United States Patent 8,781,750 (CELL-TYPE-SPECIFIC PATTERNS OF GENE EXPRESSION) - sequence listing, part 52

SEQ ID NO: 38285 - DNA, 249605 bp, Homo sapiens
gcagcgtgtagtgcgagtggggcggacgcgcgcagcccgcccgcccggcgaccagcaaggtaagcccgcgctcgcccgcccggccgcgcttgcccgctcggcggcggcagcgccgggggtgtgcgcggctcggcccccgcgggcggcgcctttgttccgcgctcggaggaggcgcatttaaagggccagctgttggagggacttgggggaccccctcccccagagcatccccccatgggcacagggaaagcggtggtccctcgcggccgaaccgtccatcctgcctgctcggcgaatccccagtctttcaaggaaagttccccagggtgcggaggatctgggggcttccagggttgggggtttttaaatttccttttttggtgggtgtggggtagtacgatcatggcctctgctaggagagaatgtccgcccgtctcagggtggctgcaatttgggtgggtggaggagacatcaaagcccgaatgggtttgtgctgtaaagtgaaactaccgaggaggggcacctctgcagcagccagaggaaggcggagggagcgagcggcgggatggaggcatctcaggtgtgttcattcatcagcatcccctggagagggcggcgggaggggcgcaaggacgacgcggttggccggacccgcctgaatgaacggggactagtatgcgccggggacacggcgcctgcccgtgccgcccgtgccccttcttctccccgagtggctgacagcatcttgctaggcagctcatcaccgacatggacagcaagcaactcctttctccgaattccccgggcatcccctgctaccacctcgctgctttccgatgtggcttccttgatacgtggtagcgccattcaagatagaggggaaagaggcttgaagtcattatgtttccttcatgggggaatgtgctgtcgaattctgcatccccatgcatccgctgtcgtaagatggctttgaaattcaccagtgcatgctttctccaggcagacaagaatttattacgctattacattgctacgtaaaagcagaagggatcccactgagcatggctcgttttgttcagtcctcggtttttcccagcatgttctgggcgagcctttggatttttgttttaaacactgagcgttgggatgcccctgttgtcacagggccgacctgctgaaattgctggaattggtttcatcgtcaataggagggaggttcatctagagacatcatggaacctatctggcgtgtcaggcctctgactccatctctcccctcaacacccccccccccgcccagccccccgcgcccttttttcctcttaagtggaggcgggggatggattggctgtcttcactctccttgtgttttgagctcctctgcttagattcaattctgtggttttggttggaaaggtatcttggtggtgatcgaagagaggagggttggattaaaagtggggtggacacagaggggtcagcagcatcaatgacagaagacagatgatggacatatctacagccttcagacaccgatgaggcagatggctgtctacagagtgaggggcgtgtgtttgggctgtgagggggaggggtggaggaggaggatgcctccagcagttttctgccccgccctctggatgctgccttaaatagccccttgccaaccaagctctgatgtctctttcttggcctgaggggaaagaagggaagggttggtctgttggcacctttgcccaaggcactgttggagcagatggttaggaaagggttagttctccaggggttgcagagagcacatttctcagctggagggccctgagaccactcctttggcgacttccctgcagggaattagcaactgaaatgaactgctgtctaccctgtggggtaaagagttgggagggtattgtcatcttgtggacgatacccgccttgttggccttttccttctcctacctgctttcatttgttgtagttggagagtttctgtatacttttcggaagagattgggcatattggggagtgggtaggagttatgggaaaggatgagcaaattcttcctggcagaacaaagcactgttcagctgttcctctctttccccttctctaaaataagagttcaatacagatagcagagtctagggttttctttgtaaacaatgaaagggcagggccaggaaagaaagtttttattgtgcagcattgataatgatcaggtcatcctaacttatctccagacccttccctggatgtggagatagatttgctgtagagggcactctatggtaatttaggatttgacctgtctctaggagaaaggcatggatggtctcaaaaagctttggtggagaagctctggaccagaggcaggacagctagctttggtcctggccaccaatctttgggctttgggctagtggcttctgctctctgggcctgtgtccttgctggtgaagtggaggatgatagggcagaaggtcttccagggttcctgacaactccactgttcttagagtcacagtttgtgatggcattttcaggttctttcctgtttgctaaattgataataaattcaaagtattgcacaatggcatagaagaagcattctaggatgcaggcttctgttggattcacatctaccttttccttgattagtgtgatttgtgaggttttactgtaagtatgtaaacaattcagagctagaacggtccagagtgagaggcacagaccccagagtgagtggttgtgggagatgagggtgggatgatagattgctgaggaaagggagtttctgtaatttgttctctttccctgtggatgtttaacttgctggtttattcatggttacacaggtgaacgtttacctatctagaagatgagagttataaaagacctctgtgattgccatgttcctcccccttccccgccaaactgaggaatttgaggggttgggaggtttggccatttttccaaggttgcacagctagcaagatgtggagctggggtgggaactcggggggatagattgtagatcttgtttccagatgtatctgggtttttttgttttttggtggtggtggttgttttgagacagggtctcacctgtcacccaggctggagtgcagtggcacaatcatggctcactgcagcctcgacctcctgggcccaggcagtcctcctacctcagcctcccgagtagctgggaccacaggcacgcactaccacacccagctaatttttgtactttttgtagagacagagttttgcggtgttgcccaggctggtctcaaactcctggactcaagcgatccgcctgcattggccttccagcatgctggggttataggcttgagccacggtgcccggcctatatgtatctgttaagccccctcttcctctgagagaaatgattctaagatggaatagcgaaacatgaggaggaaataggagcacaagaagagagagattggagaaacagacgagaaagtaggaggctggggacagattatgtggggaagggaaaaacacagaaaccaagcttggaggagaaaaggatggagcttgaaagggggaggctctattgtctctgaaacagctgagctcttctgcagcccttggggtgaagtgaggggaggtttggtagcctaggatggggggtgggggggtggactgagagttcaacctcagcctgagactgtcttggaatctccttgggattgctcctgttgaccctcagattgcaaagtgtcatggaggctgcttagtttcaggaccaactgaggcctttagatccacgggagcatgcagaatgtggacatgtgggaagtcaggtgtgcgggtggtgatgctggctgatgctgaggtgggactcagttctgctgaagtcccggtttttttgtaaatgcaaaactcagaacacttttccatggatttcgtttcagtgcaagcagcattttctccttggattttcatcggtgctttgaatgttttatgagatagtgtttcgaatactcccttttcagaggagatacttggagatgaatgatttactgaattgtagctcatttgggggagcttctggcttgtgacctaagctaagcctcagaatgtttcaatgagcaattaaagagctgtgaacagtggttgaccagagcactaaccattcaaaggcaaggataaaaggtgataatagttcaaggtctggagctacagccaacagctggccatgaacaatgtaactgactttggctaactcttcaagccctagaaagtgtctctgtgggtcctttggtggctccccctttttgtgtgcggttaggcatgtggacccgtccctgaatcttgctgtctcccattcttcttttgctacatctccctccactatccatttctttttcttacctctttctccttgccctcctccctcattctttctttattatcaacaatatatctttgtagtttcttttaatctattgccattaaaatttcatgttctctgttcttcatttcaaatcagtcgagggccaggcaaggtagctcatgcctgttatccgagcactttgggaggctgaagcaggtggatcacctgacgtcaggagttcaagaccagcctggtcaacatggtgaaaccccgtctctactaaaaatacaaaaatttagccgggtgtggtggcaggcacctgtagtcccagctactcgggaagctgaggcaggagaatggcatgaacctgggaggcggagcttgcagtgagccaagatcgcgccactgcaccccagcctgggcgacatagcaagactccgtctcaaaaaaaaaaaaaaaaaaaaaagacaaaaattagctgggtgtggtgatgggtgcctgtaatcccagctactcaggaggctgaggcagaaagaattgcttgagcctgggaggtggaggttgcagtgagccgagattgtaccactgcactccagcctgggggacagagtgagactccatccaaataaataaataaataaaatcagttgaattcagtcttttttgaatgtgtatgtgttttacacacaaaacaaaaaagaggcaaatgaaccaaatccaactaaattgctttttacttctgtgtggccttccattgatttatccccccacttcttctgtggtcagcagtggctttttatagaaaaaaaagttcccaggtctctgtcatgcggttattgttttcacaacaatagaaaaaagtttccacccttgtattgtggaccacaagggacaccctctctcaagggatgtaccctgtttctagacttccttccatggaaaaagtgtctttaatgcattctgtaacagaggcctgtactgtaaggggttaggggtgctgatagtggaggtggggctcttctcagtgactgcggtactgcttagaataggggctggcgggctatggcctagagagtatatctaggaagaattagcatcgttgttttctctgtttcctcaggctgagctaacctaactggctgtagcaggacccagacccttttggaaaagaatgagatgcttgttaactttctgattagtgttgagtgggacccaaggtatgtcttctgcccaccttgggagggtgggcacccaccgacagttgctggtgtaaagttcccggattctttgatggatggatgctgtaccgctttatgattttcttctgactctaattagttacagagaggattgactcttgatgctcagtggtcagcaagtactttagtatctaaagtgggccttgcaaacaagaagtcaccttgtcacattaggtttgtattctctgtaatatatgtgtactggttttagtataaaagtatttaagttgctttactgttgaatacaattgacgttctacgaaaatgtgtttattgtgggccctcatttgtaccagccctctgtaaatatgcatatcagtctcataccccaactggagaagccggggatagggtaggcatcaaacctgctggtgctgagaaccacccctccatgctttcctgctggctctgccaaaccaccagatgcccggtcattccctactccacgtccccaaaggccaggcccccctgcaccccccaccaggactggttccctcaccagaaggcctttttctgcgtttcctggctgatgccttctcccctcagactcccctcacatcttaaagagatgcctttcagctgggcgcggtagctgtaatcccagcactttgggaggccgaggcaggtggatcacctgaggtcaggagttcgcgaccagcctggccaacatggtgaaacctcctctctactaaaagtacaaaaaattagccgggcgtggtggcgcatgcctgtagtcccagctactcaggaggcttaggcaggagagtcacttgaacccggaaggtagaggttgcagtgagccgagatcacgccattgcactccagcctgggtaacaagagcgaaactccatctcaaaaaaaaaaaaaacaaacaaaaaaagagatgcctttcttcttgtgttcagctttctacttctgttgatattgctggttcccttgtctgtttcctcccccatattgtgagttctgggaatagagtgagtctgtgtttcttctctttttaaattaaattttaatttgtataaaactttcgcgtgtgtgtgtgtgtgtgtgtgtgtgtacacagagagtttcttttttgtttgttttgagacagagtctccctctgttgcttaggctggagtgcagtggcatgatctcagctcactgcaacctctacctcccgggttcaagcgattctcctgcctcagcctccctagtatctgggactacaggagaccaccacccccccagctaatttttttattattagtagagacagggtttcacagtgttggccaggctggtctcgaactcctgacctcaagtgatctgcctgtcttggcctccctaagtgctgggattacaggcctgagccactgtgcacccccaccccgcacagagttttgaaagacaaataggctgggtgtggtggctcacgcctgtaatcccagcactttgggaggctgaggtgggcggatcacctgaggtcaggagtttgagaccagcctggccaacatggcaaaatcccatctctactaaaaaaatacaaaaattagccagtcacggtggcgggcgcctgtaatcccagttaatctggaggctgaggcaggagaatcacttgaaccagggaggcggaagttgcagcgagctgagattgtgccactgcactccagcctgggcaacagagccagactccctctcaaaaaaaaaaaaaaaaaaaagtcaatactactagaaaaatataaaggctgcctgggcgcagtggctcattcctgtaatcgtagcagtttgggaggctgaggccggcggatcacttaaggccaggagttcaagatcagcctggccaacatagtaaaaccttatctctgcaaaaaatacaaagaattagccaggcatggcagttaggatatagacatccttgaggggctgctgttactctgtttacaacagttacttctaatgcactgagctgtttctcctgatattactatcatatttattgttacctgcttacaatgctgttttctgattgtccattttagatgttatttttatttttccttatttttctttttgtagagacagggtcttgctatgttgagaccctgcttgaggccagggtggactttaactcctggcctgaagcactcctcctacctgggcctcctaaagttctgggattacaggtgtgagtcaccatgcccagcttagaggttacttttagatgttatgtcttgatgtcttactatggattagatcctctcctctgccccccaatacttccctttctccctatcctctcattatagatatatcacagtttttgattacattgatatttggtgcttacattattttggctgtgtaaatagtgttcatgacagagccatatagtatactataatattttctttcttgtacattttttgagttaataattatcttacattttctatttacttagtttctatgtacttattgctaattctcaaagtatttgacagcatcttaagacatttgttttataacatgtgttcctatttatttatttatttattgagatagggccttgctctgtccaccaggctagagtgcagaggtgcgattgtagctcattgcagccttgacctcctgggctcaagtgatcctcctgcctcagcctcctgagtagctaggactacaggcaccaccatgtccagctaatttttaaagttttttggtagagatggggtttcactacattgcctaggctggtctctaactcctgccctcaaacaatcctccctcctcaacttctcaaagtgctaggattacaggcatgagccaccgtgcctgcgcttgttcctttttattttattactgtttttttttttttacgcccgcttggagacttccctcctataggcctccattctgtctcctttgttcttgcccattgacctctaggcctgtggcatgactcatcctgggaattccctcaccttatcctgggtgggatcctgtttcctttgttgatttattcttccacaagtttctgagagagggtctgtggaagttgatcactttaagcttacaggtctgaaaatgttcatattctacattcatattcgattggtgatttgattcatctagaatttgaagtcgaaagccatttcccttagaattttgaagccatcattccactgtcatctaggttctaatattggtatcaaaattcggataccattctgattcttgatcatttatggataacctgatttctcactgaaagtttttgggatcttctctcttttcctgtatttgaaatctccttgctttaaaaatgattggcctgggtctttggtgtgggccttttttttttttttttttgagatggagtctcactctgttgcccaggctggagtgcagtggtgcaatctcggctcactgcaacctccgcctcccgggttcaagcgattctcgtgccttagcctcccaagtatctgggattacaggcgcatgccaccacgcccagctaatttttgcattgttagtagagatgggggtttcaccacgttggccaggctggtctcaaattccagacctcaggtgatccacccgccacgggctcccaaaatgctgggattacgggtgtgagccactgcgtccagccggtgtgtgcctttttgatctgaagattgacgtctttcagtttggggaaattttcttaattagatatattttaataatttcattttctccattttctgtgttttgtctttggcatgcctattagctgaatgttggacttcctggagcaagtttataattttaaaacattttatttccttttttcattttattatatttttgtctttcagagagctatcttcagctttatcttcaactcttttccatttttaactgtgctttcatgtgtttacgtggaacatatttgcatgttttactttgtaagagctccctagttctctgaatacttgcttttcttttttagatgacattctattcttgtttcatgggtacagtaaattcctttatattaagggttttgtttgtttgtttttgttttttttatggttttctgctgttccctgctgtcccttggaagatgttgtttcttccaagtccctttttccatttgttttggttactgtatcttccattgcagctatccttccatgcatgctgatccttgactgtctatgtatattttaagaatggacaccgaaatgctgattgggcatcagtgccacaaggaagggagtcgttaacttcattgtagagtgacccagcagagagccccctttttctctactggagcagcctagatatcagcgccggtagatctttttcctggggctttcctggatagggctttcttggagaggattttacctgggtgtggggtagggtggggtggggtggtaaacagcctggccttcctgcattctgggagcctccatggggaaaggggctaggtattagtctgtttgatatgcagactttcactcaatccctgggtcttttgaaagttgcccccacctgccatccctctctcccatctctctacctccctcagctgtgtccctcccttggctgtatctctggtgtaagttacctgatcagtggatctccaccttctgctagctgaggcagggaaatcaccaggctgagcagactgcaagagggaccctgggtctgactgctctttgtaccaacttgcaggcaggcacccttctttttagctttaccctgcttttccctttagagtccttggtgcctccacttcctgaactgtctttgtgttctgtgccatgagttgggcacttgtttagtggctcctgctctgcttgcacttagcagagcagacaatgcggaaacctaaatcagctactgcatggtggtcagctctccactgctgttgacatatctcatctgctggggtctcttttttcattaagaaatgcatccgtctactgtccttttagtgggagtccagaagagagcagagataaacatgggtgttcagctctctgatttgaccaaaagtttgtttcatttcttcattcacacacttaaatttgtgcctgatatagagtatattctcaagaagtgtttgttaaatgattgaaagcccgttcctaggatgatatgcgtacatttagtcatcagatttcaagacacccaaacatacagtgttgcaaaaataaatccgtcgcttattctgagatagacataataataggcagcagatcctgcctattctccccatgcagtggaggataagacgcactgggagggagacagtgttacagagtgttgctgtcttcagccctgtcagtaactacctgagtcactttgagaagtcccttaacctatctgggccttggttttcccagccttaaaatgagatgttggtcaaggtttgattcagttctctgcattgagcacctgctgtgtgcaagccacggtgctaggattctctacgtgtctcttctaaggcagccactgtggtgttttgtatgtatgtttgttttggcatgggccacactgagttgattgtgtttggtttatatgtctttctcctggcttagttcagtgccttgtacaaagtaagtcctctgcacattttgactctccctttttctaaaccgagggctccttgtgagtatcacgtcgccatcctctgtatctcctgtgtctatcacagttgttggtacataggaggtatgtaggaaatatgaaaatgtgagttgttctgccagaatccccagaccctgcttggagaacaagcctagcttgttgagggcctagctgcacgttccctggcccacttatggagttgggggactcaaatgcattggtattaaaatcaatggagacagcaattctggaccacagccttgacactagaggattgttttctcccaaacagatagtagtcatatattcatttcaaacagcacagtggagcggagaaagacttgttaccagttaagatcagattcatcttaaccatgaaaatgaattatagatgtatccctgcattcaggtgtttaaaaacatttaagtgttttttcataacttcttttggttttcccacacttctgagtttatgtgccaggactagtaactagaaattttagggatattgatttagctcagtggaagatattttttattgtaagagcaactccctaccagactgcattaggaagccctgaattctgtgtcaagccaaggctaaatgtccactctccagggaacatgaagaatcaatgcctgtgtgggagatgaggtactattagagcacctgaaaagtcctttgcttttgatttgttcatcaaatagttattgagcaccggttatagaccagcgtccatgctgggctctgggaatatagcagcgaacaaagagaaatggcaccttccctcttggaatttatagactagagctgagctgtccagtatagtagctagtagccacatgtggctattgaaattaattagattgaaataccgttaaaaattcagcttctcggtcatgctagccacaaatgctctgtaggcacgtgtggctagtgactgccctacggtcggcatgggcagttgtagagtgtttctgtaatctcaggaggaactcttaggcaggctgatcatagagctaagattctgtgtttctagacccgacatttatgattagcatttcatggtggaggcaactgaggcacagaaaagccatttgtttaagactgagctaggaacaggtctcttatctttgagtgtggctcttctctccctgaggtgaggtagggcaactgagagtatagtctttgcactcaggctgcctgggttcaaatcctggctttgctacttcctagatttaggtcttagggcaagtcactgccctgtgcctcagttgtatcacctgtgaaatggaggaagtaatagcacctatctcacaggattgcagggaggattagatgacccagtcattcaagtctttagaactatgggctgggcctggtggctcacacctgtaatcccagcactttgggaggtcgaggtgggagagtcagttgagcctaggagttcgagaccagcctgggcaacatagggagacccccatctctacaaaaacttgaaaaattagctgggtgtggtggtgcaagcctgtagtcccagctacttggaaggctgaggtgggaggatctcttgagcctgggaggttgagcctgcagtgagccaagatcacagtactataccactccagcctgggcaacagagcaagactccaactcaaaaaaaaaaaaaaaaaaaaaaggaaagaaaagaactatgcatgacacataagtagtaataattcagtaaattctggttactattattgagactgagaaggggacagaagatagtgggagagccaaggaggcattttcaaacagcagagtggagtggagaaagactgttaggaaaggctatgcttgtagagctgactgaccacctggggagggatacgtaatggaatgtttctcagccaggggctgctttagtcatgtgagctgatgtgaaaatgccagtatgtccatgaagtcctctgagtgtcacaactggtcactggtcctctgaataaggatcctttcagtatctcctttctcctggcttgcctgcacataggctggtccccacacccctttcccctgtccccatgcatttcttctcccctcactacatctccatcatggaatgggtgggacatttaccatcacccctgtggagcagcgggctgcatcgaaggaatgcagaagagagcagggacagaagcccagctgggccctggtattttcttggaggtttgcatctcttgttggtgtcattccctctgttgctcagtctttcacagtgttttaggggtgccccattttgctgcatgaggagaaagagagctctgatgttagccccagggatgggagggtgccccattgggtaggtaaatctctgcttatatgtggaactttggcttaagaaatactttatttatttattttttgagatggcattttgctcttgtcacctatgctggcatgcaatggcgcgatctcggctcactgcaacctctgcttcccgggttcaacctcagccttttgagtagttgggcttataggtgcccgccaccacacccggctaattttttgtatttttagtagagatggggtttcaccatgttggccatgctggtcttggtctcctgacctcaggtgatacaccccctcggcctcccaaagtgctgggattataggtatgagccactgtgctcagccaagaagtagtttaacagagcagtctcatcaacactgtagacatgggccccaccctgcaggtgtttatttcttcatgaacacccagagggcagggctcttgtcttccacaacagacatcaacagtgcatttcaggctatgaaataggaaggttctagtatgatacagtgcgtgtggaggtgcaggtagtgagggtgctctagaggtacataatggatgtggcaccttgcctcagccaggggaggcacacagggaaagtactataataggccagtgatgtatctgaggtcaggtgtctagtagtggcagaccctgagctgacctgtgaggagactgttcctagcaagcctgattctcagcatggcatagaaatacaggttctccctgagtaccagtgatcaggagtattgagtgcttggccgggtgcggtggcttacgcctataatcctggcactttgggaggctgaggtgaatggatcacctgaactcaggagtttgagaccagcctgggcaatatggtgaaaccctttctctaataaaatttaaaaaatttgcaggtgtggtggcacgcgcctgtagtcccagctgttcgggaggctgagggatgagaatcgcttgaacccaggaggcagatgttgcagtgagcagagatcatgccactgcactctagcctgggcgacagagcaagactctgtctcaaaaacaaacaaaaaaagaagtattgagtgcttgaggcttcacctatggtacagtttggatgtgtgtccccactcaaatctcatattgaaacataattcctaatgttggaggggggcctggtgggaggggattggattgtaggggcagtttctcatgagtggtttagtatcatcctgttggtactgtcctcatgatagtgagtgagttcttgtgagacctggtcatttaacagtgtgcagcccctccctctttgctcttttgctcctgccctggccatgtgacatgcctgctccatgcctgctcctccttcaccttctgccttgattgtcagtttcctgaggcctccctagaagccgagcagatgccagcatcatgcttcctgtacagcctgcagaaccatgaaccaattaaacctctcttgtttataaattacctagtctcaggtatttctttatagcaatgcaagaaaggactgatacagcctgtaactggctttgccaatccattcttgtttgggccttgatgttccatcatcttgggtggtggtctagcttataacagttatgataggaatgggtgcttagtagatcccggaattgttcttctgtttgcatgtcagtgtgaaagctcattacacatttatataatagcttatgcattgatcattaacatcaacctgtgggctgacctcggtttcctagtatgaaaggccactaggacataccttgtgaaattcagtttctcttattgcctggagtctgtgtggaacctggtggctgagcatatgagcagtatgtctgatgtgtaaaaagataattcatttgcatattgcttttctccacttagaatttatcttcagttggggcagatccagtgttgggtgactgtttcctgtgagcatggaattatggccaggggttgtaattgcttataacaaattgacagggaggaaaatgggactgtttgcctggtacgttgatgtaagggagtctttccagtgctgctgtaagatatacagtgctgagtcttctgggcttgggcctttgtttctctcccttttttttttttttcaagatggagtttcactctgccacccaggctggagtacagtggcatgatcttggctcactgtagcctccgcctcctgggttcaagcgattctcctgcctcagcctcctgagtagctgggactacaggcgcctgccaacactcccggctactttttttgtttttaatagaggcagggtttcaccatgttgaccaggctggtctcgaactcctgatctgcccacctcggccttccgaagtgctgggattataggtgtgagcgaccacagggcctttctttgtagacagtgcacacaggaggctggcgataggagactgggcagagtctagaagccagggatgaggtaagaaaggctggaactggagctgggagatctgagttgctgccccagtggccttgccagtggggaatctgggtggagaggtgaggcaggagtgggaactgcttttaagcaggacaaagtgaatagaggctctggagaaggaaagcaaaatcccaacagggacagaaatgagagtagctggagaaagctggagcttgggagagctgagggcctaagcagggtttggtggttgctgaaaatcaagttgccaggcccatgaaccgaggccaaggcaatgttaggccttttaggactattttgtgtttgctttgcagggcctctatgttggacgtggtacattagtgagccagcaatggcaggtgtgagggggcgaggccccctaggaactgggaaatattagtcatgcctgagcactgttagaagatacggcttctcatcaagacagctgctccgggaggagggtctgcagccgccagcctgcattacagtttatgttcttggttttgtctttaattattaaaggcacgggctatttaaatactcacctgaagcatcattgtgagtaattttcccttcctggggtcaaaggagctccagcagggaaggggtttggtggcctatggttctgggttctccaggtgcttccctcaaggaatgcaaggatgtcatgaggacgttgtaagatgcccttgacagtagggtgcagacctccctgggctgtcttgcagattggcatttattttgagtgagtccttaatttgaggagtatagggtgttcccttttatcataggcaaggaagaaacagtgctgttagaagatgtaaaatatttaacactctctttaaaaaattaactgtccaggaacctttgattgctggtgcctatggcaacatgcatggttttcaggagtgtcttctcggagtccctgggctcctcagaaggggtgatatgggggtccatgggttaggggtgatgtgagggtccagtcttgggagggctggctgggaggccaagagcccacctgttctgcttggcttagaggctgggcagtagcagggctgagccactgcctcagagggtggtagtcgggggtggtctgttttgacaagtggagaggagtgaaggggagaaggagagctcgccatccttcttgggcttgctgagtttatgcatttgttttgttttactggcctctgttagtccctggtgcctaccgttctccgtccagcctcaggacttttgcgcatgtggtttccttagcctggaatgtaaagggagccttccttcctgacctggttcgtgcctcttacccctcagatctcacctggagcgtcatgttctggggaaattatctctggccctgcttcctaggtgacactctcctgtttgagggctcttatggttcggtggtctttgttacacttttttggaaaatcattgtttgcccaccctaccagcctgtagggttatgacaacagtggccagggctctttcttgtcaccagtatgtccccagtacctagcacgggcctggcctacagaggggccccactatctgttaagtaaattaattcattttttcatttattatgttttgggttcggtagagatcctgggaatacaacgagaatgaaacacccctgctgtcctcaccgagctcctaaactagagcagtagataagcagtgctcaagatagccattgagggcaggaagaaagctttatcagttggagttctgtttatgctttaactaaaggaaagacttagctttcctatttataggagtacagatttataattactttgtaagtatcctcaaaactatttcacaaataggaaggtgtgatcaaaaagtttggagactactggtctgaagggagaggtaggaaaatgaaagggtttttttgtttgtttgttttttgttttgttttgttttgttttttgagacagagtttctctcttgttgcccaggctggagtacaatggtgcgatcttagctcactgcaaccttcgcctcccaggttcaagtgattctcctggctcagcctcctgagtagctaggattatagtcgaaagggtttttatgccaaagtgtgatgaacaatatgttagggcaagtacagggtgccatgagggcatgtgggttggggggtgagctggaatccaaccagaggacagagggaccggcacatgcaagggcaggcttagtggattgggagaagggcacatactttagtaaggcaggaggagggcttgctactgggattgggaggggttaagagttaggattactaagagagatgagactgggcccctgcctgcagcatgggcatagtctagcagtggtgcaaatgtgccttaggagagacacagcatgaggaatacttggcattcagaagagggtatatattttgcttagcagggatcgggcctggtcatgctttaaaaatggaacatgctcaagatcacagaggcccctctcttcattgtagaaggggaagaggagggtgctggaggttgacttcaaggctctttaaagcccatctcaggagaatgacattctccttggtctcctgctacccagtgggatttttatcctaatgtgatttagacccctcctcaggttttattctgcaggttacaacattgtataggaacaagaaaatggcgtatggtatatgtaaataagcatatttggtgtgtttacttacctgtgtaatcacgcacactcccttcttttctttgtttgttttcaagtcccagggcttgaagtaattacgtaattagaatccacaaagagtatggcgagataaggtgtaattaaagaggaaagcctaattttggaagaatgataagaggtcatttgactcagtctgggcccaaatccaatcttggaagaacagtgagaggtcatttggatgtaggcagcttgaggccacccaggagcccagactggcctcagaattggacagattctgtttcagttcactgtgaaagccactcattgagcatcctcttggtatagggtattgtgggaggcccagctatgagtaaggaacagaagtcctagatctcagggaggacatggggaaatagggcctgagagtaaagtggagagatggctcctggggacagggtggggggcggtgtggggaaggattcacagaacaggtagcatttaacttgtgctttgaaatgtaaggagggtttcaagaacatggacaagaactttctgggtctattggagacactcagataatatttgtgggatgaatgccaggctgaggttggaggcagaaggaacatggccatattggtggatggtcattttgcagtttggtgatgaggtcaagcttgtacagctcagacagtgtagtgacaactcacagccaggaggccaacaggcttaggccctgagtgtgtagtgaggattgtgtgcagaggagtcagagagcactgcgggggtcatgggaggcctccttgtggagggaaacttggacagagccttgaaggaccaataggagggaggaaaggggagaaggaaggaccctccaaaggaagggaatgacatgggtacctagagagggattagagaggagataatccccgcaagaggggaggggtacataggggagcagggtgaaaccagcttggcaggggtgggtaagactggtttctgggggttgggcatgttgggcaggacaggattgatccagtgggatagaggagccatggcagattgttggacaggtgagtggcatgaaaaaggcatgttagggccagaggaatctggccctggtgggtgggatgggctctggggagctcagcctcagctcctgggcatgaggtggtagggaccaggcagtaggcttgggaggttggggccctctgcagtttcttatcacggaagggttctggtcttggatgagagaaataaggcaagggaggagctggaggtatttgcaaggtcccagcctgggagaatggagatacttgagacaggaggggtacccgctgttggggaaagagggcgtgagtggggacttggtatgttgagggccccaagatccctcttctaacccccagttgtgatctagtggagagacctcaggccagtcccttcatctcctgagctccatttcattgtcagcaggagtcactgcctttacggttccatctcatctcagtgcagtcattgcagccctgggctcaggcaaggggaagggtctaggctgaggatttgtgaggccatcccttagaggtgagaggagaaacacattgtcctgttccttgttctcctggagtgagcaggagcctgggggagggcctctggctgaccagcttggatgaggagttgtggggaagaaggggctgtcctgactcaaccagcccatctcagggtggttttgagactctttgacgaaggggtgtatgaattctaagtttatgcagatgttgaggtatgtgcactattctggggcacagcagggaaggggttaatcttcctgaatttgcagaaaggaaattctcaaggtagggaactgatggctagtgacctcctacctaacctccacaaagctagtctttgggaaacttaaggccttcggtctttagagacagagtctacagggagggcttcctggcagaggaggacttggacagagccatgaaggatgaatagtatgtgagaaaggagagaagaaagaactttccagaatgacatggagttatagtacaaaattcacagaagagattccagaaaggaaggcatatgtttttgaatacctagtatgcctaccagctctgtttgtcaggtgctttcatgatctttgtcttgttatctttacaccatttctgcctctcttattagcccatgttacagataaggcagtaggattagaggggtgaaccactttgcccaaggtctcagtggtagggtgggatttcattttattcagatttctgactccaatggcaacaaatagccatgccactatattctgctggctctctgggaatataggaacaacagataatgatttgtctacatgactttattcccaagttaaacacttacctaaaacgcggctgcggctgccacccctgctgcagctttgcagtactgtgcaagaccttagaggccagtgatgggaggccgttagagctcctctgagtctgaaaccctcatttatagatgaggaaactgaggcccacaaaggagaagagaatgtgccaaggttaggggcagaatgggaatgagaactagaggagtctggagactttggcgcttgtggctgtttaaaggccccctaggctccctgtgtaaaagtatgtttttagacaacaatgggaacctttgtctggagggttggtctgaccagggttgaatatgaaagggtctgtgtgtatgtgtgtttctttcctttgctttaacctcagatacctttgaactagcaggaaggattctttcagaccaaaggttaagactaaaggcatttaacaggtggaaagagcataggaaggagggggaagatcagaagccacagaaatagaagactaaactccaggcttggataaaaggaattttccaagcctgtaaataatcactaacgtttattgaacacccactgtgccaggcagtctttacatgtcattttatgtaactgccatcgcttccccatgaggtaggtgctgtttaattgttcccattttgcagatgaaggaactgaggctccaagagtctaagtgacctatttaaagtcatggaattagtacaatgtagagccaggactccaactcaccagatcctaaactctccctttaactcccaaggcattttattggactaggtgctcccaggtgcctgagcatatgaggatatatgaaatagcaaacttagggaggtcatcctttggcaatggttctcatggggatgtggattttacccctaggagacatttggcagtgtctagagtcatttttggttgtcacaaatcttactggcatataataggtagaggccaagcatgcttccgaacatcttagagtggacaagatagctcctcgtaacagagttaccccatgcagaatgtcagcagtgctgaggttgagaaactctggcctttgggatcctggttgtatcgttaccactcagagcacagtgctagtggaaggtcccatctgaggaacttgagttgttgctttagctctagagacttaaattgtaccttactgaatatttatagtttgggtttgtcactgactgagacttgatgggccaaggtggggctagtggtgggtagaggctggaaagaaaaattctagcaaggtgtgaccagccatggtggcctagggctgcatcttagttgcagcaggtgagaggtggttggggtccactccaggctgctgagaattgatttgctcacttcatatgtaactgaaataagaattcagatgcagctaattgtgcttttgtaaaatttatttttatttttttgtgagacagggtcttgctttgtcacccaggctggagttcagtggcacaatcacagctcattgcagcctcaacctcctgggctcaagtgatcctcctggcttggcttcccaaaatgctgtaattgtgctattttttaaaaaaattaagttattgctctgactactcagcatcagaaacctccgaggaagggttacatgttgcagatacactcagatacaagtatgctgcttgccaaattcctctgttaccagttactgtttaatctaactcgagtcagcccctatccacttggagaatagcgcacaaatgtggggagccccaggacccttggcttttactggagcctcccatgctgaactggtcagtcagagcagcccgtctcctgagggcagtgctgaggaaaggggccactgcgttaccctgactgctgttgctttccgctccctcttccaggtcagacatggaaaggtggctctgtggacatatctcagatggtgacctccccaggcctaatttctgccccagcgcagccgctccctctgtaacactgattgagtgctagcactgccttgtcaagcatctgctgtggccacagacacataattatggccctgccttcaccttgccggccacttcctttctatcacctgggactcaccccaaggcctctttcatgaagctctctgatccctccaactaacagtgtcccttcacaagcacctttttttttttttggagacaaagtctcactctgtcccccaggctacagtgtagtggtgcgatcatggctcactgcagcctcaacctcctgggctcaagtgatcctcctacttcagcctcccaagtcactggactgcaggtgtgagccaccatgcttggctaattttttttggagagatggggtttcgccatgttgccaaggctggtctcgaactcctgagttcaagtgatccgtccaccttggccttgcagaatgctgggattacaggtgtgagccaccacaccggcctcttttggctttttatccagtcattaaattctgagtctttcctggatcaccttctgacctctccagtggcccagccactcactagctgtgtgaccgcaggtgaagcagcacagcactgaatcacttcccttccagcatcagggtggaatgagagtcatagttgtgggacctggggtgttgttcctctcaggtcagtggaaattcaggttctcctttgatctcatacagattaatggagaattgagaactagttgttagcaaactctcttcagattaagtaagtaagcttctttaatattaattcttcacctagcaaatgtttgttgagtacccgctctacccaggggcgtgtgataggtttagcaggggtgggaaatggacctctttggcctagccctcaaggagcttactacagccttgtggggtggtggttgtgtctgttcaaaaccataacagggtggcttctccagcatgtcactgtgtgtcttccttaggaccaattatcacggttatgtgagtgtgcatgcacctcccccaacacttgaattaaagtttcagggagatggaattttttcagtctttttcaccatgtgccataacaagcaggcagtacatatttgttggatgaatgcagtaatgaatgatactagttaaattctgttttgaatgcagggtgagatttagacctacctagatggataagggggcgttacagactggtggggatggggatgggtggaggcaggaggagggactgccgtgagcaaatggacagagacagtgaagcccaaggcatgctgggcacctgcaggcccactgtgattagaccatgtggcacagtcagaacgcaaaaagactgtgaagtaagtcggacccagatggtggagaatcttgaattcaagccgttagagggattggatttattctatatagtaggatgaccttgtggtccagtttcccagggtgcttcgtcccaatgtgactattactagtgcccccttttcctcttaagtgtccctgcttggatgataaattacatggtcttgcaatcctcaaggccatatggcacccctgaaggtttcacagtgggccatggtcaagctggtcttaggaaggtcagtgtccacagtgcctgctggagtctaggggcaggagatgagatgtctcctggtctaggcacttcaggccttagctggaggagctgtagtgacttctgaaaggaggagatggttacaaaagagattaaaaatccaagtgacacccacacatggtctctaaaaaggctccaaagtggctcttccagcatagacccattctaaagttcagggatcccggacaggcatttttctaacttgaggttatgactgattaaaaaaaacccccaaaaaaccaaaaaaaacattgtgcctacttcctgagcaattagaagttaagagaagcttctgcccagcctctaaaatggcctggtggaactcactggtattcactttcctaaaccccggcattgttccttggaattcaaaataggttatgaatgtgcttgatgtcaggaaagataaatctgtgaggaggactgtagtcaatacatttcctttttaagtagaaacaatataaagagcttaattcagccctgaatcaatctcactttgttgccatgattgtgtaaaacctgaactgctttacgtctgtcttacaatgtttatattcccctgatgttccccgtctcagccggccgtgcagagtcccagcctttttaggccatgcacggctctctcttcttgaggctgttttcttgtgtgctgccaaagggctgtgcgacgagcagtgattttatttcatatctaggggttctcttcagggtggctattcagtggtgcccgcaaatgagcttccttgtctaagcaagttggaaggctaaattcttttgccttttcctttccattaaaagattattaaatgtaaaaatagtttgatacatacacatggtttggaaattaaggcactataaaaatgtatacattgaaaaatttcattcttacccctgctgggtcccctatactccctccctcaccccacctccattagctggaatgaactagtttgtccagagcagttccggtttaccttctttgttccagtgaatgatcaatcacaccctctttcattttcaaaagtgtcccagtttaggtgatgaattatatattatccaacagataggtagttacttttatcagtttcttgcgtatccttccaagatttctatatgcagatacatacatggggaatgtgtataatatatatatattgcttttgcctcttaacaatggatcctagaaaactcttatcagtacaaatggagtgtcttcattctgctaaactgtctttggagagtaatgtttgtagagactgatagttagttgcctttcccttggtttatcagtttaattgctgtttagggcctgcttctctttatctagagagagatggtaggctataggaagtgaaggcagattccttcacttaggaaaacccagttcagtagtaaacccatccaggatgcatttgtgaagcaccaactttatgcctccctaacatggtactaggcactttggatgaagtggtctcttcttcatctccacttgttcacatccttcaagttctagctcagatgccttagccctcatgaagctttccctgatttgctggccagaattcctgggcatctgtatccatctactcatccatccatctctccacccatcatccatccattcatttatccatttcatcaactagtgcttattgagtccctccttgtaccaggacttgtgctagatatgtgaggatgaacgagatgttgagtctcttgctacgggagacagacagatatggtgcagtgtggtagctgcaatgatagttatatgccgagggtgttggggaagcacagagtggagggtgcctgatcactgaacttgggagtgtagggaggtcttctgaagaggacacttcccctaatggtacttgcttttcactttctcctctgtgtttgccttatcctcactgttagactgagatgcttcgtgctttcttcagctctggccccctcccttgtcactgcaacccctagtgtagccttcttcatttaatagtcactcaaatacttattgaatggggaaaaaaagccaaaatgaattaaataggcctacccgaaggatcttaacatcaaaaagagcaggtgagatgttctttgctgcccttggccttcacggtttattcacacaactcatgtcctgaaagggcttctctaaattggtgctgatgcctccttccagtctccttttatccacaccacacagtctctgccccctgatcatcccttagcattgccatggtaggaaacccctatgactctgactagtgttgaaggagctgcatgggccgggcgcggtggctcgtgcttgtaatcccaggactttgggaggccgaggagggcggatcatgaggtcaggcatttgagaccggcttggccagcacagtgaaaccctgtctctgctaaaaacacaaaaattagctgggcatggtggcaggcaccggtaatcccagcgactcgggaggctgaggcaggagagtcgattgaacccgggaggtggaggttgcggtgagccgagatcacgccactgcactccagcctgggtgacagagctagactccatgtcaaaaaaaaaaaaaaaaaaaggaaaaagctgcatgattgggggccccaagtcccaccccctctctggtcttggtttactcttggaattaggggcatagctgtgaccccttaggatttctggatatttgacatttcaaaaacaatgatttctagacagcctggtggctcagccagctccttcttttatcttcttctaataaatccagcttcctttgccatttcctggtgccacagggggtgatctgtccaggataagagatagccaggccaggaaaatgaccttttaataaagttaaaatggccaccgggagagcgggacggccagtcatgtggccgtgagcctgtttgctgtgctgtgtgctgaggtccacaagaacagaggtccaggtagactccagctgtgcagctgtggaggcaaccagcagcagtgggttgtcctgggagagaattttggctgaatgttagcagacggtttcctaaaaccacgcagaagcagccttttaggggaagaggtgctatttgtttgacagctcatcactccccttttggttgtcctcatctgttctttctgcagtttttcacaagtgaaaaagtgggatggtgtttctctggtaagtccattttggactgtggcatagtgttgtctgtgtgcctggcattgcactggacatctctacattccattaaatcactggttcttaaacttggggagcgtaagaatcccctggggtgcttgttaaaaatgcatattactctctggtggacccaaaactcgtgatttttaatatattccctaggttatgcaggtcatacccagattttttcagctgcaagtcagaaaccctaagtcagattggctatgttttgcagtgggcaggcctatgcgaacctacccccaaagttcaaggatgctgacaggctgaagaaagaggctgatttatctagtttctcagaaagaaacattcaatagggacttatgaacagaaaccatgtctgtgtctcggatggtggtgagacaagatggtggatccctgcgctattacccccaagacccagggtttatatacggtaccatagggagggagtgacttacgaagggatgtgtaggacatttgaagcatgataatatcaaggttgttttcacctaagggcaggatttatgtacagtctcttagacaaagaagaaccgatacactggaaatcttagaggccttccatgaacagtggttaatcagaagtcaatgtgatggattaacattcaagatggagttgtctagcctgcacaggatgacaatagggaaattcattgtctttcaaacaggagtggtttcatgtggactgcaatgtgaatcatgccccctggagttgtgcaatggggccattcttaatccagacactgggcgggtttgggattgattgtttcagtggcttggtgatgtcaacaagaccccagcttcttctcatctctgtcatccttggcattatcttcatttgcaagctgggaatgagacagccacagcatttccaagcatctcagacacaacattcttggaaagaagggtataaatggattctggtgcttcttctcaggagtcaggaagcttttggaggcaccaccagctctcttctcatcatgccctcttggctggagttgggttacatgtcttccctgagtcaatcactgttgactgaaaggggatcccatttcctgagccatctggaggtggggtgggtacctgaacagagtggaggctctgtcaggaaggaaggagcaggaaccagaggccgggaaggttcccagcagggcctgaggtgcagggggtgtgcaggccacccttggagaaacccttccttccaccatcctggacagctgggggttgttggtgaggttatctgtgtcgtgcagatgaggaagtgaggctcagtgagggttagtggcttgtcttagataacaggccttgtaggttgtgggggttgggactgagggaacctggggcatttgagaggcctttttagccccaagagagtaaccatccccttttgccttcctaaggtgtccaagctgcccccttcatttctgatttctcctccatgactgcatttatttgtggcaggaggctttcctgagtatttcttatgggacgaaatctcagggcatgagaaaaatacatatactgtgttttcccctccaagttgactttgcctgaaagtaattgaaataatatcagttcctattcggggagagagttaaaataataaaacgtaacttaagaggtcgttgttaggatttaaggtcacacaatgcacatgttggcccctgtgcatgttatcttaaatcctaacaacaatcccttaagttaggttttattatttatattgtgtggtggggaaactgagacctgggaaggtgaagttgactgtggtggattgcacagctcgtcttcgggggtggacccgggacgggggctgcctcgttgaaagtccgtgctgcttctccatgccacgctgtggcttatcagcagccaccagccttgttttgcccctgaaggcaggttctcagggaaagaggttttagtgtcaaaagagttccaaatgagctgaatgtttcctatgggaataattctcagagcattaggaaaaaatatcctgaccataataaacacaagaaagaatcaggaaatctggtttgttatatagcagctaaaatgcaaatagggaaatctctcaaaaaggtttcaagggctgttggctttgaaaatggaaggccccagttaagacggtgagaaaaccgtactgggtccaggagacgactgatacatgtggccactgtggcagcaatgagtggaaagtctgcacaccttgctgtgagccccagttctgctgcttttgagctgtgtgacctccggcaagtcgcttagccttttagggcagtttctgcacatgtgaaatggggctctggctcgcagtttggtgggcagagggagcctggccagctgcacaaggccttgcaaaggtgaaggagtagcaggtgtaaaccacagagttggcacctctgagttggaagtttagtgctgctctacctggctgcgagctggtagttgcctagagtgcggggatgtggcagagcatggcagagcaggctgagggcaaaagtctggctttgacttctcaaagagaaaccgtctttgcctgaaaagcccctctctagctgtggatgtttggagaacctcccttggtgctttgcctggcctgtgcaccagggagtattgtatggggaccgatgtcctccacagatgccccagggcaggtaacatgtacagggtgggcagagataagtgctcggttctcagtacagacctgtgggaaggtctgagactcgggaagctctggctaagctgggaggagggagttgaaggaatgtgttgagggtggaccacaggtgtgttggggtattcacaggggaggacctttccaagtgctgccaatacaactctctgatcatggtggctctggagagaaggtgacttgacttttcagatttgagcagaggaaatactaaagtatttctttaccccagcagagcacatctacaactttgtagggttttgagtctgtagtgagatattttagattagtttctccctttcattcttcctgcctccctccgtttattgaacaccttctaaacatttgttgagcaacttctgcatggcaagctgagctaggggctgaggtttcaaagacaaaatcattgctctcaaggagttgtctcataggtaaacaagatgattacaaagctgtgtgataagtactaacaggtaagtacagggtcctctgggagaggtaggaaggaacacctggttgtgtctggtgggaggaggtgacacctgagctggagctgggatgaagggaaatgcagcaggtgaaccagcgtcttggaaggcattctatgcagagggtggtaacagcgttcattcttggaataaaagagttcatgaagactttctatgtgacagtggtgatgcagagatggatgggacccagtccctgccctgcaggtgttcacagtcaggtgaataggaagtggcagtgcaggtgacagtgtttggggtgtagacagagttctgtggcaagaaacacaggggccctgctgaatccagttattgctattcgcttatcagtcttccttccaggggacctcttttgcaggttctttcattgggaagaggctctgtttaaggacctagcttgctgtctgctgccctaggggctgaccatgctcttcagcaatttgggttataatgtgaggcatctattcttatttctagctttcttccttgtggagccattattggacttaggaagttggacttgggcaagtcactgcactactttgggcttcatttttcttacttacaaaaatagcccattggaccaggtcagcgtttcctcaagagttgtctagggaccacctacctttgaaaggcatggggtgcttactgaaatatggagtccttatggggcagtgccttttttgcgttcatacagttaacctttttaggggctgggcctggggttctgcatttatcaagcactccaggtgattcttaaacatcttagagttttgggacctctgggctacaagatttcaacctgcaatcttttcctccctaatctcctcagctgtatgtctacaggaactggacaataaaatgttagctttttgaatgttttatcgttgcagtgatgccctcggcaaactgcttggtagtttaagtgtccagaatcttgacagtgtatgcttatgaactgtttctgcaggctgtttttgatattccttaaggaagaaaagccttgttaacaggcacctgaatgtggctgtcagaatctgtttaagagctgaatcatgacagcaaacactcatctcagcctttcatctctggctttggagtatatgactggcttcccttttctgagtcattctctcttggcctcctacattctgaagaggtcatttgcattgtctaacatgggagccaaaggtttcaacttctctgacaaatggaatctccgctttggttccaaactgaccgtctttgtagggtcctccagggagttctcagtgttttaatagctgctgtgtgggttctcatttgttggtactgtggaaacagttttttttttttttttttttttttttttttgagactgagtcttgctctgtcgtccaggctggagtgcagtggtgcgatcttggctcactgcaacctccacctcccgggttcaagcgattctcctgcctcagcctcctgaatagctgggattacaggcatgtgccaccatgcccagctaatttttgtatttttagtagaaatggggtttcaccatgttgtccaggctggtctggaactcctgacctcaggtgatccactcacctcggcctcccaaagtgctgggattagaggcgtgagccactgcgcccagccagaaacagtttttaatatacaaagtaagtaaataaagagtcttaggctttatatggctgcctgggagtcttccccagtttcttatcctttccccttggaaatctagtgcctctaagacttcacagtgttggtgatgttgagaagctgttgcctaagaaccattctcaggatgacccctttatatcattcaggtgtgagtgaaatggattttggacaagggctgggccaggcacagcactgtgttctgacccgttacgaagaggtaaaccttgacaactggtatcctagaccttaaaaattaaaaattttcatctgggtcttggttcactcctcattctattattctgtgttttggttttccttgatgaaatcaatctgtaaacacagctctgcactagtaaattttaatgaagccctcgacattacccaggtgggggaaattcagagctatctttaaacaatgtggtagttgcaggtacacacccaagaaggcagagaagggcatgagccttctctgtattctccaagggtcttgcatagtgttctgcccacagtgggtgcccagaaagtggctgttagaagaatggacttttaaaaaataatagactgataattaaactggcaaaggtatggaattcaaagggtggctcagtgtggttttggatttgcccttggttcttcctcaagtttaattttcatggagatatcaattagatgcaggattagttgcaatgcagaatggcagagaggggaaaaggcagacgtcgtatgcattttaagttcttgggtacatctgttagttgtttattatttgccagtcactttgttagacaatcccaagaggttgacaaaccacttccttttgtgtccagggaaattgaggctgagaagtgcaacaattggtgtaaacttatgtagtgaagctattggcaggcttgctgaccagtagtcaagaaggattcatagagtgccgcctctctactggatcacacaggagttaaatttagctttgtgaaaaatattagaggtgatggagatcaactatacattgtcttggggtgtatagttgctttgtgacatttctgttacatggctatttggcctctgcttgcatctttccaaggacagggagctcactacttattgagtcagttcattttattttttgaattattttaattgttaaaattcttaattaattaatcatttttgagacagagtctcaccccgttgctcaggctggggtgcagtggcgtgatctcggctcactgcaacctccgcttcctgggttcaagtgattctcctgcctcagcctcccgagtagctggtattacaggcacctgccaccatgcctggctaatttttgtatttttttagtaaggacgaggtttccccatgttagccaggctggtctcgaactcctgagctcaaatgatctgcccaccttggcatcccagagtgctgggattacaggcatgagcccctgtgtccggctaattgttaaaattctttcatatgagctgaaatcatcctgtaatacagttttctcatttagaacccatgtcacactagtttttacaccccatgattcatttcgtcattcaaacgtatgtattgagcaccgactgttttaggttcaggaggaatacgagtaaacaagatagataaggtttttgccctcttggaatttagagcctggtgttagtacagtggaaagaagattgaactatatgtcagaaaacctaagtataagccaaagaattttacagaaagaaagaaaagaagaagtgaagattatataacacttataaacttggctaagacacttgagtatcagttttcacttcatttaacagaggacattatcccattggaccttccagaacagtgaaggctcgctggaataatgtaccttgaaaaatgttaattgctatgtattaccaagaggagtagtagtagctcttgcttctgtagagtagttcttaaagcatggttcttggaccaccagcatcagtatcacctggaaacttgtgcaaattctccagccccaccccagacctgctgattcagaaactcacagggtgggggccccaaaatcttttttacaagtaatccaggtgaattcgatgcctttcctagttggagaactactgctgtgggttagagcaataattctcagccttgcctgcacattggatgcgcctgagagaggggggcgctttcaaaactatatctgttccccccaactcccctcaaaagttagatcaggatctgtggtggggcctgtgcagaggctgcccaggtgatctgcaggtgcgccaggtctgagaatgctgctgtggccacagggcccagcccggagggacaggggattaagataaggtgcggcagccttggagttacctgggttggtttgagtctgagctctgccccttcctggctctgtggcctttggcaagaggactctggcctgagtttccttatctgcgtagtaaggataaaaatgcccatctctcagggttgttgtgacagtcgatgagatgatgtatgcaagcctgcaagcatgtgtcaggcacagggttggtgaaggaggactgaacttattgatggtagctgtgggtatctgagggtgatggtgctcatctttccctgcagccctctttgctccatattaagcctctttagttcttccatccgggacataaattccagcccccctttttagaaaactccattttgtccgtttctctctttaaaaggtggtatccaattagacaatatctatcaaaattacaaagatacccactttatcctataattccactttgtggaatctgtcctacagatatacctgcatatgtgaaaaaagatgtatgtccatttctgacagcattgtttgtggtagcgaaagactggaaaacctaaatgtccatcagtatagtgtcttcatgcaatcaaagactgtgcagccacagaaagaaatgaggcagctttttaagtactgacatgggactctgtagcatatattttttatgtgaaaaaataatgttaagctgtatggtatgctatcatttgtgcaaaaacaggacaggacatttgcttgtatgtgcatatactacacctggaagggtacaaaagcaatgggtaatgttggttgcttttgacttgggggtggaatagggacttttcactataaaccattgggtgtcttttaaaccatgtgactggaatctattaaaaacaatacattaaaagaagtgtggtgccctgagctgaatcctccacttgtggcctgaccacagcagggtacagtgtgagtattaccattttttctgtgaaccagatgctgtcctacttttaatgcctttgaagattgtattactctgggcactgtgggctctgatgaaccttgtggtcaggatggcacccttctctgtttcccatgaatggttgccagggcaggtctcgtggacttcaggaagtttagacctgcccccagcccgtacttttgcacaatcggctttgtttttcgcccagaatgctgggctgttaaggtcatttgaatcttgattctggcatctatagcattagctcttcttcccagttttgtgccatctgaaggtttgataagcctgcccttcatgtctgtctctagtcaagtcattgttaaaaagacagtggacagtgtgtgcctaagaattgaaccctgcgtcattccaccagtaacccttctctagcttgtcatcaagtcattagtgatgccaatgtatacatttactcaccagatgtttattatgtgcccattatgtgccaggcactatgccagtgccgaaggtataaaggagtaagacaactgtcctgcctggaaagagatcatcagcttgaaaagagatcatgattggcacactttttctctaaaggcctagatggtaaatattgtcagctttgcgggccatacattctctgttgtaactattcaactctgccattgtggcaccaaagtagccatagacaagatggagacaagtggcgtggctgttcctataaaactgcaaaaacaggtgacgggctgggttaggcctgtgggtgtgtttgctgacacctggtctagtagaaagacaagtaactcaatcaagtttaataagtgctctgagagcatatgcacagagcacaatggcggcccaaaggagggagtgatgtacggtcagtggggtagtaaccacctggctacatagacagtggtgcaagcagcttcactctgtttcactgtcttatctacaagtggatcataggaggtttttctagatgctttgctgaaatctaggtgcatgatatctttggcatctcacctgatctaccaacttggtaaccacaagagaaaaatcgattggttttggcatgcctttgtcattgtggacgcacattgccttttcccaacattcacatttttttcgaaatgttcccaaaccatttgttctataattttgccgggaaccattattggtctgtagtcgtccaggcttatttatttgtagatatcaggatcacccactttcctgctttaaaattgagacattggcccatgtctcctactcttagaccccgaactttgtgtgattttgaagttgatcaatagcagttctaagaaacttttataatcagttaaatatgcacgaaagaaattatatgttgtcaaaagaaaagttggagccacatcaaaaagtggaaatcagccatggtcttgctgctccagtgttatccctgctaacattttggtgttgcttttgccaaatacatgagaaataatcaaagctcacaatcatatcgctctggaaggggtatggcttatagggggagcctgatgtgtaagctacttaaccttttagaggggcacaattcatgtgtgtttaagggatggtgaaggcatagaggagaagggtttgtttcacctgaacaagtggatgtctgggaaaggcacaatagaacaggtgacccttgataatcaagtagaagtagttgaaataaaacagaattgcatatgggctacggttacaaccatgtgctaaatgtattttttaaaaactgcagggaactgtcctaaaataatactgtggttggaatgttgatgaatgtggttttattttctctgggtttccaaatgggagtctattgcctcttataattatttttcttaatgcaacacatgcatgtccctgtcctcaggaactcagggctgcagagcttggctgcagtctgctgcagggtcagggagcttagagccgtgttccatgcaccgttgtctttttcattagtggtagctgaggatgaagtagagaatctaataattctctgatagcctagccctgggagtagtctagtcttgggcgtggaacctgaaagttttagacaaatcttggaatataactcgaatacagtagtgcagattgcttctttgaaacccagtctgaataggtgagaccttgcttttccttgctgaagtattttacttagcaaagaattacttgcttttaaactgttcaagtgcaaaagcatgaggtaatggtttgagaggtaagtgacattatttagggcatagagaaaatgtttacacgtttatttctgacacacagatttcccatccccagcattcgttcccacctgccttatccacaggcagaagagagggcacccagaactgaggagggtctccagacattctgaagtcctgtctcactcctgtccacctctggggaaaggagaagtgtagttgttggattgcctagggtccagattttagtgctgcttcttaacttgctgtgtgactgtgggcaaagtcttggagctcagcttttcttctccaataaattgggatgataaaattggcctcagttgtaaggattgattgaaccagataatgtatgtaagcaccagcttaatgcctgacctataaacaggtacccaatacagcatggctgcttttactcattattactgttcgattgttagtgccagccttggaaatcggctcttgtgtgtcccctaagtggccatgcagaaagaactcttgccaagcattcattatcagtattttgcacccatatgaatgatctgcctcatggttctgaatattgacatgaagttggtgggcactagtgggatttgtggtccagcaacccaaaataatgttcagtgacatttctcttcagggattatttttcacaaaaggctttctataagattgctgaagggttgtgttcataaaatgtcaggtgctatgtgtgtgacggcattatgttgatgaaggcagtgttaaactgggaaacatgcatatgttaagtagggactcaagaaataagtatgggttgaatagaagaacaaaaggggaataatcagcaacaaggagaaggaaagggagaaaaggaggcacctttcggttgggccttgggaccctgtcagaacttctgcacccttcctgtctctctttaacctatagaaccacactggcacctggctctgagctttatgaggcctggaaaacttgtgttcttgaagttagtgatgtgtcttcatcctttttccagacacccccattttcacttttctaccactctgagattctactaagttccagattcagtcttattggtgaccagaaacaagataaaattagagaaggaagtccgggtgtggtggcttacacctgtaatcctagcacttcgggaggccgaggcaaggggatcacttgagctcagcaattcaggaccagcctgggcaatgcatattgaaaccctgtctctgcaaaacatacaaaaattagctgggcatggtggcgggtgcctgtagtcccagctactcaggaggctgaggcaggaggatggcttgagccccagaggttgagctgcagtgagctgtgatcacgccactgcactccaacctgggtgacagagagtgagaccctgtctcacagaagaaaaaaaaattatgggaggaagctctgtcctcaatcaggaaggcctgaagggtgggaagataggcttataagttaagagagaatgccaagcatggtggctcacgcctgtcatcccagctactcgggaggctgaggcaggagaatcccttgaaccctggaggcagaggttgcagtgagccaagatcgcaccactgcactccagcctgggtgacagagcaagactccattaaaaaaaaaatgctaagagagaaaggaagatgaaagagttacttttgtcagcctcttaagatgaaaaaggatgacttagggctgacatgctcctcggttgcactgagctccaagctctctgtgtgccgttcacctctgcctgctggtaaatatcagctgtatctgaaggtgtggtatggcattcagtccctcttcattcttaacctatcatggccattggcgactgggaagacaaagggtcaggcaaagggggtaccttattagcactgaggtctggcatatagtaggtatttaataaacactcgtctgtctattttctggttcagaatccatctgtggtaattactttgaattcagggcatggatagaactggaaccattctttgtgtgtgtgttgcttttaaaatatatttgagcagtaggacagatggtattgagagtactgaagttaatatataaaaaaacactttaaacatctttttgtagaaatgtccattttagcaaatttcacagagagtaaaagtctgttggtttcagtttaactgccaactaccctttcccctaatttggaaaaccatagctagatctaatagattagattctcagtctttctgcattctcttaggcccccaggcatttatggccagattgtgggagcatgttgtgccctttgagtatgaatgcataacgcttcctttatttttaaataccttaaaattttaatttcataaagctgcattttactatttaatttgaaggggtttgctgaagtatatttaggcatttataagcttttcttttggagatggagtcttgctctgtcgcccaggctggagtgcagtggcgagatctcggcttactgcaacctctgccttccggttcaagcgattctcctgcctctgcctcccaagtagctagtagctgggactacaggcgtgcgccaccatgcccggctaatttttgtatttttagtagggatggggtttcaccatgttagccaggctggtctcaaactcctgacctcaggcaatccgcccacctcagcctcccaaagtgctgggattataggcctgagccaccatgcctggcctagaagctttttttttttttttttttttttttttgagatggagtttcgttcttgttgcccaggctggagtgcaatggtgtgatccgggctcactgcaacctccacctcccgggttcaagcgattttcctgcctcagcctcccgagtagctgggattacaggcatgcaccaccatgcctggctaattttgtatgtagagatggggtttctccattttggtcaggctggtctcgaactcctgacctcaggggatcaacctgcctcggccttgcaaaatgctgggattacaggtgtgagccaccgtgcccagcctagaagctttttataagaagctggaaatgtcttcaaattctgtgtctggtatttatggtggtccacttaatatttgtcagtttgcttttctgattttgcaggagattgggtgctgacttagtacaattattttgtcaggttttgttgtgtttttggtgtttgatggttagagtggaattgcagaactcccttttgaaaggccttggtaagtagggggagaggagagcaggaccaaggctatgaggcagcttcaggttgggatgacttagcatggggctttctctttacactgttcccctttctgtatttttccttctccccctctttctttccctcatttctccccactttcctgctcctgaaatatttcatatacattgctggatttagtgcatctaggattatggtaaaaaagagggattttccttccttcctccactcctccccttctgctcttgcttaaaattcaggttttattttgacgaacattttacaaagtatctttggccatttcctccataccctgccatacatgtaaaagtcagtatgggttttgcagattatagagctcaggagtcatataaaaatggatgtcagttcttttgtgactcctattttggttctggggtgtctgtgctcactcttagtggggacaagcaggaggtggtaacattcacaggtgctggtggcagcactggtctgtgtgctggaggggaccagcaggaggtggtgacatccacaggtgctggtggcaacacaggcctgtgtgctgctgaagcctggccagcaccaggcgccttggctccagctctgcccgttgctgattgcatttggctgttgggttttttggctttctgatgtgtcgtttgtatcggccatttagcctattctgtttcacagccttttcatcctaggaatcacacaacttgagcatttttgaccttgtaaggctttgtagaagagactgtaaattccagatcactctgtacagcagtgcaggggttgaagtgagggaagatctgttacttggacggatggccttggcctctgaaggcagtccctgcagttggtcttgggtgtatgttgaacacatcccagagggaggtggggctgcacagaagactgctgatgggtgtgagcccatggaagacttggagactgacacctgcttcttttgcagcatatggtattttttcagttctctgcaggagggagggaggtttagatatttaaatgtatggtaaacagtctcctttcccttattacttatctttgattcattccaagccagtttcagggggcctagtagaaaagtaagtgtcctctgtcattccttccctccctaccagaaagctcaaagtttccggctaacctccggtttgggtgagagattgctgagaggcagtgtggctgggtcctaggtaaaggccaggcagatgtggtttcatgataggttctaactggcacgtgtttttgtgtgctcaacagcatcctatctcttctcttaatggccatctagttcattctttaacattagtggggaggaagcctccctggggcccagggaggtgaaatgacttactctgggtcacatagtagtagaagattccacactagaattgtatctcttttctgttttatatcatgttgcattgagtctccaaggtctgtacatacttcacagactcttagagaaacttatacctaatatggtgatggatagctgaatatggctaagagcacacactttgcgatctgatttgggttctattaatagttctggctctgctacttattcactatgtgatcatgagtatgttcctggtctccctgagtctcagtttcttcatctgtagaaaggggaccataactacctcattaggttttgaggatcacccaggactattgcttggtacatgtagacactcagtacattgcagctggcagcattattttccataccttgctgtagagctccaaggtatagtgaggctgccagctgtggtgaggctggcatccctccactttgagactgaggtagggagaactgcagcacatctcagacctgcctggattcctgtgccattttgcttcattcagcacatgccctttgagcagcctggggcatgtgcacccattggaagaggatgcctttgggtttaataacttgtgcgtttaataatcagcctttttggctgagtgatatggcagcagcagattgattttattggggcagaaaaagagttgtgtgcttttccgggtagccctgagtcacagaccgccaatttgttatctgcacatatgtgcagtcagctgtgcacaacgtcctcttccctgcccagctgctctggtgtgattcattctacaaatatttgagtacctactgtgttccaggcacaggacaaagtaccaggggaagatacattgatgagcagaaacagacctgagccctgacttcatgggctttgtgaggttgtggggaaaacaggcattaagcaaatgagggtaacattataatcagtgtaaggctatgaagagcaagtacatggggctactgaagcaggtactagagagatttgacctaagctggaagtccaaggaaggttcccaaagaagcggcaagtgagctgaaggaaggccaaaggtgtgaggagtgggtgagggccggacccgactcttgtgccatcccctgagcccaacacccttccttcttttccttggtcctttaggaggcagttaatcctcttgcagtcagtcttgttataatttcagatgtattttatttcttttcaattgcataggtttcagggcaaaaatagaatatggcctctactttaggagttcaacaacaatgcagccacttgttgaatatcaactgtgtgcattttcattgaatcctctcaaccctggaaggtcagtattaggattcccaggcgaagaaactgaggctcggagaaaggctaagtaacttgggcttttgtctcctgttggttactgattagaaagctgggattttaaccctatggcccattgccaaacactcttgtgtcctctgcctctccctctcagagacagctttgtggcttgacctggggatccaacaactatctccatgtcacgtccatgggaaaatgcaacctgagttccaaccctccaacttgaaaatgaacttttggcgcatggcctgtttgtcggttgagggctgttgtcttaattctgtgtcagagaggcattgaaaatccagaattaatggaagatggtcttggaaatagtcacttgaggtgagtgacaatggaccagatgaaaagaaagtcaatttcacccctgttgtggccagtatacctgtggagcgtggggaagagaaatgggtgtgggctggtaacttttaattatttagagttaagtctctaatttttgtgcgcttttttaatgagtgggctctgggtaggggtaatctatgctagttacttcatctatctgagcctcaatctcctctgtaaaatgggataatgcagcttatctacttcagcactgctgtgagattcaaatgaactacagagccttaggattagaagagggtatcaacatttgatatattatcaaatgtattaagataatacacttgaaagtgttttgtaggcctgtgtatatgatgctacttttgttgatctaccaccgtggttcatgttattattaatagcacaacacactggttcttaaacttgagctggatcagaatgacctggaaggcttgttaagacacagattgctgggtccctcccccagaatttctgattcagaagctctagggtggggccagaggatttttatttctaacaggttcccaggcaatgctgctgggctggtgaccacacctgaagaactacactacccagatctggagccaccaggcccagctggtgcctcagacctagacagtgacaggtaaaacccactgaccttggtggggggtgggtgtggatgtcaattcagggctatcgtgtggccagacagagctgagttggcattggcgaccctaggtcagggactgtgatgtctggagtagggtggaggcagctactctgctctcttgggtccctgaggacttaatatggccgctggcagtcaccatttctcggggctatggtttatggtgcagaaggtacctctctcatagggtgcgttaggccaaatttggatagacctatccacactggtgaactccttcattcttgaggctaactcagctccatccaagctcaagcacccttgggcttctgtaaagaaatcatcttctttctaatgattttccaagggtgcagtaaagggagcagccgcattaattctggggctgggtggctgatcctgtctcatatcctgtccctcatcctaagagatttcctacttcctgctccagccacactccttcctgccccccagcccgtgtgtgatttctgcttaaatctctttcttagttgagatagacaactttttaaaaaattaccccccatttcagaatagggcaggctggagcaggctagcagcaatttttgtatttttgggatcatattgagtgggatcattaaagtcaccccgagaaatggtgactgccagtggccatattaagtcctgagggacccaagggagcagagtagctgcctccaccctactccagacatcacagtccctgacctagggtcgccaatgccaactcagctctgtctggccacacgatagccctgaattgacatccacacccaccctccaccaaggtcagtgggttttacctgtcatattgagtggcttgctaaagatgcagattccctggctatcccctcaaaggttttaatttctcaggtctggagagatcgcagaaattctgatgcaggggtctgagaaacatacttagggagataatccaagagaattggacctgcttttcagtctgctgacaagtggataccactttactccagctacccagtgcccacgagcccctgcttggacatctgtcctctttagagtctgtgcctgaaagcctatgccccatatttgagagatgaagctgtagtgtgggaggggagtggggcttgcttaatggttgccttcttggttagccagcttcagagtttccattatggcctgtaaagaggtctttttacctgcagtgtcttccatcgatattctgcctcatatacactctacttctgcctcaaggcccagtatgaatctgaagtcgaagtgacttttgtagcccatacttggttcctgctcacaacttctctatgaatgatgatgggtcttctggtttttcttttgccttgtatggctgtctgattagcttccattgggctgattttatctctgaaattatattgtaagcatcatgaaggttgtggggtctgcatggtgttgggcatacagttatcgatgattatggataacttggttcaccgtgatgtttctggggtggagtgaccactgtttgatacctggtttgacagatatcaaaaccatggcaataagggtctagaattggcttgatctccacagtatctcttagatgcaaagatgttttaggtatagggctttgagtatcagtgccatcaaatagtacttccagggggaaccccagacaagtctgggtcctaagtgaaaccagaggttttagccagaaataaaccagcatcaggaagggagctggtcaaacactgttccactgcatcagtgggtggcagaggttgctggcaggacagagttagctggcatcagtcatggcagaagatgactcataaggctagttgaatgtgtgtgtatgagtttgtgtgtgtcagagacagagagaaaaaagattcttacttcaaacggcattcttcctgtgtctcccgaggatgtattttttcccctcagatgtttctttttttctacataatagtcaatgttcaagattgtgtaaaaaaaaaaaattaggaaataatccaagaacccaatattcaaaagggcctgggcagactgtcagcattttgtcaatggctctttctagcctgggttgcttgtgtggtagcatgccagatctatccaacaagattgccacttgctttgcctgttctttgctctcagtctaaataacttctcaattcattctagtccttttaaattttcatggcttgctgcatttcgttagctcacttaaaatgagaacatggaatcaatacagtacaaccacagacccaaagatggttagacttaaaagagtcctttctagatggtcccatgtggccaagggagatcttaagctccttggtgtaaaggtcctcagcccaggtgtcccatgtctggtgaatttaattttcttctttcagccctgcacctgccatccttgcaatcctgctttccctctgttcttccctcagccaaactgatgtgtggtctatagagagaaataggtttctcaggcctgaggtagctggaaccatttaagtacaaggaatccagtgtggaaaggggtgttgttcagattgcatttaaaaatgggttgggaataacactggctgtgaaaacattatcaaaaatctgcaaaatcaacactctttcttcctggtaaacatgaagggctcggcagctgcacctccctcacgtgtgtttggccaactgctgcttgggacattgtgcctccctcagcggctcatgggtgctgattggagccaggattggctctttgctggatcgaaaggtgtctcaatgctctgaaatgccataccagtcaagggtgcagttgaacttaacggtagcgtatacccgtccatctgggttacatgcgccccacatccctgttgaggtttcactgcgtcaagacccagggcaggcagaactgaccctcctgcttaggcaaaggtgacttatgggtgatttctttccatcagaatcctcaccctctcagtcaccgcataaccttatacaagagaatttgtttatttcggagaatcagcccacacacaggtttgaagcaagtccaaaaggaacatttgccactgtgtgaaacttgtctcatcttgctgctcttcgatgagaactggtccactacttcgccctgacccccgaagttgccaatatcatttgtggaaatcttactgtttggaaatttactggtttccccgaacaggagctatttgcctgagtttcttttagagaaagctgaactgcctttttggcactccttgtcttcctttttttttttttcccatgtatcttcataagtagatggcttggaaatagttaccaagaagaatacagctgtgtactccagtctaatttcctggagcgtgagccatgtcaaagggctcggattctgtttttgacatggactcagggatgtgctgcagatacagtagcaggtgggctgatttcaggggagcatctaaccggaaaagcatctaaccaggaacctgtggctgaaattggatgtgggggctggatgataaggctacaggtagatgcagtgttggctgaattattagatcagatttacatcctcgattcagaaagcttcttatggtacttagaattgtgcctggacctgcctggacctgtcctggtcttttttttttttttttttttttttgagacagtctcggttggttgcccaggctggagagcagtggtacaatgtcggctcactgcaacttccgcctcctgggttcaagcaattcttgggccttcagcctcccaagtagctgggactacatgtatgcgccaccatgcctggctaatttttgtacttttagtagagatggggttttgctctgttggccaggctggtctcgaactcctgatctcaagtaatctgcctgctttggcctcctaaagtgctgcgattacgagcgtgagccaccacgcctggctgtggtcatttttgatcagacgctggagctctggagggcagccctgtgaagtgggcagatctctcagagctgggagagagagcttacacttcaaagagtgatcagcacctaacagctcttttaacatgtgtctagcatctaggttacaaaaaaatcctgtatgtgtaggatgggggtgacctgatttttaaagaagcccttgtgaagaaagacccattttggatgaccagaaaaaggagaaggcccttcttagagggctggaggaagaggtggttctttagcagcatgctctgatagctttgggtttgtcttctggggcagttgactctcctgaatggggtgatgctgggctggtacctcaggagcagagtaagttggctctgacactagccctcttcctactagccgtctctcctctagaaaactaccctctccctgatgcaaggcctcttccatgtctatactggcttctccaggcaggagctagggcttttctcatttctgagagtttccaactcagtcccaaaggctgcaactgcctttgatgttgagaaacgacaacgacaaaaacaagcaagaaacaaggcagcaacataggctttaggagacagacgtatcaacaggctgggcgtggtgactcatgcctgtaattcctgcactttgggaagccaagatgggaggatcgattaaggccaggagttcgagaccagcttgggcaacatagtatgacccccatctctgcaaaaataaaagtagaattagctgggtgtagtggtgcatgcctgtagttggagttacttgggaggctgaggtgggagcatggagcatcccttgagcctggggtgttgaggctgcagcaaatcatgatcttaccgctgcacttcagcctgagcaacagcatgagatcctgttgctcaggaaaagaaaaagaaaagttataaacagaaggctttgtatttcagtttataacttaaaaataaggagcacttaattcgattctgcaaatgtggagtaataagaatgtgatcttagttccacattgcatcaggttacaggtggcacagaaaagatacaggtgtgagagcggaataaaacaggaagttggggtggagaggaaagctagtgacaagtagggttgtagggagaaggagaaagcaaagacaggcttgcatggaacgagataaatgtgcatgagcaggcttgtgagcagagttagaaaacagcacaatttgaggtggaaccagtttgtagtaaggatcttctcttaatgctgtaatttatgtccagaaattctgaaaaattacatcttcgctttcattttttttccactttaaaaatttttgacagagtctcactgtgttgtccaggctggtctcaaattcctaggctcaagtgatcctccccagtagctgagactataggtgtgagccaccatgcctggtaataccttcactttccaaaaacttttgacaacctgacatacctacctgtccttttagaatgaacgcttgatactgactgatggtactgtaagaagcaaagaccctatttatttaataatcttcaaaataaaatgctttttctcaggacttcaagaccagcctggccaacatggtgaaatcctgtctctactaaaaatacaaaaattagctgggcatggtggcaggtgcctgttatcccagctactttggaggctgaggcaggagaatcacttgaacctgggaggtggaggttgcagtgaactgagattgcaccactgcactctagcctgggagggagagtgagaatctgtctcaaaaaaaaaaaagctttttctcccccagacaaaaaccttattgtctttagatgagcccaaagagttaaagaaaattgtctgtattgatacacgaatatacatatatgcatacataaaaagagaaaaggaaatactttcatatcatccagcagtttttttctgggtggtaattttatgactattttttctttttttggtggggggaagggtgagttattttctatctttttaaaaacagtgaacagtattactttaatcagaaaaggagttattaagatatagtgctctggttgaaacatatggataaacaatatttaaatacagtattattatttacctaaagtgttatttactttttatagcttaagtttggaaatgcatgcatttagtgtatattagcccttcccctgctttcttctagcttttaaaatttgtaatttttaccagagttacacaggcatagagtttcaagaatccaatatttctacatgactgcagtctccgacaccgtcaccgttagccccctgctgccccggtggcagccactttaaaatcttagctgattcttttgatatttacttccacatttgatagtaacctgtatgttttactaccttttggacatcatctgttaacttatcaccatgtaagatgaagatttggttctcttttcctttcccttctcatccttgttttttttttttttttcttctttttttttgaggaagaaaaatcctgtcttctctgaaaatcttgggtgtcaggccttatccgagagggacaaggtttccttatttggaataatatgtgcattctttggccttttgtgattttgccaataagacttttaaagtctgctccaaaactctaagttattggcttgaactgggccatgtgttgctatgagctctgtagaccaaataaaaccaggggattgtcagaatctggattgaatttaaggcatctcctggaggttgttttttggaccaaattacagattaccaattattttatcctttgctttggtcataaaagtaagagtgtagagaaaatatacaaccctagttcattgtttgctggcctctggaaaacttggggcaagggggcggtcctagaaggtaccttccttgagctctcagtttcaggaaactctcaaaagacggcttctgttcatatttggtgatgtacagggtttgtgaggcagtgtgtgggggacccagctggatttgtataaagtcccaagaagtgctccttttccagaagggctgctacaatccaatctcaggaacgtggactgttatctgagttctgacagtttcactttgttcccagggccacccccagtcacctccaaattctttgtataattccagaggccattcctctgggcttatcctgcttcctccacgctggtgaataactcccacctcctgccctttgtctctctatttatggcccttctgagttctggagaagacttcactgggacttacgtcagtgagcttaacatctttctcattaatgaggaatgagagagaaggcaacaggacaatgcccccatggcttccactgtaagaaagttgaagactgtgaatcttaaagttattagagcagttggaagccacacggttttaacagttctacttgtgtacctctggcaatgaggaactcactctctaggagccactctttccattgttggatagctcttctcattggaaagctctttcccgctgatctgacattcgtgtctggaactttcatccatttcagaggataggagcattcttgacggtacagtttgtccaaccagtcaacacattactcttccttttgttctgacataagtggtataaaatgaggtaatagatgcattttgaaaaaagtaatggcactatacaaatgcaagaaatgttattgataggcttttatggcttagatgagtctgacttgaactttcagcatcatatactccattagtcgagaacattgcagtgaccttttttaggaagcagtttcctggagatttaatcagtgtagaaaaataccatattcagcctttattccacaaaagtgtcaaatatttacatgtctgaatagtctgggctgggtgtgccggctcacacctgtaatctcagcactttgggaggctgaggtatgaggattgcttgagcccaggagttcaagaccagcttgggcaaaatgttgagatcccatctctacaaaatactaaaaaaattagctgggcgtggtgttgcacccagaagtttgaggctgcagtgagctgtgatcatgccactgcactccagcctgggcgacagggtgtgactctgtctcaaaaaaaaaaaaaaaaaaaaaagtctgggccactactcttttggcttagatgccctttaatttcttcctttcgctttccttttttttttttttttttgatagagtctcgctctgtcacccaggctggagtgcagtggtatgatcttggctcattgcaacctctgcctccttgactcaagtgattcttctacctcagcctcccgagtagctgggattacaggcatgtgccaccacacctagctaatttttgtatttttagtagagatggggtttcgccatgttggccaggctgctcgaacttctgatctcaggtgatccgccctccttgacctcccaaagtgctgcaattacaggcgtgagccaccgtgcctggctgccctttaatttctatgtgtcccgttttgtttttcacatatctccctctatgtgatcatgtgtgtgtgtttagttttaaaattctgtttttttgagagaagaaagatattgagagctaactctgatacctttaaaaatgaaattctgaagttgaagattaaattacttatacattttattaattgatatcttccaggaggaaaatatcgtgttttgtgcaagggaagatcaggctctttttgatgaagggatagcagaatggttaagaacaggctttctgagtggtggcggctctgtaatcccagggcctacccatccctcacctctaagtgcctgtattccttcccaagtcctcacccacctgtgactagatatggttagggaggaggaccagttttgtaaataccagaacaagtatcttctaactgtatttgagtcttgataaagatgagtctaacacgcagctgttggcggggagcagtggctcacgcctgtaatcccagttctttgggaggctgaggtgggcagatcacctgaggtcaggagttcgagaccagcctggccaacatggtgaaaccccgtctctactaaaaatataaaaattagctgggcctggtggtgtgtgcctgtaatccgagctacttgggaggctgaggcaggagaatcgcttgaacccgggaggtggaggttgcagtgagccaagatcatgccattgcactccagcctgggcgacagagggagactccatctcaaaacaacaacaaaaaaaccatgcagctgttacacgttctcccacctgccctaggatttctcttaccttcgccctcaaacgctttctctttggaaaaatcacttgggtgcagtttgttgaaactggtcagcaaattattcttcccatagctctggcataagtctcattagaaatggttttatgaagcaaccgtaaaaggagctggttttctcagtatttaagaaaactcttgttttctaagtactgagtgtattgccagaggttcagttttgtttttcttactatgattttgatttatttgagtctgatagaatggtatcagtgacatgaggaataattacagcatcttttgaaattctatcctggaaccccaccaggaaccgacccagattggtgccaaggtacacataataggttttaggttttaaaaaatacttgttggaaatgctaggctttttgatacttaaagagcattgttttagtgggtggagttcttttttgatcctctaagtttaaacttcttagttcaggggtggccagtgaccatcctgtgttgtgagagtttaagaggcctctgagaggcaagacctgcatttgtatgtgtgtgtgtgtgtgtatgtgtgtgcacatgtgcacatacacactcacatttgtacttcttcattttgccaacaagttttaagcttttctggactttctgcttttactgaatcttcagagatgcttgctatcttaggaaatttagtgtgatattaagtctttaaataaagataaaaataatttgctttaaaccaagaaaaagagacagagagagagagagattggcagcaataaatcaacatgttaacattggtggacagattcttgtgttttctttgagacttcctttgttttctcagctttctatgattaacatgtattacttttatattagagaaaatgatttgtaaaaaagcatggttgctttggaattcattctcagtctgccgatgggataacaaggtagagaatacaggagggatgacagattggagcttagggacgtcaggagccagggctgccatgggaactgttgttcccagcctttttgtcatcagagacgccctcttttgtttttatacttatttatttttcttctaaataccccttgctctgaaaaatttcatcaaacccaacaccatgtttattaagtaataatatatttccccactcttgatcaattgaagatagacttaactgcctattagagttacccgagtcttaatggagttgatactgttccagctgagagtaaagatgtgtggtatttgaattgactcttatgttagacattcatctatgtcctccacattcatttctacctgagtggaattttctggctgtggacccaaggctgaggctctgcagttagagctcttctgtgttttggacccaggatccctgtattccttctgacactggaggcaagaaataggcatttctgtggctgggaaatgtctcctccaaccctttttggtcctaatctaaatgagaaaggagagagccaaatcccccaactccagcatccacgtatgggaataagcccactcccacggagtcccgcagaacgtgggaggaggagcttctggcaccgtttcccagccctgcattccagttttctggtcaccttttctgaacctcctgctgaggaactgtgaaaacaaagaatggtaaccatacaaggaagcaatccaactcaaacataataaaaattaatttaaaatattagtggatctcttgttgaacaccaaagggagggaattaaattattaatgcctaggaaaataactttaaaatcctttctccttctctaccacttggtatcctgtacacgacggcagctgctcctctagaaactcccttttacttttcatctcctcactctccccagccctccaggagtagtggggcatagaaagcctcccatccctttcatctggacaggtaaggaagctagaggggacacttctcttcttagaggatgacctcagttccattccaaggatagggtgtagaacaagagttcttagtttttattggaacatggacccctttgagactctgatgaaagctttggacactttttccagaaaaattatatgataataactaacatttatgttgtagacattgtgctaagcacgtaggtgtattactcttgatgctcatcacaaccctgtgaggtgtaggcactgttatctctgttctgcagatgggaacactgagccactgagatgttaaaagatttgtccggggatacacgtataaaaagtggtggagtctttgcatatagttttagttggcactcaggttaagatcttcagctctagattatgagccaccaactgcaatcacttgaagacagatgtctgcacatgtaacagggtagcgggtggatactaacccccagggctggtgaccaacctgcttgtcagggtggtaaaggaagggaaaggctgctcttggctccccttttgcagagtcctcccccgtcctcttgcaccaattaggtgagtctgtgtgtgggtttctaagtgtctatgctttgcagtgatcccacacagttatctaattggcatttaatgtgagctgggaagacagacaatctgggcttctctcttggttttgctaccaccaaactgtgacttggggagtcattcagaccctgtgcgctcatctgcagaccagggagaatgaactctggacttcactaggattgggagggtcttgctacagtgagaggaagtcactgcccttaatttgtctttctgtggcccataagtgaatggcctgctatagtgtgcacgtctttctgttattaagattaggggtcccagaaactggcctgtgactgctgaccacacttgacacctgcagtttttggagttgcagtgaatgttttcttagagctccaatccgtgatcagtaataattaagattttgtaatagctgtactccctcttctgtctgcccttcttcccacccatttggccatgacccccatggcaggtatccttaaaatcacagagctgtgaaacggcagtgctggaaaggaacttgatcacctatggccagccatgccattgtgcagaaatggaaataggctcagagaggttcagaaacttgcccaaggccacacagctaatccatgggagtagaggctgggtcatattcatcatagtttctctgttttagtcctcactgcctcccaaacttcctcagtgcatggagagtgacagaacgaactatttgtacaagcagagctattttagaagttcttcatggtgctaggcccacagttcctcatattcaggtaattgttaacttctcccagcaccaagatgaatctctgctatagacagagacctgggaaatacccctctctatttactgcgttatcccaggtaatgtagagatggatatagccaggcagtgtgttgagaaacttttggaggtagggtggtgtggtttattaatggctgtgctggggttctgtctgcagcagaggtttaacttggatataaagagcatcttttctgaagctgggcccagctgatctgagtggtgacatttagcactactaggcattagcttccagcatccaccacctcttgccacatgccactgtgagtgttcatggactttctcctcttctctctgcaaaagagaattctattgtctattactcaactttcctagtaacactaccttctaaggagaagtttctcttggttagtttagtgcctgggcctttttcatatggagtcagggcaatgagtagaggctgaattagagaactaggaagtagggatggtcagagtgtttgtgtgtgtgtgtgtgtttgtgtgtgtatgtgtatgtgtgtaagcacctactggcatctgaaagggccaatacttgtaggtgagaagagagaatggaggccaaaggagaggaggagggagaggcaagaagtgtttatcagcacaggagatgaaaagtaaaaggaagtttccagaggagctgtctgtgtttaggatatcaagtggtagagaaggagaaaggattttgaagatactttcctgtgcattgggattttgaagatactttcctgtgcattaataatttaattccctccttttggtgctccacaagagatcccctaacattttaagttaatttttattatgtttgagttggattgcttgcttgtatggccaccaagtggacactgggctacatggagacccagtaatgttcaggcgacactggtctgttctatctggggcatagaacagaggatggtgaggcagtagaatgtgagaagcacactctggaaggtgagtgatgggggaaatgctctgtggcagggggcctggggctgatctgctggagtcagcatgtgcttggtgttacttcattctgcacaaatcccagatcattttcctgtgttaaaaataaagaaatatgtcagagttctcagattcagtgcttatttacttcataccctatcttcaaaaataatttgaggcagtttgaatttagtggggaaatgtggcaattcattcagactgtattttttccataaatagaaaggaaatttgcgttgagaaggaagaagaggttgagtttctaggccacattttactgacagaaatattattggggaaggatattttaatttttgttctccaagaaattgctcttttgtactgctttgaggtggaggtggtttagcacagagaggatttttaaaccaagggaaggagcagtgactgtttggcttagataaagagagtgctttcttctgtctgtgcctcctggagtcgaatcgatctgtgtgagctgcctgtccaacattcacgttcagtgagatgacttctttgagtggctaaaggccccagaacaaacagcctgctgggacttgcaggtctgtgcatggagcttcttcctgtcggctcctagaagggcagagcaatgcttctgcggaagagtaacatccagaagactgacactcagaatgttcaggcaagagtaccagtcaaaggcagaaaaaaagacccgcctggtactgctggtaagtaaataagcatcgcagtcttatttacttattatttgtttatttttttagagacagggtcatgcaatactgcccaggctggagtgcagtggctgttcacaggtgcgatcatagcacattgcagccttgaactcttggcctcaagccattctcctgcctcagcctcccgaggagctgggactacagacccacaccaccatgcctggcttcagcaaggtctttttagcccagtggccaagctgttggttaccttgaaattgtccatattttttgactaccttaaggggccttgtgtgagggcagaaaatatcagctgccttctgatgtttgaagcagtgcccagggcagatggtgattccctgcctaggtttgaaagatctcaggaaagcagccatttgctgggaaaaggcctgtgaccagttcctggtgtctcaacaggtgggtcacacctgccttgttgaggctggtctttctgactggctggggaggtccccagggagtcttgccgatattggtcacaatttctcagctgtgtcagtgtttctcaaagtgacttctagaccccaggcatcaggatgttctgagatgcttgtgggaaatgtgtatacctggacccataccaggtggacagagtctgaatctctgggagatttgggcttcccaggtgattccttttaccctgtagatggagaaccactgtcctacttgctgccactgtgcagaactggacgttgtggttagtaaatttgaagccagatgatctagactcaaattttgtgtccttaaggaaggcggggaaggaagaagggccggcagtgtgcaggtgttgagtaccagctgggagaagatgcgtggttagtgcttccagctctcttcttttatgtgcgctcagcagcagcccagggtgtggatgttatgcctgtgtacaggggaggaaactgaacatcagagattgagaactcgtttaacatcatagagttggcaggtggaaaccagcatggccagccttcttgcgtttttagttatgactgtaatccccactctagaatgatgagtgtctccttgagtctggctgtgcagtagaaatatgatatgagctacaaaggtaatttaagactttctagtagccacgttaaaaaagtagaaacagacaaaattaattttaacaacactttttttctaacccagtatatccaaaatattatcatttccatatgtaattgcataaaaaaactctcagatattttacattcttttttaaaattctgagtcttcaaaatccaatgtgtacatgactcttacagcacatctcaagtcacactaaccatatttcaagggctcagttgccacctgtggctagtggctggagacgtatgtcctaccctgctgtccaggtagccaggggtcagagttttctagatcactgatttccaggcaccccaggatggattcatgctgggcagactgcatgggtgtcacctgaggagaggatattaaaattcctccatcaggctggagccccaggtgatctttttgtgtaacctggttggaaatggctatgctaaaaacattcactggcaatttacttgggttgtctgtgactatgcccgcccccttttcagggacagttgcattccaagcacgttctccgggagtgggtggggtggtggggtggtaagaaaggtgggggaacgcacaccctaagggtcttttccctgccttactaaatagaactatagtttcagtggagaaaagaaatcccgcttatttttctggttgtgatcttgcataaggggtggaacctttccttttgatggctgagagcgggatcctgtgttctcaggaaaggtgagatgaaagaaccaacatacttaggggagaatgagatgttgtgtacttaagctgtgttcttttccagtggtttgattttaaagtttatttgctgacatagtaagaaatttggtccaaaagagagtctgggagtctaaacctcaaatgcttcagaggtcaggcaggtagcacgagatgaagggtaagagattgaagaccaaactgttaggaatgttctccgcactcacaaaaatgttgtggtcttccttttttctggaaacataagactcttgacctttcattttcctgtttttgatagataaatatttatcttttgtaagagaaaaaccagtgcatgcaactgggatcaatggcagccaacactcagctttggcgttagggagatgaatcggagagccttggccatttacagggcagcagctactacccggctccatccagttgttatccttgaggccctgtgttgccagatcctgttatttttaaagagaagccacattttgaaattataaaatgtttggctttataaatgttattgtaatttaaaaatcattacaaggccgggcatggtggctcgtgcctgtaatcccagcactttgggggctgaagctggcagatcgcttgaggtcagaagttcgagaccagcctagccaacatggtgaaaatgtatctctactaaaaatacaaaaattggctgggcgtggtggtggacgcctgtaatcccagctaggggaggccgaggcaggagaatcacttgaacccaggaggtggaggttgcagtgagccaagattatggcactgtgctctagcctgggcgacagagccagactccgtctaaaaaaaaaaaaaaaaaaaaaaaaaaaaaacattatagactcacaggaagtggcaacaaatggtacagagggatcctgtgtgcccttcaccccacttccccagtgttaatattttatgtaggtatagtatgacatcaaaaccaggaaattgacaatgctacagtcttattcagatatcatttgtgttatatgtactcatttgtgtgtgtgcacatgtgtatgtagtcctgtgcagatttgtataatgaccaccataatcaagaaaacctttgaggctgggcgctatggctcatgcctgtaatctcagcactttgggaggctgaggcaggaggatcgcttgagcctaggagcttgaaaccagcctgggcaacataatgagacctcatcgctataaaaaaaaataattaaaaagaaaatctttggcttttgaattgtttgtgcaaatataacattgaaaactttgtttaggtctaaagaacatgccataggcctggtgtggcccgttgacctccaattttcaacctctgttctagtctagccctttctttctttcttttattcagataaatttcacatgacacaaaattcattgttttaaccatttaagtagacagtttttttaagtatattcacaaaggtttgcaaccatcactactaattccagaacatttttgtcaccccaaaaagaagctccatttagcattttcaccccattcccctctacccccttttcctgacaacaaacaatctactttctgtctctatggatttatctattctggacatttcatgtaaatggaatcatacagtatgtgaccattcgtgtctgattgggccttttatcttacagaggaagaaacttagggccagagaaggaaggtaacatgcccataattatgctgctggcaactgccctagtctggacttgaacccagaaccagtactctttgtaccatacctttctgcctgttagcattcaggtcttcagttttatgatgatggtgataaaactaccaccccagctatttcttatcagttggcttaagtaagcatgcgtaataacagaatgtttctcttacttgtactgagtattaacattatgcaaagagtcactttggaaatgggaattgtcaccgagaaaacaaggtagtttagttcagtgtatgtttattgagtgcctactatgtgccaggctctgggccaacagggatgaattgaatgggtcccagccatcaaggggcagtcatttgggggaaacaaagagattaaagataatttccagatgttgagggcaaatatgactgtggggcagagggaaagggtatcagttctagcctgggggtggggtggtggtgatggtgagggatgatttaaggggtggaaggaagctaacaggtaacgaggcagcagaaagatgttttaagcagtagagacctgagcaaaggtttaggcatgatggatccagagagttgaaccgtgagctcattggtggtgatggagggcgaagtggggtattggagatatggttcgaggggtgggcttgggtcagattcttgagggtcttgacgtcataaaaagtcagacacggctatggatgtctgaatttttcaagctgaggatggctgaatggaggcagagtaagagaagccaaacatgggaactgggtttcctgggaaatacccaggtctgaacaattggggtggagtcaggggtatatggtggtggaaccagtatctaagtagcaacagacttgagaagaatcaaggcaagagaaaccaagagacccattctagaggccatgatgaagtcctgcccacgcttcatgccatgatgaagatgccatggggcatctttaaagggctctcagccctgttcccactggcctgcctcctcctccttgtttacccgcccacccactcagcaacgttttactgagtacttgctatgtgttgtgttgctgggggtaccgcagtaaacaagttgggcaagattcttaccccctaaagggaaatacagataaataagataattacagattgtgagagggtctacaaggaaagcagcttttgctggtgagagtaaggttagggagtctgggctggccccagtgaaaaagcatatttgatctgagctctcaaaagtgagtgctctctttccgtggtgagaaaaagggaaagagctttgcaggcagagagaacagcaaatgcaaagactggggaaggaccctctggcatgggttaccctgggctttgtcgagattttttcagggggtctcaaatcagatagagcaggtttctggagatctggccctacactgtcttagggaggggaggagagagaaccattagctttgggaggaagaatacatatcctagtggaggaaaaattgtgaagtcattgtgaatcattgaaagtaggcatgctttctttttttccttttttttgaagggagagctaaactcattttgttattttcaactaattttgttatactttatgagctttgtgtcattcagagaacttggaaacattcattctccctcctactgaatcagtggagtaggtggaagagctttaaaaagctcttgaggattcatcttcctttgccaatggatgcaggaggaggacagctgggcaatgggaacacagccaagaggtgtttgggaagtgggagcgacctcatcattgagcacccaggaagcttcagtggggttcaggtcctagagatgttggcaccagttatggccccagtgggttttgttatggaaaagagagaagtctttttcaaagtcagaaaagggattcattttgcatattagaacttcatcttaaataaaataatgcagtgtgatttaaaaaaacactgcccatggtggggcacggtggctcacgcttgtaatcccagcactttgggaggccgaggcaggcggatcacgaggtcaagagttcgagaccagcctggccaacatggtgaaaccccgtctctactaaaaatacaaaaattagccgggcatggtggtgcatgcttgtagtcccagctacttaggaggctgaggcaggaggatcgcttgaacctggaaggcggaggttgctctgagccaagatcatgccattgcactccagcctgggcgacagagtgagactctgtttcaaaaaaaacaaaaacaaaaaaacactgcccaaacatgaaatagataacttctgatttgtttccttcccaaactggtcagcctcagggccagttgggcattttctcccctggactgcctgtgtttgttgatggaagagttggaatttgtggagggagaaggagaagagagtatgtcgtgagctcggaaagcagcttgggccttggatctggaacaaggagagagggaccaagtctgagctgagtggcatgaaatttgaggtgtattttgaaggaaaccagagggctccaaggtactatattgggatacagtgagccatcaaacaaagaccccttaaaattttaaaacaacagcagtaacaaagcaaagcagaaatgattatatggatccctgtccatatataggttagtgggacaacaatgtgaaaatataagtgattcatgctaggaaggagagatacatggggctttgagaacttgtaacaggagagcccagagtggtccagagtgggtcgggtggcctggattgatgtttggtaggaatgagggtggcagaggtgactttcacaatggttggtattgatctgtattcttgggatgggggatgaattagggagtgatggtttgaggtctttggcagggcctgggacaactcttgtgaagtcttttggggggttgggacagagaaatgtcttgttttaggccagaatataacagtactgtagggaaaattagtgaatcttttaaaaattgaggaccaccaccgggtgcggtggctcatgcctgtaatcccagcacttggggaggccgaggcgggtggattacgagatcaggagattgagaccatcctggctaacatggtgaaaccccgtctctaccaaaaatataaaaaattggctgggcatggcgacaggcgcctgtagtcccagctactcaggaggctgaggcaggagaatggcgtgaacctgggaggtggagcttgcagtgagccgagatcatgccactgcactccagcctgggtgacagagcaagactccttctcaaaataaataaataaacaaataaataaataaataaataaataaataaaaataaaaattgaggaccaccaagagggggcaaattatgatcttgagcttttcctaaacttcctcctccaccatgctcttccaagtttgcattatggctcacatggaggatccttaggttgatggggacacctgcctgtttccttgttccttggaaggatagtatggattgctgctgggccttgcaatcagaaaggctgaccttagtcagctgtgggtttctctggtgctggctgcctgaaggtcacctagtggcaccttgtaatattgggggaagagatttctgcaggctggtgcattcagggagccggtttactccgatccgtctgtcatctttgcggtacacggcatttactttgccagtcttagcttgagattgctcaggtcgttacatgaccacaaagtggagatctggaaagagaggtgctcagccaggcttggcaggtttgcaggcgctgcattgaccggtagagtcctgcgctttggtgggcaggaaggacctgatcagagtgctctgtgccttggagctattcctcgaaggccacctgaatgactggatgctcccacatcctttcttctgccagagcagtgaacccacacaggtgtatgaaggctcagatctgctgctgagattggacacccccaatcgtttaccaagaggcactgacattgggccatggtatacaagggatgggggcaaagaggaaggccacttcacttacccatttgctattctggctgctggcattccttttttttttttttttttttttttttacatttatttaaaagaagttgtggttgtcatagtgtgatgcagagagtgggtaaacataccagggatgtgctactcccctaaagatctggatccttggctctttcctggaggatgctgaattcatgtccttgaagaggttttggagcttctgagacctctgggtgaaatacactcttttcatattggacatcgcaatcacctgtgaggaggttctggacagtgcttggacctctaaaccatagattttgatttaatggctgtggtacatagggggttattttgttgctgtagttctgcaggtgtttctaattttcagccatactcaggaacctgcccactagttactgattcagggaagctcttccgattcttcaggtgaattctgcctgtttgtttcctcatacgggccttgaaccggaaccctacccttgaccacgtgtttggtctttactcctctgtgtgctgctttccagcctgtgttttggagtgcttttccccggctttgcctcagcctagatcagggctggtgactcacttctttcttatctatgaagaaaaggagaactccatgtggggattttgatgggcagatattctggaacatttttcacaaggcttcctgcttgaggctcaaatgcatagtagcttcttgctgcggaaatccaggtcctggggtggagatagacagggcagccttgtgactggtatgagaaaaacatctttatttactgtcttttgtccatcatgaaaggcttagtatttctttatttcttttttcttttttttttttgagacggagtctcactctgtcgcccaggctggagtgcagcggcgtgatcttggctcactgcaaagtctgcttccctggttcaagcgattgtcctgcctcagcctcctgagtagctgggattacaggtgcgtgccaccatgcttagctaattttttatttttagtagagatggggtttcaccatgttggtcaggcgggtctcaaactcctgaactcatgatccacccatctcggcctcccaaagtgctgggattataggtgtgagccactgcgcctgaaggcttagtatttctaccactgtgtttcttaggccctgcagactctgggacagcagactccagggagtcgtaggtaggcattgccagggagcagggctgaattagtgacatttttgatatggacacttgtcaagataaacttctgtaagtgcatatgtaggtctgtggatcaagtccagcagatgttgggtcacgtggcatcaggcaggggcttttaagacccagagctaataggagatctggacaagaccaaattgtaggggctcttctcatctccttgcttttgcctccattgtcgtccatttctcactgtgcctggtccactcccatccaacctttaggatttcctgaggcctctgtccatgctaggaagtatcttttcacctccactgcatcaggtgcccctgctcagtgctcccataacacaggtgcatactcagatcactacacttaccgtagagggtttagctcaggggtagagcatttgactgcagatcactacaattacccattattttataattcattttgagtgtctggatctatcttttattcagatcaacttgagggtcttgttcacttttgtatctccatcaccttgcatacttcctggagtgtaatagggctcaataaatatttgttaagtgaatgaatcaataaattctttgtgggagtgatataaataagtactatcaagatcttattgttgaacattgcttacttattacagtgctgttaccttgtacataaacttatttacagtcttgtattgaagatgcatgttaggggagatttttctagcataaagagtactcaagaccgtttaggacactgagcacttttgatgtatggcaagcattttagtggaaagtggggtgcttcaactgtatttccttgactttaatacttctctgaaagtattatttttgataattatctttaattagttaattgtgtgtgtgtacttgtttattgtattaatttttttgcttaatagtataagactagtatgtagtccagcatagtgtacgagtcctggattaggcaatcgagagacctagattgacctctgcatctaactatgggagtgggcaagtcagtttcctgcttacatttaattcatgtaaagtgggagtgttgtacttctttgggggttgcaaatgtctacaggagtgaggctaccaacttgagttattatatgggctctaccattttttttttcttggaactaggccccttttgttttcccacttgtgttagaattataagtagaagaaaatatttctgtaccgcaagaaaaaaataatgcaagggcaatgactaatgacaaccccagttcttctctgtgtggaggagacaatagggagtggtggggactgtggtatattggagcggccaagcctgcctatgaagggtgactgcttttaatgcttagcaccacctgatcattttaagacataaatgtgggccatgttgacaggtctgatttttttttctttctttaagagaagccagaaatctgggtttttgtgtgatagctctgatttttatgtttggctcagattttctaaacatatccatagatgaaatgtaacacttccacaggttggatgtcaccccttgtgctttcagtttgtgatctccattaaagatgatctctaaagctgccttctgcccaagatcctgtgattctaatggggaccatttcagctggtgaattaaagatccttgttctactttgggaagtcagagtggggaaggaaatcgggctacaagagataggggtttatgcctaaattgcctggcaaatggtgtttaaatgagtcctgttggggagaggccacagggtgcctgtgattcacaccaggtgttttgtacatttgtcattgcaggagttggcatcctttggaagagttcgtgaaagctttctgcccagagctcctggaccaatgcatcttcccaccaccttaaaccactggtgaatatatgtgtttttttccttcttctcagtgaagggaaatgctttgttaactgtagaatgcgatttgcagagaactatgctgtcctttctattatagaaggaagtatactgggctgggcctaggcatatctgggttttggtacttacttgattctgccatttttactgtgggattgtaggtgaattctttgacctcccaggccccagacagagaaacatatcctgctgtttacaggatatgtttgctttgcagactaaaagagataatccatgcaagaagtaatgtatgcacgaatgcttatattttcccagggagaataaagtcctgggcaaatagaaggtaatactgtttggctctgagatgtagagcaaggcagttctccccctatctgctacatttattaactttattaacacactttttcaagttggaattccagatataagtgttacagtgtagctgccatagtcagcccaattcaactgaccaccagttaggggcttcctgccttgacttttgtgatgttcacagacaccttcatctgccagtctcataggggttttcaagcagggcacttctgagccaacagatacattaaagtgtgaaactgatatgttggaaataatgggttttaaatacttattttctgagactttcagagtggttcttcaagagatttccattctctcttttttttttcccttcctaccactatagctaccattttcttgaaagatgaattaacgacatttcacaattaccttcatttttatttgagatcagagaatttcacagttaacaaatgttcttcctttttttgaaagaaacttaattactcatcacagcaggtacatgtcttgcctctatgacagttgaaagaggcaaaaatatgtccttaataacagtgtgttccagtgctgaggtgagagtgcctccaggtatgacagctagtggatgttggaggtcttaggtgagatattgagggaaaggaccaccatgggccagggacgctgaacaacccatgcatctttatttgagctactctttgtagagaaaagctggcctgtttaacactacctggtcagctcctatgatgtggatcaggtgctcctgtgacctactgagacagatcccagtgggatggccactggtgagtttgcaggatgctgggggttggaataggaaggaagggcagtcagttaggtaagcaggcccaggattagggaaccagatcagccacaggaggctggctgtctagactcccctgtccaaggggacacagtgacattctgagtcccagaacctgaatcccatctggtaggcaggaagggctctgtagtggaagtcctcagggaagcagatggcatcaggtagcaggacacttatgtattcaacaaatatgtattaatgcctgctctgtgccaaggcactgttctggggattcagtggtcgtaagatagactgtgcctatgcctccctggatcttagatttgagtgggaatgatacataagaatgtgagctccatgaggacaggggtctttgcttgtcttgtcttgttcactgttgtatcctcagctcttagaagagcacctcacacctgatgggtgttcactaagtattgtgagcaatacttatgaaggaagcaaacaaataactaaatagacaatataatttcaggtggtaatgagtggtatgaaaacagtaaaacaaggtgaagggctggcggggctctttttgaaagaatggtctaaaaaggcttctatgtatgtgagagagaaaaagaaggagattggttttgtgcagagacctgagtggagtaaaggaaccaggggaggagaagtgttcaggcagagggaatagcaagtgaaaagaaaggcctttgacgtaggataagcttggcttagtagaggagcagtttggctggacttgggctggggggtgttcatagggagggagagtgatgtgaaataagagcagtaggtgagagccagaccctgtaggccatggtaaggagtttgatttttactctgagagtgattggattccatagtccatgtgatcttctttgtgctttaacatttttcctctggatcctgagtgcagaatagatgctaggggcaagagtagaatctgtataacctatcggaggtccttccagtggtccaggcaggagattagggtgtggcttggattagagtagtgatgattgaatgatacgaagaagcggtcaggctcaggatacattttgaaggtagagccttctaggttgcatgtggcatgtgagtaaaaacaagagtcaggattagtccaatgtttttggctaggtgaatgacgttgccgttcactgagataaggagcaaagagggaccctaagggttctgttgggccgtcttaggtttgagatgctcattcaatattctcataaagatgtagagttggctggggctggaaatggtatctctcatagtcattggcatgtagatgatatttaaagccatgagactgaatgagatcatctagggagagaaaggaagagatgcgtaggatttttgacagaggaaagagggaagacgaaggcaaagggtatattttccatataaagtccccactaagaagtaaataaagacatgctaatgaatatggtttccattttatgcaaatatgaattatacaaatgagataatatgatataaaagtagtcataaagtctcaccttatgtaaaaagtttgaagtgctgtgacttccccaaatcaagaaaattagtttcaagattgcataattataaatctggtcagctgagtgaattattagcaagcaggaacatccagcagcctttgccaatagcctgtaagctacattgctcttaggcactggaacttctacaagccatttcaatgactaaatttaatttactgttattacatttcaggtatttttctcattcaatagttatatcatccaaaagttcattgagggttcactaagtgaaaacatacctgaaaatcagtaattttgcaatgaaaagttagacatcataaaattttctgaagaaggccaaacaggcaccatgatttacagggctagaagttagaagatatttatgattatcttcaaaatatcaaggataaatgctacaagataacaaatatactgtgatggttgtggtagatagttgcattccacctgtacccctcaactgccattgactgatacgagaaaatcagttctgactcatgcacatcttcatctatttgtgggcttctggcataaaatgcagctgtcccatatttgctttgtctgtttcccagacaaatcgtctcattgagcttcttccatctcctcgttgggcgccttagttttcccattttgaggctcctagtgagttcctttagtcttgcagtctccagctgccatagacatttttgcctcttcccaccatcactggctccaaagcctatttgcctcctcctccgactgcctatgtgagccttcctccgtctgactgcctttgtgagcctttcagtttaggaaccccccaatccccctgccctcaaagcttttgaatatcctcacaatttccttctttgaaaacattttcactccttccctcaaccccaaccccatgtggtcttctcaggccttttgtggaaatgatgatgagagagggcagggtgatcagcagcattctagaatggggtctggccctcccgtgggcatgggcagtgctgacttgcttctacatgtatttcaagactccccagcttgagtgaaaacactctgagtggtacttctggaacatgtaatctctagaaaatgaacattaattgtgtagtgttctgtctatgaccaacggtttatggcaaatgagggtttcagtggaatggtatttataatgaatggcatcaaccctggttttcatttgttgtcttttctcacagagtggaacttaaataaaattaaaaagaatgaaacttactggcaatcatagggggaggatttttccttctgattcctccttcagtaagtgatttcaggaataaaaaaggtatgggatcttcctatgcccctggagacttagagtggtgggacattaaaaaactggtggtatccttcgtaagttaaacacacacacagacacacacacaaacaaaaaaaccgctgaggctgtagaatagtcttcagtgcttgtatatttgtagaccatctcaggaggagaggcctgagatgggtagctacttaaaatttttttgtgtgttatgtttatatattatatttaaaaaggataataatagtatcccttttattctttataaatgatctagaaacattgaaagtttcctcaccagttggtttataactcctcttgctcaatatgtcttttgattgagggcattgcctgttcacagtgcctttaattggtctgaggcttcacattcattaacggcttgggactagagtactttgacttgagtttcaaattttgcatgtatggggatatgtcaggccaatttctttcttccatcctttcccttatttctaaaaaggatttaaagctgtttgtgctcaatattttcttttttcagcagctttagacaaatatggatttgaaatgaggtggtcgccatgagttgagccacagattatggccatttcaactgaacatctcactgctgccctttagaacaaggtcttcttgcattgtggaacagaacaggatttggaatcctttgtgattgatagtttctaaccgcggagttcagacaaattaaaaagcaatccaaacccattttctttatcttaagaattccagctaccctaggaaaatgctcaaaatagaatttgtataagttgccacctctctgaaagagtagggtggcaactgaattctaattcggtgtccagaaccaatgatgccagtcaccacactgctgtttggagtgtgtgctattgggggcagcttctcaggggtcattgtctagaagtatctccctgggctgccatattgctttatatcaccagaggttcataaggccactttctggccaaagttattgtgacctacaatgacatgatatccatttcacacaacagcgacatctcttaggtgttggtgtttctccaagagatttacacatttgcatttgtactttttaaacaaacaggaagttgtagcacatttgccagccacatgtaaaaacaagatactttctctttttccatctagtgactacaaatagagagtggaatacattttttgtctttcctttttttttctttttttttgccctggtttggagaagtaaacattaaattgtgttggggtcgtcactaaaacaaggagatcagcatcatctccggtgattactgctcgtcatgggaagaaatcattctgattgttccactgactaatttagacaaggcaccatttgatgcctacttcacagcagtgccctcatcctgctgtctccttatcaacatagagatgactcactccatgtttttctcactcagagagaatttctctagtctactgattatggcagtgattaaataaaaaatgattcctgcagaggtgtgcttgaaaaaaatgattgtattatttgtgcttgttgaactttggataattcagcattcactattataatcagtaagatattggtttttaggctttttgggtaaagggtcaggaacccctttaaggtacatatgcacgtacacaatttccatgtataacacttctacatttttaggagatgacattcccctgcccagttaccatgcttagtcacacatcccatgctaaatgtgcttctggatagctctgtgtggcaggtaggtgcctgctgtaaaagatggcttttctgattagatctaggtgaaagactggggaagatagctatgttcaaggcagcctaacttcaataaaatttacaacttccagaattgtcccaacatggactcaaaagttggaaatagtctcttatatgagttgctaatccttttaatttaaaaaggaagcagaagcacctttacactttttgtttcctttctatttgagacagggtctcgcactgttgtcccggctggagtgcagtggtgcgattatggctcattgcagcctcgacctcccaggctcaaacagtcttcccaatcagccccgttagtaactgggactgcaggtgtgcgccaccatgcccagctaatttttgtatttttttgtacagacaggatttcaccatgttggctaggctggtcttgaactcctaggctcaagctgtgcacccacctctgcctcccaaagtgctgggattacaggtgtgagccaccacgcccagcccctttttgttttctaacagctaatttcattttccagcagatttcatgtttctggacattgtatttatttgttccctgaatttatcatatttatagcattttgtcttctgtggccagattgcaagctagctggccacaaaacaccagtgttttaaaagtttttaaagtagtggccagagttttaaaaatcagaaaatcttacataatttgatttctaactactcatgaaaaactagaatatctagcagtactgggctctattcttgcatgggacagtgggctggaatggaacagaggttgccccctcaggagggagtccaatttgctgtggtccccacatcacctgtttgctacctgtttgatcctctcaggcttttggttttgtcacccctgacttactgttcgtttaaaatcttatcctaaaaaatcaagagatctttaggttcaacaaaacaacctttttttttgttgaaatggagtctcactctgttgcccaggctggagtgcagtggtgtgatctcggctcactgcaacctccgcctcccaggttcaagcgattcttatgcttcagcctccccagtagctgggaccacaggttgcaccaccatgcccagctaatttttgtatttttagtagagatggggtttcgtcatgttggccaggctggtctcgaactggtctcaacctcaagctatccgcccacctcagcttcccaaggtgctgggattacaggtgtgagccaccacgcccagcctgatacctctctttttaaataaggaaactaaaatttaaatgatagggaaaaaaatgttgggacagtagggtgaaacaaatatttttttctttaaataaatttgtgtgttttatggctgggcctggtggctgatgcctgtaatcccagcactttgggaggccgaggtgggcggatcacctgagatgaggagttcaagaccagcctggccaacatagtgaaatcccgtctctactaaaaatacaaaaaaattagccaggcatggtggcgggcacccataatcccagctattcaggaggctgaggcaggagaattgcttgaacctgggaggcaaagtttgcagtgagccgagatggcgccattgcattgcactccagcctgggcagcaagagcaaaactacatctaaaaaaaaaaaagaaagaatggaatttgtgtgtttttaactaagaggaaggaaagaaagcaacaatgtaatttttaaaaagtattctttacaaatatcaagtcattatattagttttgaaacatataatgtcctttgtataatgtgatttactcacaaaaataccatgttgggaacatttatacaaatttactaattacatttgctcttaaatattttcattttatttttcaaatagaagtgaactactgaactcaaaggagttgaatgtttcttaggtttttttccttttaatagacaaaaatataaaactggacaacagaagtcaccagtgttttaatgaaacaaagaattagtttttgggtctggtaccttctaaagcatctgtagattttagaaaaggaatttcacaccaccaccaccaccaagaaagcccaaccaacctaaaacttgaataactgaacttaatccgagtcattcctattttatgagccatcatgatccacagtttctgtttcttctcatgtcgtcgtttcctttctgaaatcattcttgtagactgctgaagactaaatgctagcccagatggagactgaatttcaacctttttcatttttggcttcttggttttggggtgagagttcatcagactgttggtatacgtgacttgccaccaactctacagcaacctgctgtctctgagctttagttgtttctgagataaatgagatcatgtctgggccttcctcaagctctgacattctagaattccactattctgtcacatactgcacatactcagtgctgggtaaacctggagtactggccatgtaacaacttctgtggggttcaaagggcagagtctcagtagagatgggttcctaatgtcatcgtttatttctcatggctgccagtaataaacacgaaagaagaactaaatatagtgagttatgtactcaccagctcatggtattatcctgaacttgccgcactgagaggaaattctgtagctctgtttagtagatggtacagagtaaaccccaggcagagagttttcatcttcttgtcatcccgcagaatatttctgatgactagagctctcaggtctgtaagcctacccgtcttcaccggtgctcatgagacttggactaccctaatacttggattttacaatcctgggttatattgtttcttaatttttttttgtggtgggtccaaagccagttgaacaccatctcttggctctgatgagtcaaaattgtgaccaggacaaaaattaaatggcacagaggctttagcagagaaaacaaaacattttgtagaacatgctcagcacaggatggtgtaatggaggctgcagggggtgttttgctgtgggcctgtgttagcagtcattggctaagagcttataatggcacttagagcatggtacaaatgtatatacacacccacaaagtatagtgtactatatgtgcaatatactaaacctgttgtgcttgtattttatactaaatatattgttttaggaagttatttccaaaatagccaaaatacatcattagaatgattcagcactgctcaggttggcattaagtgggctgtgtgtgtaggagcaaaggagggaccagagttttgaaaactctggttttagaaaggatcttcttggctgaattctagactgtgttcctggttcctaagcctgataatactgtgtattttgcagctctttagattgcctcaaattcattgatttgtttattcatttattcaaccaacacatatggagtagctctaatatttacacagggccttttggcatgcggagtacattcatataccttatcccacctaagtgtgcttgtttcagagcccagtcacatgcatgggcaacagcctgcattgatgcattgattgatgaatgcaatctctatttcttcatagagtgtttctctttgctttctgttgtgcttgtaagcagagatatacgtggttttgtctgcaccatgtagaaaggaacttaggacaggtgggcaggagggttgctatgggagttgtgctggacagtcattcccaggaacagaggaggtaggaatcatcgactaagcatgagattggggtgggtgggagggatgtgattgtggctttgaggaagatggaaactatttggaacagctgacatgggttgggcattgggggctgagcaagagctgaaagcaaggcctgctgggtgactgagtggaagcttctgtgtcagcaggtgtggcctggatgtgtagggcggcaggtggagctagatgagactcagggacaaaaggagagggctgggggcaggggtgggatggttgcttggctgttgacataaggggacttggaggagctgtttctgaccctgatgtggccatatagggagttgttgaggtgaacagcaggggaggtacaggggccccgggggtgcttggcagtagcttttcttagtttggcttataaggcctttgatctcttagcactcctcccaccccacatgccctactgggccattcctgagtgcatactatcatgtgtacatactattcctttttttctttcctttggcctaattacctcctacctcaagtgttagcccaggaatcactcccgggcaactgtttctgattgctgtctgccctctcctctgctggaacccttcaccctgtgcatgcatctctccctttgtactgtacagactcatttgtaagtctctcgcatatgtggattggaaggttccttgggtgcaagattgtgcctcgtacccagcggaggacctggcatgcagaatgtgttcatgaaatgcttgctgagtggatgcataactcttttgttgcatcattagtagcataacagaatgatagagctgaaagacacctacaagatcagctagtctaagtcatttgtttcatagttcacagagaattgaaactcagaggggttgaatgcctggcctgaagtcacacagcttgtcctaggctgagccaggactcaagttcacctcctctgactccaaatgccatgctctttccaccacaccacagtgttctccaaatgtcttttatgtgtgtgaagacagcagccctctgcgtctgcttagtgcctggatacagcctaatatcactattcgtactgttatctaacttttctcatcgggaggaaaactatgttctgaccacgcggggagcttttcctctgcgtgcatggagccaggtttacaacaggccttacctcactgcttccccttccctttccggtttgtcctagtttatctttgggcagggtaagcatcagcaactgtttctaagtaaatagaggaattgcagattcaggatttgtggtttcaagtattcagtgtcttttgcttcagcccgtcccctcctggctgccatcactgcctcccctgtctccacattgccccgatttagcatgtgttgaagactggtagtgcacgatggaggtttctttcttggggcaagcagaagaaccaacagagcattgaaaagggaatctttgagagagagagagagagagagagagagagagagagagagagtgggcatgtctccgaaccattttgtgtcagttaaaaaaaacaaaccaaagtatatctgctggtttctggacccatccctggaagatggcatacaagacggccatctagaaatgcttgtttgtacacctcccttctccaaagtgcgtctccgagcttttgagcaacactgatgtttagtatgttctgtttagggttaaatttgcagcgtgactgaggctggggtgtggctagttcccttacagcctgtccatggatgacgcagttttgtgaggttggttccagatcgccacggatcatctgacctctctccccatcaccctggtctgaagtacctcagggtcagttccaggactgaatgctgggagtggggctgattggtttgaacctttggtctcctctgttaattaactaaacagtgcatggctaaaaatgtcgctttggggaaaagggctctgaagaacagtctttaaatccttcaccactttaaggagctctgcaatattgtttcccttagcgcttgtatattcccctcacctttttttttttttttttttttaaagtaagaagatgatgtacgatcttccctttagcttggaaatcctatggcttggaacaagcccggtgtcttcagtcttagagatttctgaagccactttggaccttcttcgcttctagccacatgggagcctgtgtctgatcctccctgggctggtcttgagttccaggcattgagctggaagtacatcagccaaggatttggctgtgtcaggaagtattttgatttgctatattctctgcttggcatctactcatttccttcagggacgtccccttccttggaaaaaatagctccaaagatgcttgtctcactgatgagctaagaaggagttccaaccaggcgtttccattcagggatcttggcttggcagtcacaggtcactgagtgagaagggtgtcaccacacttaaaatattcttaacatcccccttcccctcctgccagcagtggtctttatgctggctagttttgagaatgacagtctggagactgatccagcttggactagcaggccttaacaagcatgtatttctaaggtgtcagccatcacactgcttggctgtgacctttaggggatatcctaagtggcagccttccttgcaccctaacctcaagctctcctctcctccagatgtgcataattttcctgtgtggtgccagggaactgtggttataaatgagagagaaggggctctgtgggggtcccagaactgtgttgggatcctgtctgtgaagttacgctcatctgagctactggtctaattctatttttaaaaagggaaattaattgataccttttgacagtgagcctgtgtcagtttttggagtgacaccaaaatagagtcatcactttcttttcataggtattcatctatttaatattccaggctagaattcttcaggatgttgatcccaagcttcttagtgtatacttctagacccttcttagtgttaattatttagttcctcaatttcatcacctttccttttctcagaggtttctgaaggattactgatagtgattcatcagtgacagttcagattcttttagctgtctatggatgtggttcacctgagcctgaaaacccaaaaaggagtagctctcacttaaaggggctgcgactctcctagctccacacctgtcttctgcctcagtcacctcttaccagagtctccctttccagtaagatcattctcatagttggtggaggtggaaacaacacgaggaagagtggcttctcttataatatgacgagggcttcttcaagcaggtctgttatcatacgctttgttttcttcttggtctgatcatagatttttaaaaaagaacctccaaaacaaaaaacctaatggttatttcaatttcttatgttttaactcttcccagaccttagaacaagcttgtccaacccaaggcctgcaggctgtatgtggcccaggacagctttgaatgtggcccagcacaaatctgtaaactttcttaaaacaatatgggatgtgtgtgtgtgtgtgtgtgtgtgtgtgtgtgtgttgttttgttttagctcatcagctatcactagcattagtgtattttatgtgtggcccaaaacaattcttcttcttccaatatggcccagggaagccaaaagattggacacccctgccttagccttttggactttcctctgaccataaatgctgctgtcctttgttcagctttgactccattccttcttcctgtggcctagacatgcaaatagggcattccaatgttaggagtgctttgcagccccttaaaagattttctagtgctttcctggctcccaaatttccccaccctctttggaccacagagtttttctccaagctcagataacctctgactcctcatttgcccttccaaaaactttgcttctccccatggtgttctctctaattttaagctgtgactggctttctgggctcccaggcataaccatacagggctgtgttagtgactcagatcaggattcagctgtgctgaccacccagaacttattcccactcctactccccaagagaccagctcttcaggactcccacccagggcagggctgggtgggtccaccaatgcctctgccagggttgagttctccaggaccatctgggcctctccctgagctgaggtacaagaccgaggctgcccagcccctaggtcagagacgaaaggaaggaacaggctaggggtgggctggcagagagttcaggctccctgagctgggagtatttggggaagggaaaagaggaggaggtcggaaagtttgtgatgactctgaagactctcaggtttgtcccggggggactcaggccgccaaactgttcacttttctgcagctcggtgttgggagtgtgctctcttttggagtcacccatcctattttgggatgactgagtcaaaggagtagctctatcttggtgcctggaagtgcctcacatttcctcattttagacttgccattcttttcttaaggtgcttttcttaaggtgcttaagaaaagcaccttaattccattattaaagattcaggatcattaagactcaggctggattgaaatttatctctttactgtctatggaaaaagatttaaggagaaaaatcactgtgagggatgtcgatttaggaaagctttctaaagaacccactttaggaatgtgcatttgcatacaaacaatgaaagtgctaattaaaatgattctcacatcatcattttagcagtgcagggactgctgcttggcaacacttatgaagtggaaatgagtgtactttgaaaataataaaatattgttccatccattgaatccactaagacattaggtccttttatttgcaaggcactgtgctagaaccactgtgtgtgtttgtattggtcaagagtataaaacctagtccttgctctctagggtgaccaactgaggggtttccctgggataaaagactatcaggaaagcccgggaagaaccaggttgaattgggccaaacctacctcgggagttgaaaggctggtaggactgaacaatgttcctcaaatatttcacctgttgagataggccacacctgttcacattgttttagaaacagcattttgccctgtaggacgtttttgccctggaaattgagtagtctaattcccttttaaagcaagagcccaacatttaaaatatttctgtcatcattgtcgttattggcatcagctatcactgggcacctgctgtttgaggctgggactttgccctggagagtgggggtggggctgatctggcctggagatgatgtgaaaaccttttagctcctgggcgaataactgccaccttatctttttttaaaaaaagaatagtgttttagaacacggagcctggagcgcagtagatgcagagtcaatatttgtggattgaagtttattaactttgtggttgagagttcagggtctgcagtcacatagacttaagtttcaaatcctggctctgccatttgcctgctcgatgatcttggcttgtgacttacctctctgagcctcattttcttcatttgtgaaattgagataaacataaatttagttattatataatattaatgttcatatgataattatgacaggctgcatattgtggtatatagtaccacaaactcgagtcaggctgctaaagttcaaatcccccttcctagtatcataacttccagcaagttattgaacctctctgggccttaattttcttatctacaaaacaaggataataatagtacctttacagagggttgttagatgtgagaattgtcaagcacctcatcccagccataagaaaacattatatacatgtttgctaaaccttaaagactgtgaaactattattaattatttcattttggttcttatagaaatcctgtgaggttagatacagggcaagtattactccccactgcctcattccctatttgttgttattgcttgtttcgtatttgagggggaaaaatggagttctgaaaggttaaagtggttggctgaagggaacctggctagtaaatgttataactgaaactagaacccatggtacttgctataaaagatacaggtgtgcctatacacatttatcgagggcatgaagatattaaggctttactgtaataaatctgaagacaagtgactagggtatctccctcttctgcaccaccacccccaccaccatgtgccagatctgctggcatactgctaactgatgttctttgtgaatgatggcattgagcttgtgccctctcattgggtctctggggcttactgaggcagccagtttaaacctcttacagattctaactgcattaaagttagtgttacctgctctctggctggacttcctttggagaccagaagattctactatattccaatacctgatttcagaaccccttaggggagccatgtcatttgcgggaagctcaggcttaaataggaatgctcccctccccctacctttctgtttgcaatagaaactctttattgctcttgagaaacttaattaggagaaccatatatcagggagtgtaaacatagctttaaaacacttgccaatctcttgtcacctaggcagttatctttagattaaaacgttctcatgtttgttcacaaacatgggcactttaaaacatgctgccacatgaggggttaaaacataaatattatcctatatgagcaaagaaaggtgctttagtacttaagtcctatttttgagctgtggaattcaattccttcctgttgccagctgaacctggggctctgatgtattagatgaaaatatattcctatcttcaaacgtggacaacaggacattctgtcctccaaatttcagtgtttgaattgggtgttacaggaaacttggcaccctctcttttcaaaataataaacagacatgatgtggcttcatgtttcatctgatggggcttagatgctattgcctcataaaggctgattcacagacaaatggagactaattatagtagcttaaaaataatatcgctgtttaaatttggcaaggcaagatgcctcgcatgctttgtaggacacgagagactccgtttctttggtggcatggaggtgacatacccatttctatttcagccacacagtggtggtgctggttcattacctgccatgtttattttttttaaggatttcttatgatctctcacatatacccatgcacaaacattgaactctctcttcctataatctttacagggagttctttcctgctatctgtccactgcatttttaagaaacaaatgtctgggctgaggaaagtgaatggctttttgtttttttttctaagcatttcagaatctctactgtgaaaaattgcaggaagttattcacttctctctaaggaatggatagaggatgtctgtcataagagaccattctgattacttttattctatccatcttccccaaaactgtgcattaggttggaaaacagttttaatttgtttttgaatttgctttaaataagtaggtgatatacaaaattgaccatgtgcaaaatttaaaaattagtaaaaatgttttcagtgaaaagtaaatcttctacctctctcatatctaggatctaggtacctctctttggaagaaatcctgagcaccattttattctatactattctggagattttctagatatttataaatatgtatgtgtgtgtgtatatatatattatatgtagttcatacaaatggcacatattatctacaattttttttttttgagacagagtctcactctgtcgcccaaggtggaatacaatggtgtgattttggctcactgcgacctccacctcccaggttcaagcgattctcctgcctcagcctcccgagtagctgggattacaggtgcctgccaccacgcccagctaatttttgtatttaatagaaacagggtttcaccatattggtcaggctggtcttgaactcctgacctcaggtgatccacccaccttggcctcccaaagtgctgggattacaggcgtgagccaccgtgcccggtgatctacaatattttgaaccatttttatttaactgtaatcttggagatcattccacatcacacattgagatacctcattctctttaacagctgtctagttttccattgagtagaagtgccataatacataaacaattgcctatgaacggtagttaggctgtcttaatcttttgtccataaaatcattatataatgaataattttgtacatctactgtaggataggtggtctgtctcagtggttacaagcagggctctggagcccaagggcctgagtttaaaccctagtttcttcgtttacttttttttttttttttttgagatggaatctttctctgtcacccaggctggagtgcagtggcgcaatctcagctcactgcaacctccgcctcccaggttcaagcaattctccgcctcagcctcctgattagctgggattataggcacacgccacaatgcccggctaattttttttgtatgtttagtagagatagggattcaccatattggccaggctggtcttgaacttctgacctcaagtgatccgcccaccttggcctgccagagtgctgggattacaggcgtgagccaccgtgcccggctcttcatttactattgaggtatatatggtcttggccagttactttatctgtctgtgtctaagtgtcctcatttgtaagatagtatttatcttgtcggtaggatgtaacggttaaaatcactagtctatctaagcttatagacctgtgctggacatgtagacaggcctgtttgtatttactagtgttgtttcatatgatctggaaacacatgaatcctaagctattcttatctctgcctgtttctgaaccatctcagtagctttcagaagccataccacagttgttgggtctgtgggttacatcggtctccttgatttattcagatgtcacatttgtcctcctgtccttcatcattcccttgttacttttgtgtaacatcctggagaataaggaagatggtttttcaggccactgtactcatgggttcaaacccctttagaggcataaaatgtattgtcagtggtgataattttaaacaaatggtctgactcccctcccaaccccaaccgctgccgctccattcatagttaatttagaatcttacaatacttaaatatttacatttaggcaaatatatagctcatgtgtatgtatgtctcgatatttagtgaattatttcatcatgttttaagttataagttgaatctttggaaaagactgcaaagtgtcctcaccctgttttagtcgactttggaggtggatgttccagggccttacatcaccttaaaagactaccagttggatttagacaaaccagagctaaaattgccacatcggggtttgttagctgtctgaccatgggcaagtcacttaagcttccaaagctttggttctccatttacaaattgttccacctcatggagctttatgaggataacaggagagagtaggtgaaggactcagcagtatgcagcacagggcaggtgctcaagggccatctgttcttcccttccctctcctgccttccacttcctcctgtcactgcctcacggtcccctagaagtaccctccttcaccctttctttttgacacaggatcttgctctgtcacccaggctggagtgcagtggtgtgatcagagctcactgcagcctcaccctcctaggctcagctgatcttcctgctcagcctcccaagtagcttggactacaggcgtgtaccaccatgcccagctaatttttatttttatttttcgtagagatggggtctcactatgtttcccaggctggtctcaaactcctgggctcaagcaatcctcccacctgggcctcccaaagtgctgggattacaggtgtgagccactgctcctgacccctcctccaccctaacctcagcgttcctcctctccactctcctcctgactcatgccctatgatttaccagtgcgctttttctgcctttactgggagggcagtttacagctcaattgttgtcaatagcatcctaccttaaatgttaaccaaatgttcaatgaataaatgcctgtacatgagtgaattagaggcaggcttatcatctccctactccaaagaagtcattactatttctctgacagcagtaactagcaacagctttgcaaaatcagaattgggggcacagtggtgaatggtagcccctgaagtgataatagagcatggtattttcaaccttgattattcctttgaagcattttgccatggcccactcacaaaatcctttccccagatttttttttttttccaagacagagtcttgctctgtcgcccaggctggagtgcaatggcgtgatcttggctcactgcaacctctgcctcctgggttcaagcaattctcctgcctcagcctcccgagtagctgggattgcaggcacctgccaccacgcccagctaattttttgtatttttagcagaggcagggtttcgccatgttggccaggctggtcttaaactcctgaattcaggtgatccgcccacctcagtctcccaaagtgctgggattacaggtgtgagccaccgtgccccgccctttccccagattctattgcttgttgtttgggaatgcagcaggacatagaggcgatgtcaagaaactgtttcatctcatcgaagctctattagaaaggcacttgcatgagaactattttgactactttgctccccactttccaaggaaagcatgaactgttgacttgcagatttagtggtccttggtttaggttgttggggatggactacaaggcagtgggggtggtgacctgaggaagtaaagctgcagatggaaagggagcaggaagacctttgctaactcctccaaatcacttatttgtagaggaactactctattttgcattaagtgttttgctgtgaatttttgagatagcagtcacacccatatttaaatgtaagaattagagtgttttccaaagacatacaggccaggtctcttccagctccaaaagctatgattttacaaacacaaatattgggataataggaaccattgtttccacttggaatgctcttcccgtggaaagcattcatctctttcttatacagacctttctatccttcaaggtctagctcagttctgtctaacttttgtaattctttgactctggaatttttggcagttagttagatatggcattgtatgttgaagtgtagttccttaaaccttttgtcatttaggtgttttcacgtgtttatgcctcggccacccactaggtctttactctttagggcaaggtgccacccatctcctgtacccctacagatggatgtagttcagtggttctcgacaggtgccttgtagcagcaggatcacctgggaactagttacaaatgcgctcatacccactgaagtagatagaaagtctggggccagagctcagcagtctgccctttgacaagccctgctcgtggctgtgctgtatgctgacttttgagaacctttagtgtagtgataagagcaggggactgagggtctaagagacctgggtttgaagccagcttcaccatttactctctgactttgggaaagtgaatttgtctgtcttctctccccttctaggggtattttatgaacatttatgatgcaggatgttaatgggtaccctaagggttggggtgggtgaggggctctgtggccaaataagttgatgaaatgctgctttggctaatttaaataggattcttttgggcaagacttttcagatgcctaaatatgtcattgaaagtctctgagagtctccgtggatgttgcaaacttgcgagaccctggaacacattttctgctgcattcctgctaacttttccgggaacacacagtgttttgtggaacacattttgggaaatgttggcttagctaatctaagggtgctttgagcctggagattttatgaccttgtaaatcagtgagacatttagaaacttcaaatacagatttagtcagacatggtgccagaatctataatttgggtaaaccaggcttatagagaccaagttcaacattgagatgatatggaagtaattaaacattagagagtaaagggttatatttttaaaagaagtgagtttttgttaggtagaaaatggcatattaggggcaaggtggggaagataaggaaaggaaaatgtcatttactgagcgttttggaggcctggcagaaaacatatggcacatttaaatcaggtaatttaaggcgattttaatgaaggaactatttataaggggtgtgggcagagctttggaaaagcatcggcaatgacgaaggacttgattcctctgtgtacctaaggttttacacgtatcacattgtcattgtcatagccccaaagctggtcttattatttcattccttgcagaagaggagtgaagcccaaagaggcaaagcaaaatgcccttagataggacctgaaatggaggaggcagaactccactctgccctgtccggcccccagcctgcacctcctggttcacatttctttaggctgagcctccttatttccttcagtccttctctatgtaatgaggctgaaaacattgctttgtagaagctcatatttggagctagatgcgttgcactgagcaatcagtagacaagagaaaatagcaccttaggcaaataaatacattaataataaaagagtgcaggttccataagtgggaaagaaagaaagatcataaacacaaattttcatgtctgggtgagttggggctgtggaaatctgtcatccattctttcctaggatccatccatcctagaaaatctttctggaggaagtgggaaccatgtaaaggacatgatgtggcagcttagcttgtaggggctgggaagagggagagggaaaatttttcagacaagggggcactgcttggggaaggcctagcagtgagagtggaaggcaagggtgctccttgcgtgggtaccttaacaaaatggcagtgtgggcggtttggagaaagggtcaccatgggatctgagggggctgctgaactaccagtttttatatctgggccgtgctgttccagtgaagtctctttagcctaacacctttgttagaagatggtaaagggctgggcacggtggctcacgcctataataccagcactttatgaggccgaggcgggtggatcagttgaggttgggagttcgcgaccagccagaacaatatggagaaaccacatctctactaaaaatacaaaattagctgggcctggtggtgcatgcctgtaatcccagctactcgggaggccgaggcaggagaatcgcttgaaccaaggaggcggaggttgtggtgagatgagatcatgccattgcactccagcctgggcaacaagagtgaaactctgcctcaaaaaaaaaaaaaaaaaaaaaaaaaaaagaagatggtaaaggttgaattttctaagaattgattttgcttcctttgggaagtttcagagtatatgaatgctcagtttctcttaagcccaaagataatttagaagtcatgtttctgtggaggtttctttccccattgtgagtttaaatttggggcggcttttaatgctcaattagaatacttcttatggttaagtactttctattccaaaaaacaaaaacacctctcaaatcctctgcacaagacctgcctttgaaaacatctggtaaaaataacaagtcacttggaaaactgtgattctcaaatggacccccgcctcttggttagtgggaagtcactggggtaaacctttatttcctgttgcttccacacagccggcccttcacggaaatatttcacatgtttcctcaggcagcagggaaccttgaagggcagacagagggctggggccccagataggaacacagttgctgtctttgctcaatagcgcctcagggtgtgtggagagccagcctctgcctttgaagctgggccggctccctgcccctaactgctgaaaaccccagctctccccaagccatgagcaaggcccaaacttgccacacctctggctctttttgcaagagagatgttttaaaatagtcttaaatgtcagacatattttttttcacaacatgcctcagacatctcataaattattctgcagtaaaactttaataggaatgcttagaaaatgaagagttctagtcaatggagtttttggtaacttatacaaccgttaaccccaaatcaccctactttttctaccccagaactcattgaagaaaataatttaaaaatagagatgatttttctgaacccatgttagaggctgtctttgatgactgaggtcttatgtttcttcataatgccatatgttagtttgaacaacgtgatattccaatatttgactattttttactttaaaaagttaatttgagatggttcagtctgataatatgtaggaagtataggagttggagttcagtgttttctgaccagaatacaccgataaagttgattattttttcttagaaaaaaaaaaaaaaaagaaatctgcgatatccacctttcttgccatttgcttccttctcttgaatatgggtaattaaagattctggttgcagaatttgcatggttgctcaagctgtgtctgctgtcacattggctccacattggggctcttacaaatatgtgtcacatctatagctgtagatctaacgagctctctttcgtgtgcacatgcttctgtacatgagcctgtgagccctccttccttttgtggtttttcagtgttgtggcttagatttatttctatttataatgcttactgtcttgatttattcagttactagttcctgaaaagttggaatttgggaagttttttctttttctttttttttttttggagatggagtcttgctctgtcgccaggctggagtacagtggcgtgatcttggctcactgcaacctccacctcccgggttcaagtgattctcctgccccagcctcctgagtagctgggattacaggcgcctgccactacagccagctaattttttgtatttttagtagagacggggtttcaccatgttggccaggctggtctcgaactcctgacgtcgtgattagcccacctcggcctcccagtgtgctgggattacaggcgtgagccgctgtgcccggccagaatttttttttttttcgagtcttgcactgttgcccaggctggagtgcagtagcgtgatcttggctcactgcaacctccgcctctcgtgtttaagcgattctcctgcctcagcctcccaagtagctgggattacaggcacccaccagcatgtccagctaatttttttgtatttttagtagatatggggtttcactatgttcgtcaggctgatctcaaactcctgacctcgtgatccgcctgcctcggcctcccaaagtgctgggattacaggcgtgagccaccacgcccagcccagaatttttaattattgggacagagatagataatttgagctggggctgtcctaacaagtctggaatatgtgctacatcacagaatcatgatcatcaatgcccaaagtggtgctgcatagatgcctttttgcccataggaagattcaatgatatttagatgctagcatacttcgtttcatgatatttctcattctttaaaaattggacttgctaatttaccagtatatttcattatctagaacattccattaactctatatttggcaagtgtttgaattgagaagaaatttcaaaagtgagggtatatttcctagtatctttttttttttttttttttgagatggaatctcactctgtcgcccaggctggagtgcagttgcgtgatctcagttcactgcaagctctgcctcccgggttcacgccattctcctgcctcagcttcccgagtagctgggactacaggcactcgccaccacatccggctaattttttgtatttttagtagagacggggtttcaccgtgttagccaggatggtctcgatctcctgacctcgtgatccgccctcctcggcctcccacagtgctaggattataggcatgagccaccacgcctggcctcttttgcctttttatgtgaaatcaaagcaacaaaattgtctcttgcccctttacttcatccaaggcaccgtgttaaaattcagaaggtgtatttgcagtgactaaagaattttgcttctctttaaatgtgacactagcatgacgttctccttaccatttggtctgtaggaaggcaaagctagctatctgtgacttgactcaggacagcatcctttgggggaaacggtgctgtgttgaaaggtagagcccttgtttcattcctgtccaggtcccaagctcactctgactttgtgggtagatctgagtttgtgggtagactttttccttttccacctggactgcttcctcttctatacagtgaagatgtcaaactagatcatttctaaggtctttcacaacacagtaaacccaacagtgttttttattgactactttccacttcacagggtcctgagatagttccaactgttaagagagcatttcacacctgggtgttttcagaggtccctcatagataagtaaaccaagaaaacatgtttgttggccattctgcaagagcagagagaatgccagagtgtgcagagtattcagcccttccttcagagagttatgcgtggcttggagaagaataaatgatacgggacctgtcacatgtgtgggacaaagagtgggctagacagcgagcaccctgagtgacagctgttgtttatcaaacacttgcaccatccccgactctgccaggtgcttttaattgctttacctataatatcctaatcaagccttgtagtaaccacatgagaggagtgccctgtttaccctgttttacagatgaagacaccaagataatttgcccaagtttccatagccagtaagtggtggagctggtacctgaatttgagccttttttttttttctttttttttttttaagacagagtctcgctctgtctcccaggctggagtgcagtggcgccatctctgctcacttcatcctccgcttcccgggttcgagtgattcccattcctcagtttcccaagtagctgagattacaggcacgtgccaccttgcctggctaatttttgtatttttagtagaggtggggttttgccatgttggccaggcttgtcttgacctctagtgatcctcccacctcggcctcccaaagtgctgggattacaggcgtgatccactgcccctgcctgagcctacattcttaattgccttgcctctaagaaaaaagatgaaggcacagacagagagaagaaacaggactctcttgttaaaggaaagcatggaattgccaggggttaacaatggcaggagaacgggacatttgtgaccatgggctacttaggtggacccatttcctgatggttctctcaccttggttacctgtcactgccttgtgggccctgggggacactgcctctctattaagactctggctcaagcttggccagaaaaacctcctgccacccctcctccagcactctgccagtgctaaaaagagccttgtgtttactggaacttgggatatcttttccacttgagttgaccagagccaagtcaaggtagtaaacagctggactgaaacagccatttgggattggagggtgaccccaatagtataactatacaaaggctttaaaaatccctttccaaattttccaaaacttggttttactttaaactggtattttccttttaatgcctccatttgcagaaccaaaaattctcagttttggaatttgtgctgtgaaagggtcagagtgaacaatgtgaagcatcctcattagctctgtttatttcttggatggaagggatcacttgtatctgctcatggggctcaggacaaacttctgttcactgtcactctctcagcagccatcatcagtgggacactggccaggcatcacatggcttaaaaaaaaaatcagtgtcttgcttttaagcaccctctgtgcgttggattataagaccactgcctccttgaggggcagtgatgatattcatctccatagcctggcactgagcacagcatgtggtaccaaggagacactccatgagcacttggcatatttgttgagcacattcttttaatcaccatgcaaacaaatgcaatggaaagatgtttttaaaatgaggtgagtacaaggaagggaaatgcattgcaaggcacagctttgtagtatgaggcatgatagttcttaagagccctgggatttagggtgggatagattgggttatacatcacaattccaccacttaatggtagggtgaccctagagaagacactggatcattgcctcctttctaaattggtaacagtgcctacatgataaggctactaggattaaatgagatattgtatgtaatgtgctaagcatgaggggaggctcttgatgataacaatagggttttttttccctagcaataaatacatcaaatttagctgcccttcaaaagaagtgggaaggagaacttgtgtatatgccccctccctgaccaaagaaaaaaagtttgcatgttgcacagtggtataatactgaatgttttgcaattacctggatcagaggcaagttcagcaggatatgagtggtcgttgtggaaatgtagttcaacagatttctgaagtctggaaaactctttatatagaaaacatgcagaattagaaccatatttcaaagcttttatagcaagaagaaaaatacttatgagacaatactatacatatactgtgaacgtaaccagataatataaagaaagattacagggaaattcagcaaataatgagattgtgttagggtggtgacattatagatctttttatttcattttcagatgtttagttgtgtgcttatatttcttttgtagtttaaaaaacgctttcaaaaataaaacctattcaaaaaaagcttcactcttgaaatgagttgaaaaagagtcttcttacaaaaagtttgatacttgaatggctgcctttgaattttttagttttaattgcttttccaattgttttctttaagaaactttttctgttgctgaataatcataaagactatacttagtgaaaacacatcgagaagttggaatttaagagtttgatgcaaaatggaaattttcctttgaaaataatgtgataggataaagtattaatggactattagagatcaaagcctgtctaattaaaaagtaaacacttgctctttagatggcatcacagatgtgtcaaatatatccattttttaagttatagtcattttatggattatgatatgaaatagtcttaaaggtagggtgcatttcaattctttgctttcctaaacatccaggcttagaaatatttaagttaatggatgagcatagtcctagtaaacttctcactcggaaaccctgtgccagactgtgtgcagatggggcagcagtcatgactggcaggcccagcaagtggaatcacatttgcacattgttttattcactgtgaacatttttgcaggaaaaaaaggaaaaactgtctccctgcttaatgcaattctgacgcgatcagtacaaattataaattacatttaaagtgatggtacaaattagtgaacatttccagctttgtgtgacagtttggggttgagcatcagcgtttaatacttggtgttgccgtcacttggttgtattgaccaacatttctcaaagtatagccctaaatgacatctgccagaaatgcaaattccagggcccccttggaacttcagaatcagcatatctggctgcagaacttgtaatccgcattttaaataagtgcctccccaggtgatccatgtaaagcagttttgttgaggccctctagtacatacagtgggaacgtttgcaaagattatttgttatctcaatttaagatacttatttttaaatccagagaatacaaatgtataatgaaagtttgagagcaaagctgactgattttgggtccatatttttacttatgagtgagatttgagacttcaaggcactgtgggtagtgtcttcaatttgtgcaataaaattaattttcaaagtacaagttagaaatttagttgaagggcacatgtgagaataattttaaaatgctcttgctgtttttccgaattctccaactcatcagagttgacttagaacagcattgcaagtagtcatttaaaatactttctcaatatcaataagaaaacttgcatttgagaaaatctctgattattaaatcatttgtgaattcataaaacagtaaatttggagaaaaagggacgaagacagagacccaatgttatatcaaggattataactaatatttagttcaataattatcattgggggtaaaagtaaagataatattcattcagttatctgcaaaagagatgatgatggttttattagggtcttccaaccacatacttacatgaagcagcatttttggcctttaaagtaaagaaatcaaagccaaaaaggggtcagtttgtttctggctgtactctgtataaagttattaattttttttttttttttttttgagacagggtcttgctctgtctcccaggctggagtgcagtggtggaatcacagctcactgcagcctcgacgtcctgggctcaagcgatcctcccactttagcctcctgagtaggtaggactacaggcacacaccaccacgcccgactaattattgtattttttgtagagttggggtttcaccatgttgcccaggctggtcgcaaactcctgagctcaagtggttcacccgcttcgtcctcccaaagtgctgggattataggtatgagccaccacgactggcctaaagatatttttaagggactgacaattgggattagagagaagcaatcactttgaatatcttaaaacttctttgagtttaaaagtgatctcacataatgtatctgtgcttaaatataatttcttaatgtcacttgtgtagacttcagtgatagaagaaataagatttaaataaaactttaaccctctgtttagtgaataaatttatatgtatatttttatctttataattttaatgattcttgtaacgaattggtgtttctttttcccctgctgaaacaatgtttgggctgggacacattggtctccttttcatcccctctgttttgcttgtctttggggactcctcacccctgtgtctcattctcctccatctcctgtccctccttggcagcaatggggtcaaggagactgaatgtggacctgacacatcctacagagaaaccacactttgtttccaggcaggatcagaagtacttgactaggcagcattttggttttgcagttccgaggcaaccccaacgctgcaaaggcatcttcacattggaagaggcacactcgaaggatgatttccttatcttcctggcagttgcctgaaatctcccttctagcactgtgatctatgagctctcacgcactcaatttattttctttgctaggaattgctagagccatggctgggtcaccctttgctttcctggcagctggcttcactctgaacttaatgaggttgcagagctgaggggccacggaagggtttcccccgttgaaaggactctgctgcttgtccctattaaaagagtaaatgctgactgctgggtgactccaaggaagggcttttccagccagtttccatgtggtcagtgtctagggcacattccggagcccgcctgctcctccttttcttctctttggactttagtgtaaccagcagtgaacaaggaatgtattttaaatgacatgtagatgtaacttttggagtcgctgggattttctgtccctatccactggtccatttatcaaagtctgttggcaaacttgtgtagccatcccggatttcatgctacctaaggcctccctgcacctgattctctgcatttgagcttgctggttagttgttagagctgcgatattagcagaggggaatttgaaatgcttcattaccattctgagagttcaagtgttttttatttctgtttttagtaagtgcttaaaacacatattttagtttttttcccttacaatctagtgtataaaaatcttttaaacttaggcttcacattcttacagaagaaaaagcttatttatttttgtacttttattattaaacagataggaaaaaagtctacaattacatgcttcttaagctggatttcctccagaagtgtaatatattcaccaaactccacaaataccagagctccctttaagcatattgggaaccaacccaagagttctaaagttacgtttttcctgaaggatttttgttgcatacttggaaaaaaaaaaaaaaggtgcaggggaggtgaggtggggattcttgtatgggacctttatcctttcccccatctctatagtcttcttaacatgccctctgtcagactttttgatggtttgctctctagatattcaagatataaatttaaacagtgagatccactattcaatgccccacatttagttcacatttagtgaacttttactgaatgaatgagctcagaagcaccaaaggacatttgtttgtggacttgctttaagttaaggattttttttctttttctttctttttttttttttttttaggagaaagctgacctgagcaaggtggtgcatgcctgtagtctcagctacttgggaggctgtggcaggaggatcacttgaggccaggagttcaaggctaacctgggcaacataacaaagcccttttctctagatagctagatagcaatttatgcgccaactcagtacttgtatatatgactttagttttagagacacttggacctatataaatgttaagaaaccttagattttaattctcaactgctggcttttcctttttaagagaggaagggaatgccacaatgaaattttaaaagcaatttagaaatatttgagtgccctcgtgaatgaacaaacatcatacaagcacacatagatgactgtcttcagggagtgtaacatctagaaagcagagcaggactacagacatagtaattgtaacatctcctgctgacatggcttgccccttgtcctgttggaagggcttggcaggatgagagttatttgttttagggaggacgtgtacctggacattgcattttctcatctcagtgtattgatcaggactgtaaagcccatgacatttggaaactgtgtttttttccagccctgaaatgcttttttttcttttttggtagggatattttattcttttatagacttaggggtacaagtacagttgtattacatggatatattacatagtggtgaagtctctagccttgaaattctatgatgctctgagtcctttggcctcatgaaacattcttaaagatgatattgccttgtttttgttcttgtttttttgagattgaactcaattactggcctgtttagcagacagccaagggcactgctgtcctgtcgcctgtaaagttctgcacaaatgcagggtgctggatggagtcactacaagctttgtgttgagttttctctgcccaaggcaaaagccttcattcctggcaatgcccttgtctccatgcagggtccagtacattgttgttaaagtaaaacagtgactaactagagccttttattaaccaggattccacttctgactcttctcacacttcatttttggagttagaacaggataaataaacaaattatgtcaataggtgaccatttactgagttcttcctgtgtgtcaagcactgtgctatgtgggtaaatggttatctcgattaatcctcacaacagggaggttagtgctgcttttattcccgttttgcatgtagggaagctgtacagtggtagcgtcactgcctgagcacctagaattctttgctaacagggttgtgtgtgaataatttaattcgtctcttaagatctcaacacactccctccctggcccctgctgtaaacatcctacactgattggaatagaatacatagttcttttcttccaacatggtgtgttctattgatacaagttgtgaattgtggcgacaaggccattttgtattgagaaccattctctttaacatttgttagtttggaaatgctaaacatccctaactctgtcaccttttattccattgtagtggttgatatcgtagtgtctttatttagttataataagcgtctttgagttctaaaggatttttcgacaccttttattttctgataattttatcttgtcatccaccaaggcaattgggcagaaaaaaagcttcactgtggacaaaagtggcaaaatgtgatttagggagtgtactcagaaaatcagattctctctcagcagtagtttttgctacccataagcaagagaatacaaatgtagaaactgtcacctatgattgctgccagcaaggcttctatggagttttcacagccaaatgagcagaacaagtttgctgggagctcctctcctgggcagagagggtatatatggttgaggcgtatttctttttttttttttggtcttataaaaagcactgggcaccactgcccctcttgtggcccaacccgctcacaggcagtcagcctgcatgctctctctgccccagggccccacctctacagtgcattctgcctgcttcagctggatcaatcactgtcttaacttgtttcttgctgcataacagaataccacagactgggtaatttatgaagagtagaagtttgtttggctcgcagttctggaggctgggaagtcctagattatggaggggtcgcatctggtgagggccctcttgctgcatcataacatggtggactcatccttttatgaggagcccactctggcagtaactaacccactctcttgataatgacagtaatctattcatgagggcagaggctttatgagctaatcacctcttaaaggtctacctcttaatattatcacaatggcaactagatttcaacatgagccctggaggagaccttcaaacctttgcaatcttgaatttgaaaacttctcttctgcagaactctccttggtttcatggcccaacagaatgtcattgcctggtattcaaggccattttgtggtctgtgtacaccatctacataatgttatttccatatactctgcaatacaaaccctttgcattaactgaattggacttgggtctattctgtgtgtgttctgtgctatgttctaaacattacctatgtgagaattgctttggaaactctagacactttgtgaggaaaacagtttgttaaaagcagaagacatggtagacaagtttttgtttgtttgttttgagacagggtctcattctgctacccatgctggagtgcaatggtagaatcatggctcactgcagcctcgaccacccaggctcaaaatcagtccccctgcgtcagcctcctgagtagctgggattacacgcatacggcaccatgcctggctaatttttatacttttgtagagatggggtttcaacgtgttgcttaggctggtctcaaactcctgggctcaagcgatccacccacctcgatctcccaaagtgctgggattacaggcatgagctgccacacgcaatgtggaagacgggttctgtatatcctggaggaagtggtaaagttaaaaaaaaagttttacatgtaaatgaagtgatacctagccagtaacatccatgagtattaactgtggggagaaagaggagactagttactttacttcttatggaaagttatgagaagattgtgctcttggggaaagaccggacatgtcacctcatgagggagagaaaggtgctgtaagctcttcaaaggagcactgaccgagactgttcttttaattagcttgaaaagactcacctctctatggtgggaatagaacatctgctgctactcagagaaaccacgtgaggagaaagtggttctgacccccgccccagatgctattgatgatgaggatcatgctgaaagcagctaaaatttattaagcattttccaacgttgtaataggcactggatgtactgaatcttatttaatcttcaccataatgctatgagattgatggctgttattattcccattttatagatgaggaaactgaggcttagcaaggttaactgactaaccacagaagacacatctagtaagcgtcagaacagcaactcaaatccaagttatactaagtctaggtatgttggtgggtgttgttgcttcctaaagtctgttagaaaattctgtaggtgatcttattcccttttaacttcccctaatgaagattttctataaagaaattgatatcatgagaactatgggctatttggtgcttttgtcagcatgtgcctgggtgtttcccaggtaagttgtgaagcttggcattctcttagctggaagattcctgcagtagagggcagtccatggatactcttccatgctgtttgtagtggctcatcagggtttcaagggttagccttatctctccaattagaatataaagtctctgagggcaagcaccatctcttatcttgattgataacttcaataattttattgccacagctggatgaaaaagcacccaaagaggatccgtttgtctttgttttaggtctgtatattctccaagcaacctttgtacacaagagcatcttgctgcaggcagggactgttttgtgtctccttggctgggttcatgtggcaaagtggaaggagcctgggttgaggagccggagccaggacctgtattccagccttcccgcttgcttctgcaagacttttcaatgagccttctaacttttactgaagctcagtttctccattggcagaataggtgtagaaaccttactaggtgttctgaggattaaaaatgacatgatgtgtcaagtggctggttcacagtgagcatttaggaaatgaagagatggttctcctctgcttctgtagtgtgagcacagggccttgcacagaatgcatacacaatcagtgtgttttgataataatggtttggttctttggcacctgaacctaaggagggagcaactgtgaaggcttttaaaacatgatgcttttttatcaagaatgtccttcattgccagacttggcataggaaggcagacctggaaactgactgtttggttcttgaatcctgcttcagttcataaaacctgatgtttggtacaggtaagtattggtaatatcaacctcataatcagatatacaatgatcacattcattagtctgttaataaacaaaggataacaaagaatagacccaatacctttgctagaatacttttccttttataacacaacaatttacagtgtttcatatatacagttatctgtcagtatgctatagagattggtccaggaccccacgtatacccaaatctgagcagacttatgtcctgcagcgggccctgcagtactcacatataggaaaagttggccatccacatacgcagcttccacatcctacaaatgctatatttttgatccaagtttggttgaaaaaaatctacatataagtggaccctcacagctcaaatgtgtgttgttcaagggtcaactgtattttaaaatttaatcttaagaacaacttaatgggctgggcacggtggctcatgcctgtgatcccagcactttgggaggccgaggcgggtggatcacctgaggtcaggagttcgagaccagcctggccaacatggtgaaaccctgtctctactaaaaatacaaaaactagccaggcgtggtggcatgcacctgtaatcccagctactagggaggctgaggtagctgaattgcttgaacgtgggaggcggaggttgcagtgagccaagatcgtgccattatactccagcctgggcaacagagcaagactccatctcaaaaacaaaacaaaacaaaacaaaaaacaattaatgtaagtaggttttttgcttttgtttttgtttttttgagacagagtcttactctgtcacctaggctggactgcagtagcacaatcttggttcactgcaacctctgcctcccagattcaagagattctcatgcctcagcctcccaagtagctgggactacaggcatgcaccacaacacccggctaatttttgtatttttagtagagacagggtttcaccatgttgtccaggctggtctcaaacacctgacctcaagtaatccgcctgccttggcctctcatagtgctgggattataggtgtgagccaccatgcccggactaaagtagtatttttaatttccttttatggatgagtaaaccgaggctgacaaattaagggacttctcaatttgcacagccctgccaaagtttggattcaaattgagttcttcttacccggctttttgttgctttcctgcagccaccaggcacatatacaactcaagtcagaagtgtgtgccagatgccaactgagccagagtccttgtaagcctataatataggcaaattgtgtgtgtgtgtgtttatatgtgtgtttgtgtaaatataaacacagagagactaatttttatatattaatatataaatgtataatgccaacctatttctaggtagtctggaagacaatatagatttaaaaaaatactttcattgaatttttgctgtgagcttgatattatgttgaatgttttagtggttttatcttggtttgaagaaaactcattacagaaatttgtattgtaatttcagtggttggatgttgtgcttttatacctgatatattcaaaaattgcctaaaattagggtaaaaataaacaaggatagataaaagtagctaatgtgatatgttcactggatgagtgatgggagccaaggtcttgcatttattacagtgaggtgctaatgatctgatttggtccatggcctcagagcctgtgctcagggcttattgattttgggcctgtatatatgtgttccacctcagttgttaaacaaatgccaccgagaagagaggttttctcagaaaagatggtgtttgcagtgttttatattacctttttggtaggttagtatatattcagttacaagttcaaaacttcttaaggaaaataagcaattcctgaacaagccagtattatgaactgaagtatttaagttatgtgtttgctaaagacccaaagtctttttactgaatggagcctctgttccctcattcctgagcatggtatgggtctgtactgcagatgtctgtataatatatgatgtggtaaatacatagcctcagggattttgtggtttaaaaggaaagttgagagggaactgtggactgtctgtaagagcagagacctctcctgccatatcaaacccaccctgctttcccattttcaagctctaacagactgcttttcagctttttaacattttttttcccagccatacacagtacttcttcatctcgtttacctatattgtggactatggccctaccttgattctcctgagaatccaaaatgctttcattcatggcctctcactggtagacattgtatagcgactgcttcagaagaaaaatggctctgtgtcctgggcttgtgtttattattttgaggttatatatttatgatttaaacagagttaagatgtcttgcttttatctcatgaatttcggaatctgccctattttgagttatctggattgtctaaggagaaggctccaaatgtgctgaatgccacaattagacagctttgttttggttctgtagacacaaccatatttgggaaacacgaataggctagtttttgcatttaagacttgtcttggttaactgcgtattttagaaactgtgtgtgcccagagttttacatataaaggatttgagaaggagttcagggctctggaatgccatgaagctgggttagaagcagggacttggcagtgagcaggcactgggagcaatgggggtagtttgtgtgttgtcacctggcagctcctgctgactattttaagatgaaatgttttggtgcgattgcttctttaggaaatctggctgaacagtcgagtccgtttattgcccccttcatcctcctgaggaacttcatgggagtagtttggctttcattaaacaaaagcagtcactgatggtgaatgttagaatcccacaagttccgtggaagatggcatcaggtggctctgccatgttctaatggacatgactgtcagtggcatttttagcttgtctcctagaattttttctttcaggttctaaatattacacaattgcatatcaaatgtcacgtaggagctaaaaaggatatttgtcattagcaaagaaatgtattataagcacattataaacagtttagaaaatagaaaaaagaagttacccataattctatgctaccacaatcactattagaatttggatatattttctttttactatatacatgcgttttgcctattatataattataaccacagagccgggcacagtggctcatgcttgtaatcccagcactttgggaggctgaggcaggcagatcacttgaggtcaagagtttgagactagcctggccaacatggtgaaaccctgtctctactaaaaatacaaaaattagccaggcgtggtggtgtgtgcgtgtagtcctagctactcaggaggctgaggcaggaggatcgcttgaacccaggaggcagaggttgcagtgagcagagatcgtgccactgcactccgcctaggcaacagagtgagactccatctcaaaaaaaaaaaaaattgtaatcacaaatgtcacacagacttataccctgctgtagtcacctaatcttacgagaagtcttttcccatgttgtatggtctatgttagttattctcataactgttcaacagtccccacagtgggtatgtggtcaggtaattagcccctgtgttattgaacaccagaggatttcaaggctttcactattactaataaagctatggtaaacatctctgtatgtatagcattattgtcattcaagcttctttctttagactagattctcctaaagcacagggatacgaggtgcatagctcttggtgtgtattgctgaagataatgataaaaatgtagtgtcattggctgtgtaggaaaaagccaatgtctttgcatttgcccacattgttagttttaaaaaatttttggactaatataagaagtagaaaaaatggttagtcattattttaatatattttttaactagttgggttaagtaaacgttttctcatagatttgtttattatttgcattttgtcttctgggaatcatttcttcacgtatctaaaaatatttttcttggcaattagtatgattacattagattaaggatattaacccgtctatcttgtttgctgcaagccatgcattttaatatgttagacaatgtaatatataattacaaattatcccctaaattctgttgtttgaagcacaaataatactgcatttataagacttgaaactgtttggggggctgaatttgcttattgggttggaagtcaacattttatatttatttaaaagctccactcaagtataaaaggtaaaaaaaaaaatgattgcagatttattggtggtgaatgttctagctccagatctgccccttctctggcatggacctggaacgagagtttgatattggtagtggagtttgggcatgggctttctgaatattgtgatcataaataggtcttattaaaatgagttcttggctgggtgtggtggctcacgcctgtaaatcccagcactttgggaggccgaggcgggtggatcacttgaggtcaggagttcaagaccagcctggccaacatggtgaaaccccatctttactaaaaatacaaaaagtagtcaaggtggcacgtgcttataatcccagctacttaggagactgaggcacgagaatcacttgaacccagggggtggaggttgcagtgaaccgagattgtgccactgcactccagcctggatgagggggcaagactctgtctccaaaataaaagagttcttcatcttcatgacttttaatagggatcaaaaccaaaactatttctagccagtgtaactacagaaaataaaataaaataaaaagtagatgaaaataaaaacctttagtttttgttgggccaatgcatctggctattgggattggccttaaatttggggagatgagggaaagggcattagtgggaagcaacaaggttaaaggcttagaaatgggaactcttgtcagaattcagtaggaatagcaagtgtggtacatgtggagtttagggctcatgggaggatgtgagggagatgagactggaaaaataactgggacatgatcctgcagggtcttatggcacattaaattaggacttgaatttttagatcagtgtttccaaaagtgtgacatttgaggtgattttagaaggtatgtcattgaacattggaaaattttggtatttattcattccttattctctctgtcatgcagaatttattccttttccttttgtgctcccatgacacttaagccagattgctagcagaagggttatcccattgtactatatttaaatggaccacatctgccaccctacagccctgtgttggcctcaaagacagcaatcctgtctgatcatgttggtctcccctgggccaagcactttcctgggtgcaaagtaggtactaaagaaatgtttttgagctgtatcatcaggcctgtgttttagatataatattctttccggaagccttgctgcctttcccttgcctgccatactgcccagccaacccctctgagtgtataggagccctgcggagtttttttccccattgaaatttgacccaggttgaattgaaagttggggagtgcataggtgggtgccagcacagtggctggagggggctcatggaacctccttccaacacagctggaaaaccaggaaaatgggctgggtaacctatatagatgcttctggttctaaagaagtgagcatgtagttggaacagaataaagaccagctgagggccctctggctccctaaactcctgaagaactgcagaggccctgttctagaaggatcctcatggcccagtgtaaatcagtttacagtgacacttagaaatcaagaccagaaagtgtggggaggaggaaggagttaactgtcttaaatgcagtggaaagatcagtgaagcctggaccagtgcagaaaccgttggacttggccatgcgtgtgcactggaagtctttctgaaggccatttcagataattggttagaacggaaactgagttggagggactccaggaggaaatgagaggatgtggaggatggcctttctgatgtgttttcctattgctccctctccagaaacattggtctttttacagaaacttcgtgcttgttgtgttctgagctcccaggagtgtcatgggattctagactgaagttaatgtcagggtcaagtttatcccactttcttccccttgaacggaagtatcagcgactcagtgtttatcctttctggctttctgaagagccttctgcaccctttgcaataatgtagagggtgcatttgaagagaagtgacattaatagagattgagaagagaaggagctgttgaaaaattggagaaacgtggctctgctagtggatctgcaaagtacaaagaaataaggccaggcatttattctggggctctgtgcgctgtctctattcttttcaagctgttggaagtagctgtacgtatataaaatcaagtcccagattagattttttttttttttttaaatacagggtctcactctgttacccaggctagagtgcagtgagcaatcttggctcactgcaacctctgaggcctcctgggtccaagtgaccctcccacctcagcctccagagtagctgggactacaggcgtgcaccaccacacccagctaatttttgtatttttggtggagacagggcatccccatgttacctaggctggtcttgaactccagactcaagcagtctgcctgcctcagcctcccaagtgctgggattgcaggtacgagccatggcacccagtaccagactgggtttttttgtttttttttgtttgtttgtttttgtttttgagacagaggcttgttctgtcacccaggttggagtgcagtggtgcgagctcagctcactgcaacctccgcctcccgagttcaagtgattctcctgcctctgcctccagagcagctggaactacaggcgtccaccaccatgcccggctaatttttgtatttttagtagagatggggtttcaccatgttgtccaggctggtcttgaactcctgacctcaagcaccggcctcccaaggtgctgggattctaggtgtgagtcattgagcccggcccaagattagattttaaagctaaggcataaccagcattttgttcaagtggggagctggctcccttttaaggagccatggtggagttaaggaggctcttgattatcttgaaggtaagactctgaagttaggttccgaaggttaaacagaggcgagagcaaaggccgtgactgagcacctactgcatgtccagtgctgaggatgatgcagttttcctttccagatatttacaatctattgttggggatgggggagctatggaggcaaaacaccatagtgcataggagaagctggagcatgctggctaggagatttaaaggctgtttgttttccaagaacctttgcaggaccttgaattcatttttacagacatgctcaatttcttcctagtcatatatccctaaactacccatataaggaccttctttcctttcccagtaaccaacccatatttagttgattgtttttcagctggaagcatgagtataactttggctttttagtaattaatcactttgtgtcatcaaaacttatcttagaattatagggtcatggaattggcggggtaggggggacaatatggaatgattaattatctggatgctttcttaacaactctggccacttcacatcttgttcttctcgtggaatgtctgtgttgatgccatggtactttgaccaagtacggcaggtccaagcagctcaaagcgtggaatggcggtttgactccccgctggcacacccaagctgtgacactgcataggttcctgcaactcactaggggaatttactgcccacttgcagttgtgtcattttgccactagatggtacactgttggtccttttggcttttacccaaaggtgcctggctcatttggaggggacttgtaagaggcattccaaagacgtgccatcatgtactcaaccaaatcaggctctttacagcttagtttttaaataaatattaagtgttagaggtttttatgtaaaataaactctcaagttctcatctgattgtaatggcccatattatctctaaataaacagcagggactagactatgattttcaaagctttcagtgttccggtcaagctcaatttgtgtagtttcatggatgcgtcctcactgcccaggctctgagcacttaaggttgtagagacacaaccactgccgagccacttgggattcagatctggtcagcctcatgtcaggagagaggaatgaagattctcctcttcagatgaaaccttggggacttctccctcccatcttctgctggtcaaggttcttgggtggcagataaccagaaaccacctctggtgaactcaaactgaagagggatttattggcaagatcttgggtagttcacggagtttatggaaggttggagaactgcactcagaactggggcaggaattccaggaggctgagctggctgggatcagagccagaatcaggccctggaatagtctggataggacgttgctgctgttgccacaacaggggaggactggatgcagggcactgtccttggcactgctgccgttgctgcagttccttttcttcagtcagcccattcatcctcagcacttttaattttattttaaactatcccttgtttgttagtatcacctgctgcagatttaatcaccagagtgagaacacacaacagaacctgctactcaaaaagtcctcgtgtgcaagagctggtactcacctgtgcattgtcattgtcacgtactatcgtcatactagctcttaaaatatcaaagtagtctcttaacacccagggtccattctccttctaccctctcagcatccagccattaaatggttaatagcaggcacagggaggggcctcccagagagtgctacaactggtgtctgctccagttggtagacatttgtggcaaaatgatggttaaatattttgaagattatccctgactgtgtctattttaggttagtttgtaagtaagggggctgacacttagaagttagtagtttctatattgagaaatgtgaaatgtgcaaagggctacccgcatatgacggtgattacttatcatgtatgagttgaggtatcctttttgtttggttcacaagacatctccattcatttcttctccagcctaagaatgctgtgtgctttgtacttgttttttaaattaagacgaattaaactatacaaagggaattggtaaatggattatggagtgttattacaatgaaatacagccattaaaatgatggatatgctgactatatagaatcccagaaaaatgttcatgaaatacttgatttaaaaattagaacacaaagctgtccagatattatgtttacaataatgtacttgctatttatgtatctaaaggctagaaaaaacttataaaagaatgaaaatagtttcagttaagatagcttcacagtggaaacaaaaagatttcttcaataatgctttaaaaattgaggaaaggccaggtgcagtagctcacacctataatccctgcactttcagagactgaggcaggaggatcgcttgaggccaggagttgaggccagcctgggcaatagagagaccccatctccacaaaataaaaattttaaaaattagccaggtgtggtggtgcatgactggtcccagctacttgggaggctgaggtgggaggatcgcttgagcccaggaggttgaggctgcagtgagccgtgatcacaccagtgcactcaagcctgggtgatagtgcaagaccctgtctcaaaaacaaaaacaaaaataaaaataaaaataaggaataaaaaccttaatacaattgctcatgaaaattatttataaaataaaagcatttggatgctatcacaacaacacttttgatcctgggaggcaaactaaggtatcaaaaacttaggactggaaaacatgaggacatacagataacagcaggttgtgtgtttctcgattgaaagaacaaatgtttccacagcttagagaaccatctgtggggacagctattgaaggtcatagatagtctcagatgtatttgacagtgacagaggcaaagttcctgctgatttgggctgcagagatggactttgaatgatttcctcttcatccctagcattctactctcttaattacaaggacagtaaggcaaagcaaccatccagaaaggaaaccagtgtccaacttcagcttttttaaaagaaaaagctaaagcatgtctccttttgcagaccttcataccatatcttcatatccctattacagaattcgtgaaccggggtttttctctgtatcattgcttctcacaccttaaaatgcaaagggagcacctgggattttgttaaaatgcccattctgattcagtaggtacaggagtctgagcttctgcattttctttccttttattttttggagttggagtctcgctctgtcacccaggctggagtgcagtggcacacacgaacttggctcactgcaacttctgcctcccaggttcaagcaattctcctgcctcagcctcccgagtagctaggattacaggcacccaccaccacacccggctgctttttgtattttagtagagacagggtttcaccatgttggccagggtggtctcaaactcctgacctcaggtgatccgcccatcttggccttccaaagtgctggaattacaggtgtgactcaccacacccggccgcttctacgttttcagtaagctcccagctaatgtgaatgctgctggcctgtggaccacacttgaaatatcaaggttctacatatcccgaggacttgtttttcagattgtgtgaccttcagatgtgttcagtaagaccttattagtcgaggtatgtacaagacttgtactttgaaaaaactataaaacattaccaagagaaattaaagaagtcctggaaaaagggagagataggtcatactcatgaactggaagactcaatattgttaaaaatgttagttttccacagattgatctatagattcaacatgattccagtcaaaatctcaacagacttttttaggtagaaattgttaaggtggttttaaactttatatgaaaatgcaaaggatctaaaatagccaaaatgattttggaaaaaaactcaagttggaagactcactgtattaggccattcttgcacagctataaagaaataccagagactgggtcatttataaagaaaaggggtttaattggctcacagttctgtaagctaactgtacaggaagcatctgcttggcttctggggagcctcaggaagcttcccatcatggtggaaggcgaagggggagcaggcgtgtcacacgacaagagcataagtaagggtgcggggggggggtgccacatacttttaaatgaccaggtcttgtgagaactcgctattgcagagatagcaccaggccatgagatatccacccccatgatccaaacacctcccaccacgcccacctccaacatcggggattgcattttaatgtgagatttgggcagggacaaatatctaaactctatcactcatattacctgatttcaaggctatgtaaaactacagtaatcaagacagtgagttatcagataaagacagctcactgaaacagaaaagagtccagaaattgacccagccatatctaaccagttgcttttcagaagtgttatgctaaacgagagaagccagacacaaaggattacctgtactatgataccatttatataaaatcctggaaaaggtaaaacaatagtaacagaaagcagatcagtcgttaacagggacctgagatggtacttggctgtagagatacacatgggaactttttggggtgatggaaaggctgtatattgtgattgcggtggtggttataggatgtatatatttgtcaaaactcatcgaattgtacaattaaaatggatatttttggttatatgcaaactataactcaataaaagatctggatatatattagggcattgtcagtataatttcagctttctttgagaccctactaaattaaggggttatccatttgaacatcagggattggttcccacctccaggtggtagagcacagtgcataggaacttgggccagaaagtcaggctgtctgggttccagtatcagctcctccactgcagcaagcacacagcttcacctgtctgtgtctcggtttcctcatctgtgtaactaacctgacattagtggttacctcctagggttgtgagggtcaaatgcgttaatatattcaaagcatttagaacatttccttgtgcatagtaagctatatataagcattcagtatgatcagtaagttctcaaatcagtttgtgttgtgattttacctctttctcctaaaatgtgttttttcccctttcctttaccctctctttaaaccacgtgcactcgtgtagcttgaggtttttaatagaatgtttgaaagggatgtcggataacatcagcaccaaatatgggcaacaaaactgaaaccagtgaggttgagtgatgtgcccaaggtcacaataatatgtgggtgaccacaaaccagaagcctggccaggtgactcctggttcagctctgttttatcaagggttacagtgtttgcatttttaatactaaccattgggatttatcgcgaacctgccattcatcaattgcattgtgtggtgtttgtttttctacagagcagttcagagccccagttgcagacgacttgtcctgccaccaccatgagttctggtaagtcattttaaactcatctttctcttatctaccaaactgggcagtttacccagatttcccacgcaccctgaaggccccactctggcattttattttttattttttgccacctgggtgaatgccaaagctttgtcataagttgtcatcatcactctcatcaccttcatggttaatgattttttgagtgcctactactattgccaaagaactgtgctatacactttacatgcacattagccctctctttattgagatgtaactggcatactataaaccacagatatttttagtatacaatttgataaaatttgacatatgtgttacaccttcatggcatttcttaatctgggtgactgcagcaaaagtaaactgattggccataattgcccaaggatgtgaactaatctaatgcttccttcatctaggctagtagagtagtttgctccctcttttgctttgcctttggtagtaaaagtcaagacctaaagaaataatcagttttgagtatttttagttttgagctgaggtagaaaacgtgggttagggaagacagagatgggaacagatccctgctcatcatgcagctaagagctgtcagctttccaacccagaattggagcagagaagtttccatctggagattcagccccacctaggctactgagcatgccctggaccctcctgagacctgcaggtggggcaggctgtggggtgggaagatgatcatgtggatatctcattccggagtctcccaatcctgccgtatttcgtgagtgttgtcagtgacctctgtggattaaaaatcacccttttccatttatttgcatacaatgccgttttaggcaagttctgagtaggacagtatgtagttcagacctaggaaggctctgggctggaatagctgaggcccacaccctgacctcagtgtttactggctgcatagccttgggcctgtggtggacccttctcctctgcaaaatggacataataaaaacaccagttcattgggatttagtgaggattaagtgaggcaatgcttttatttatttatttttgagacagagtctcgatctgtcacccaagctagagtgcagtggcgtgatcttggctcactccaatctctgcctcctgagttcaagtgattctcctgcctcagcctcccgagtagctgagattacaggtgcccatcaccacgcctggctaatatttttgtatttttaatagagacggggtttcaccatgttgaccatgttgaccaggtctcgaactcctgacctcaggtgatccgcccctctccgccaccgtgcctagctagcctaaggcagtgcttttaaagtgctgagctctgtgtccaaggcatagcaagtgcttcatctttgggctcttactgttatgagctgagttcctccctgcaaagccagggacttggcttctcagcaattccttgagtgcttttgctgtgtgcgaagaggccgtgcaccttttcccctctaagcaggctcgggtactgccagtagctcctgcttcgtaactcattttttgttgtctccttggctttttgcttttgttgtcatttaaaataggccatgatgttttgctttattttgtttttaactttttctctgtagcctaaagctactttctcgtccagtggcagaactggcctcactttgctttactactcttggcatcaagggccagagaaggaggaagggaggggcctggaagaagggtatgggtgtggaaaagcccaggagactgctccccagaatctctctctcaggtggggggttggaaggaggcgttgcctaggaagagttcagaaattctggagcctttgacctgatgatcccactcttgggaatttctatcttaattccaaggaaacaaaaatatcacctacatgaagggggggtatgagtaagtacgttatgtgtatttacttgatggaatattatgccgctgttaaaatggtcattaggagaaaagcagctacatgggaaatatttgttttaatcactggtggaaagagcagtgtaaaaatggtggattcttttaattccaagtttgggctgggctaccagtcactgggggaagtgctttacctgtgtgatattgttacattctcctggaaaaccctcacaggtggggcgtggtttgccaccctcattacacagatggaaaaactgaggccctgaggggttaataatatggctgggatcactcagctagtgtgtactgttgctgaatcaaactcaggaagctggacagcaacattgtgctgcagaggtttgagtttcaggagatggagttactaatttttaaatacctttccaaaatttcttcaagtttggttgttacatttaattaaaagaaaggaagaacatggggctgggcctgctggtagctcagaggctgccccacactagcctggggaggcctggagcaaggcctacagtcacagaaggaactagagcaggtacttggatttctggccttctcaccagcacccttcttccacccatctcagaaatcagagctcaagggagactcagacatctaggagaattagccttcacctataggtgggtgtgggcaattaacaggtcacagcctgtggggccagcatgcggaagcccaggcaccaggtggggcagtggccctgctcatgtgtggcccacaggcagcatccagactggcctgtcagtgtggtttatagcaggcgaccccccttttggaaggctgattgttaagggcctaggtaaggtgacttagtctcagcctaatgaattacaggggtgtgggactaagcttcagtcccagcatttggagaaatagaatatatatatgtatcaggaaacccaaatgtttatcccatttggggaggaagaagatgagctgtgagatgggcagaccagagttcaaatttcagcctagtgatcttgggcaggcctggaatcctctctgcctcagttttcttatctataaaataggcattcctaactcctagttctggaggtctgggtcttcaggataaaatgaggtgctaattatggaatgctaagcatggatcctcacaccaggcaagtcagtgtttaaaaacccatagctagtcatgattatgtttgtagcttggttaactctgggcttggaggggttcctccaagcacacatgtcccagggcgacagggcctgccggccttccttccttggcgtgcctttatctattttgggatggggacctgggcggggcttaggctacaggggagcagggaggatcttagcttctgtaactgagcagaactcaggaaagtctcagccaacacagaggacatgacatccgaggggagctccagggatgcgtggaatttccatcaggtgagaagggaggaggaggcattctcggcagagggcctcataggaaccaaggcctagaggtctgaaagtatctgggcaggacccctctgcttcctcctgattgtgaccccagcacctcctgccacacaggactcagtaagtgctggggcagcttactcacaaacctcatgctctctttctttcttgcagaatgtgatggtggttccaaagctgtgatgaatggcttggcacctggcagcaatgggcaagacaaaggtaaggttcttggagagaaatctggattggtactggaaggcatttctaaaggtgcggagtatgtcaggccggggccatcccatctgcctggtgcaaacatcattggcctaaccaagccataaactggtgacctgttccctacactgattttctgagacctggagcctgttgttgcatttcgggagtctgaggctgccattttcccactgtgaggtattaaaaactttccctagctcacaaggatgctgtgaatgacagatcagatacgaggaccaaggcgtatttcatgcctggtacagatggcatttatcagcctgaaatatcccttgctcagccttttaccttcacctgtaataaacagtgatgtgttcacagtcctgtccctaaggcaagagcctaaatcattaaaataaattatttcagtggcattaatttaatgcacatcctctcatagtttcagtttttaaaatttttaggataaaagatttaaatgtgaaatgaatgatggatgcgatgacctttgaggtcctgcttagcctggagactttcatcctgacctcagtgtggctgcacagatagcctggctacggggctcgcggtgccacttttattgtgttgtgtgatggatgctgaagctggagtgacaaggcatgggttcaagtcccagctctgccactcatgaacaggacatcttgagaggccctttatctttgtgggtgtgggttcccttatctataagatgagggaatttatgatctgccgtatttatttctgcttcaaattcagaattggaatgaacgctcatcccagtaaattttctggtaaccaagaggaagggccagaatccttgcattgggcatttaagtcaagatgcatctcaaagaataattccaaacaatttggcattttgatctttgtaatttccatctgggtcaacaaagtgttccttttaagacaaggcaaagtgtgaaaggaaccagccgtagagggtatgtccagagactaggaggggctggggtacagggcccaggtggtgtgggggtgggttccttggtggccagaggggacctgccatgctcctgttcttgcctccctgcctggtcgcccctctgcacccacggtgtggggccctggacagtctcgaccaagttgcacttagggaactctgaggggcagtgcctgtggagtggctgtaggcatgtgtttagcatccagtgaggagcatggggaggggtgggggccctattagtttaaagcctgtggggtcatggaccccatccatgtgaactcatttatacaagagacttaaggcgtgtgggggagggtggcaggtggagtgagtcccactctctccttggtgagactcacctttgtctgcaaacaagcaggcaggagtgactgaagggcatcagggtggcctgaggtcactgaaccagagctgggatagctgagctccagtctcagcctctccgcttgagaactgaatgagcctgagcagttcactgagcctcttgcttcttcctctgaaaatggttacaaaagtctcccccaagcccatctcccaggtggagcagacaggaggatgctgtgagagcacatttgtgtcttaatccatgcagcagcgtcattggcaacctagtcattgatggccaggcgccgtgtgactgccccatgccttatgaggtgagctgacagcgggatggactggaaggtgcactgtctctggccgacatgcctcccttctgttgccttgacaggctcaccagcacgatgctgactttgcagtggcggtcttgttcccagacagccctacccgctgtgtttctgtagatctgtggccacagtcgactctggcaccttcacacagagctcccatccctctttatgtgctgcccttgaaagagaggacgaggggaggcctcacaacaggctcggtgtgaggagagttagggaacgtgcctaccatgagattacagaatctgggcaggcagggagcccagagaccctgcagatagataagtttgagcacccaggatgttcgagcggtagccttcaccacgtcccaggcaggcattcctgctctgccttagctcagctgggcattggggtcctgggctgtgcacttgggtgctgcccagagactacatatgcacttggacacttggcacctcctgaccaggaaagggtgggtttgagcaaggccatctgccgtttaacagatgggggctttgatttgcttggggccagagggctacaattatcggagcaggcacaagaccccggaagttatgctatgggggaagtagctctgatggctgaagggaccagacaactcacgatcttgttccttcgttcttccactcatctggagcccatgggccacagccctcctcctcggaacccactccccagccttctcccaagaggccctgtggaccctgagtgctctccccttcttctgtttgccaggccatctgtgtgcctctgtaaatctttgtccagagctttggcaagctcctggtgtggtaggaggcaccggtcaacactgaccagctgtatttgggtgatagttagaggggaggggtctgttgtcttggcctagaactctaaagagagaaagcaggttatttttaattactgcatctactgccctttgtattgttcttgttgtgtgggcgacttcctcctattgtccctgcccagttcctcaactgcctgagtgtttcccaaatgttctttctggatgcaccatttacccttttgtgttttcagcaactgccgaccctttacgcgcacgctctatttctgctgttaaaatcattcctgtgaagacagtgaaaaacgcctcaggcctagttctccctacaggtatctccttgggtcggtcgattttctctaactgtgagcggatcatggcatggttttcctttcttcttttcttctaacacgcactttgagctgaatcgttgcatgtttaggaggcattccgtctcacttcctcagcttgcttccttacttcctctgtgtatgtgaatgtctgtgtgcgttttcctgagagccagcgaatgtggggaggaactgaggacagaggccttgcccctcttttctttaggagaagggtcagtccagaggctcagctttccctttgggatgggtctgcggtgcatggacatcctaggctctccctagaggtttccagcccccagtactttagcaaaaactgcagtctccctgagaattaacctggtctcacagagaacctctgaacttagctgaatttgaagcagctgcccttaggtgcccaacctagattcgcctctgatgctcaccgggccatcccagagcatcccctttgccttccccagttttacctgcagccacttcctgcctctcccctccagagggtgggggagtacagttcagatgtcagctctggctcatcgcttccttctgtacaaagtggggacacatgaggcctacacagtactttatccaatggcgctttcagaagtaactgggctgtgtgtccaggaacctatggatgggctgcatccatcagtgtgcctctcatccttttgaagtgactatgaaccagttttcccaatagtttggtgacatcagtcgcttagcctcttgatagagttggataagtcagatgctctccaaggctgatgcttgccctgacacattgtgcgtttcgtgcattgcgttcaatacaagaggtgctgacgaggcaggtccattctcttgtctaacgctaatgatcattctccctgagttgttggcagggggctgctggcgtggaaggaaaggaaagaagaggctttgcttctctctgccctcggaggggaatggggatgagctggatgtttgaactcacatcctgcccagacacacaccctgaatgtcaacctgtaatcctaactgtgacaattttaggtcagggatctaggctgtgagcaatttgaaaacaaaacaaaactgtggcgttctgcatagctcagctgcacataaagaaacactctgcgtgtgcctcccagaactgtgtggtctgccctggttccctgcctccgtgactgatttcctgcaggatggcattcagatcttttgaagcgtattttgaaatctttctcaaggaaactctaaaagttgacctgggtctgttattaggccctagtgaaactgtaggagacgccaggaccctgtgaagacagctgaggctcggtggacactgctcattgaaggatttagccttctgagtcgtttttgttgctgtgagttttctttgttatgtttggaaagtgagactgtcactcgtgagctttctcgccaggcagcatatccttctgtctcagcattttgggagtcttgacttgctgatccaaggagatttgcttttccttttcccactggaaaactgcaaaggggtagttgttctccatgggaccacccgcccccaccccccccaccgcccccacttccgtagttgccagcctggtcttcaatgagaagtatggtctggaagcttgaaacatctttcataaactctttcttgaactgtgccttactaactggtcagaagtctgctcatcaacctaaacttcatttaataaaaggaataaacctgctttcattttgaaatgttttcagctgatagtataactcatccatttactcagaactcaccattgccgccatgttcccctaacttcatgatgcacagtaaacctctgaaaacttgcccctctccaccacccacagattaatttcattgaccacaggtgttcaaagacttcgcatggctgtaaccaggttcatctcattccccggctgtaacaatttgctaaccaactgtcctttaatccttcaggagtcttggattcagtcttcaattttggaccttttcttttcagacatggatcttacaaaaatctgcactgggaagggagcggtgactctccgggcctcgtcttcctacagggaaaccccaagcagtagccctgcgagccctcaggaaacccggcaacacgaaagcaaaccaggtgcgcggaagctagggaaagctgttcaaagccacgtgggaagggcgggaggaggctctggtgtttttgctcaggagggtgtgagttcatcagatacctcttggggggggggggtgtgtgtgtgtgtgtgtgtgtctcttacggtcccctgggacagtcaaatcatttggatgggtagtggtcaaagcctcaaactgacagtcacatgctgcagatgaaggcacagcaataaccacactttatgttagctttgactgagcaggtcatcctgtgaccacagccagtgctctgcagactgctctcatgcagactgaaatagcttagggcatggggggtaagtaagcggtgcgatgggctagaggttgggcttctcagagctcatccctgcttcctagaggttcactgtgacctgtccaggctgggctggaggtgcagccaggggagactgagaagtgtggatgactcaatgatcttgctcctggaaaagcagaggtggggagggctcaggcctgggattggccactagccagctgcgggagcaggatcaggaaagtagctcaaaggcccagtgtaaactaggagcaaagggagatcaaagaagccacatgaagcccatctccccaccttaacccatcacttgggaaacctgaggtattgaggtttagaactgggacttcagaaccgggtagatctctgtgcacaccctgtccccaccacctgtcagctgtgcaactttggtcgagttattcactgtctctcaaccctgatgaactgtagaatggggttgataattgcatctgcctcaggattattgtgaggaagaagtgtatgaagtgctgtgtatcatgcctggtggcatggaatagactgttagatgttagctgctatttgattatgattagattattttggcctctccagggacgactttgcacagcccaagtattctggtagttggcaaatgctgactttgagatcaggcacagttagtttagggtgagacagcacctctccactctgtagggcagtgactttcacactttagctgcatcagaatcacttggagtaaaaaggtaggttgctgggccccagcctggagttttagaatgtagggttcccacttgcaggtctgaggtagggtctgaaggttcacatttctgacaggttcatgctgatgctgctagtgcaaggactgcatctgagagctgctgctgtaggggatgggagcttgctttcttgaaggaaagggagggagaaatggaatggaggggaggaccattcccttgggaccagagaggctaggcagtagggtatgcagacccctctggtgcagcgggagtggtgtgttgtgataagacagatatgatatgtaggatggaaatggccagacctagcatcctggaaactgattttcttccttcccagctacccataacaggtgccagggcacatgctggtggatgaggccaggctagggtttgagcacaaacccctttctggtgatgttggtccccgtgagggcttctttgtccttaggctgagggcaggcccgagcagcccacagccctaaaagtcaacagagtagcttcttggtcctgcatccctgagcccagccctgactcctgacccgctggaaaggtgggggtgaggagagaaggcaaagttattttattctaaggctaacctcatccagcctctccaagcctaactgggacgacccacttccaagctagagagcatttggagaagagagaatcctaagggatgatgcaaagagaaaggctttaatgtgcagtcccctggcccagtcaaataaccttacaaaccaactgtcccgtcctctggcagcaaatggaggtggtggagagggagcttggagctccctctagtggttacagtgtggcattgacgtagaacacaatgcccaccaggtgtacgcctgtgctaccagtaccgtgtgtggatttgtttttttttctgtttcgttttctttttttgagacagggtttactctgttgcccagcttggagtacagtgatgtaatcatggtttgctgcagcctcggcctcccgggctcaatctgtcctcccacctcagcctcccaagtagctgaggtgcacgtcaccacacttggctaatttttgtattttttgtagagacaaagtttctccatgttgcccaggttgatgttgaacttgtaggctcaagtgatccacctgcctcggcctggcaaagtgctgggattacaggtgtaagccaccatgcccggccccgtgtgtggatttgaggcacttttggaaacactctcttgtcccagaatacttttgtgtcttacaaatttctaccagctaatttggtgaaaagaaatttcaccacatctttttcaccaaaccatcagcagattgttttaaaatgcaaatactgtactcggaagaattaagggatagttatcagtcattcacaccttacagtaagttcatctttgtaaattgagatcatcgaatccaaataagcatacattcattcagcattatctatgtgccaggtgctgcatgagtcacttggaattgtgatgagaaaggaggaaaagagagcaattctaggtgcattaggtgagggcaaaaggcagtatgttgcaacaggagtcaggtgtggacttgtagtcagccatcttcctttcgggctgtgggtaagtcctagtgactttgagcccatatcaagtatgaggaacttgggccagatgctttccaagcctttctagctccagaatgctctgcgaccttaggaagtttggaaattagcctaacaaatggaatccctttgattggtgataaatttaagatggtacaggagggcagtttggatgaaaaggaacaagctgggtttgagtagaggaaacaaagaaaaaatccacgtgctcattaagtatacaacgcagactagaataagttaacactggggagtgggcttaaaagaggatgtcagtaagccgggcgcagtggctcacacctgtaatcccagcgctttgggaggccgaggtgggcagatcagttggggccagaagttcgagaccagcctggccaacatggtgaaaccccgtctctactaaaaatacaaaaatcagccaagcatggtgttgcacgcctgtaatcccagctactcgggaggctgaggcaggagaattgcttgaacccgggaggtgaaagttgcagtgagtgagatcatgccactgcattccagcatggaagacagagcaagattccatctcaaaaagaaaaaaaaaatgaggatgtgagtataggtaattcagaaatggtaatcttgtccccttaccatgctacctattggctaacatcctgctggctcttgactctgacagtgtccatgtcaccctccggactgacaacttgctggcccataccagtctattgtcctatcctggggcctaggagcccctgggccttccctggcttcataaaaacagttttcagcagtatttgcagacagccaagcccagtctggactgggagcccaagtgtgaggtagtggatggctcttgccaaggattgcttcctactcccaatgcctttgcagatagctaatgtcagatggcgtctggctccctcccttctcaccagggacagcatttgtcccccagctgctctgcctgcttcctctctgacttgctccctgtttgccaccttcttcaatgcctataggtgtccaggttgttgattatttgcctggactggaaggtccagtccctacctggtcccctgatacccacatttcagcagtgccccctatttctagtccttgtcccaaccccctcacctgggagagatgatatagttctggtttcacacagttctctactgaggctgagcactgccacttactgtctttgcggtatggacaaattactccaccttacagggcttcagttgccttatttgtaaattggagatgaccataacagagttgttgagattaaatgagctctttcttcttcttctttttttttttttttttttttgagatggagtctcactctgtcacccaggctggagtacagtggtatgatctcggctcgctgcaacctctgcctcctgagttcaagcaattctcttgcctcagcctcccaagtagctgggactataggtgtctgccaccacattcggctaattttttttgtatttttagtagagaccaggtttcactgtgttggccaggctggtcttgaactcctgacctcatgatccacccgccttggcctcccaaagtgctgggattacaggcatgagccaccacacccagctaaatgagctctttcatgtcaagcatttggcacaggcccaaagcaagtgctttttaagagtaaccattctagttcctgcaggtcaagaggcttgttaaagatttgaaagaatttcagtttgaagccatgagggcctcacccctagcatggtggcaatgggagtgaagagcagaggctgaggtcaaagtgtcttttggagaatgaaatgaccagggctccttgtggtgtatttaaggaccacagagaggtaagactccatgtggcccaggagatgccttccctggttggctaggagagtaattgtggcactcatggagttggggggatttgtgaagagtgctggaaagaatgttgaattccatcttttgacatgtcaagtttcttggcaagggaaggacttccaggagaatgtttctaatgggaatttggaaatttggagtccaatgtgtggatttggaagccatctgcatccacatgaactttgagagaatggagacattctcggtggagtgacagagagagcccttgaaattgcccagttaacactcattctccagactcctccattcaagtggtggcttaactcaagatccctgaccacagcttcccgatcagcctcctcatctctgaatgtggaccttggtttttggatcagaaccatctgaaaggaatggcagtaatcttagtaccgactccctgcccccaggagaaacctcatcaccttatccctgcctcctgacctcattgccacaccaggtctgagcgttggccatgttggttcagagtgacttgatcatgtcccaggtcagggtgttttcactccagacagggagcctgagttggtggtgagtgtgatacaaagctttctgtctggtatagtctaaagatcttgtggcttgatatatcaattcctgtgttctgacttagatgccagggtccagttcagcccttatattttgttaattctgtaccagttggctccagtccttactgcctgattcttgaatgcaaagttagctttggacataaagattcttggacctgcagtccaattatttcctctggttttgactctcacatttgctctccaggaatggcagtagcaaaaaggtaccataagaaggttaacattgaagcagttgaaggtaccccgtacctccattaaattagagtctttttgatgagtacatgtgtgagaattagggccaactgagaagttggagggaaaagtcctcacaagagtgcaccctcccttctgacaccagctgcaagttcaggggattcacaaaaccactctcaggtttggtacaatgctggagggactcacacaacttactgaaagctgctacactccgggttatggtttattgtagggaaaggatacagattaaaaaaggcaagagaagatgcacgtaggctggagtctggaaaaggtaccaaatgcggagcttctgttgcctactctgcgtggagagtcaggacatattatttcccagcagtgatgtgtgacagtgttctcagagcattttcaaccaggaaatgtacctgagcctttgtgttcagcctttttgccatgtctccattacataggcatgatccactgcccacagggcagttctcaatctccagtccaactttgtaatcgattgagctcctggtggctcaaagcccccaccccaagtcacataattggtgtgactcaaagccccagataaacaaagtcactcctatcaggcatgactttccaagagctcagagattacatcccagaagctgagggccaaggccagacctctttttggataaagttaaattctctactgtacagtgtgaatacaaaataaacacaaataagatttggaacacccttagacttactattaacacctgtcatctacctcttaaatactcttaccagaacacatcaagactcactcagtgaaaattatcctaagatgccaagaagaattgactgatcagcaaaaggctttaaaacaggtcaaaatgaaattagcatagaatgagatgagataaaataaaatatcaggaggctacagccacaggccagaaaagattgcaaataaagaacagctggaggaaaagataaggcaaagtaaattatgctgcttgcagaaagggtaggtctctcaggactgcaaaagctctctaggatccaactttccgaggcactccccccagcttgggagctctaaggtaacatttattgaaagaagcattttgacagtctcttcaatcaggagttaataatggatgatcatgtgtgcaaaatttcatacttctgcacataggcacaaatggccctgggctgctaccaaccttccaagttcagaagatgaggtaatagatgaaggatgataagatgtcagaaatatagctctcctttaacaaggaagagaggaacatttaagaggtcctgagaactgcctttttgggataggggaaggggaacagttttaaagacttggaatgagaagaaaaagtggatctatccctaaggatcttacgttcttaaagctatttatcacatggcagagatcaacaatgctcatttttttccatggttttttcccccttatgctttgaattctgattttgcaaagcacatgctttatgccaaatactttcatttagtcctcttgattcaaaagaggtagatattatctccatttcacagacgtggccaggtcatttgccacaggatatgcagttagcaagatagagactcagggctgaaactaggcaatctgatgtcacagtgatggtcccttcatgatacctggagatttagaagaacagttcacatttcagctttccgtgacatagctgtttgctagtgtcacttgaatagaaccaacccaactgagaaccagaaagtgggcaaaataatgtgtccccaattgcatgtacgaagtttacatccttcactagatagcccttcactcagaacctgttgacgttagtatatgcataaatctaataaatttgatagacttatttgacaaaggtggactagaaatagcaacttagtaaagaagatggaacggtaaaagtgatagctgtgagggaagaagtggaccattgtcatggcatgtcaccaggtgtttaagggcctgccaggtgtgaggggagctctgagccagggagccgtctggatgcgacagggagtgtggtgcactcagaggtattttcatgtacctgatctttgattctcaaagattctccaattcttcaattggagagaatcaaagaatcatactccctgtgaggagtatggggtaaggcttatattttataggtgagaaaagtaaaatttagcatggctagtgaacttgctcctggtcatacaagccggtacattgcagtaatgtgagcaaaacacatgtcctgtatgtacctttcccaactacagttgtccctcagtatctgccagtgattggttccaggaccttcacggataccaaaatctgaggatgctcaagtcccttatataaaatggcattgtatttgtacataacctatgcagatctcctgtatattttaaataatctctagattacttgtaatacctaatataagtgctatgtaaatagttgttactctgtattttttaaatgttgtattattattgttttcttattttgtgttttttcccccaatatttgatccacggttggttgaattaacagatgcggaatccgtggatatggagggctgaccgcacgcagtttttgcgggttggagaagacaaatggcagtgaattgtctgtaaggaagtggcagaaatgtaacaggcaacctgctaaaagaatatgtagctaaattttaaaactgttttaaaggggaaaaaataaaatggatacagctagttttccagaataaggacgtttttgagtgtacctctcatcagtggttctccaggtgtcggttacggactggcagtctcagcatcacctgcaaacttgttagaaatgcagattcttgggcctcacctcatacttactgcatcagaagtgccaggatccaggcccagccacctgtgtttcagcaagccctgatgcagctacaccactgctatacgtgaatgccaatcacttggaacctttaccctaccttgccttctgctccagctctttttggctcccaccacctctctgaagcatagcatccacttcatggccgatggggaggctggtggctgtgggggtggtaggcagagtgctaggtttggattctggagacttgggctgactgctttgtcacttcctggctgtgcgactttgggcaagtcatttggcctctctgtttcctcatccatgaaggagagtgattacctacttcacagagttgttgtgtacactgaactaaaactaaatgggcgtaacagtgactcacagtggcacttagagaggtgttcagtaaatgtctgtaaatctcaacttggcatctggaaagcccatgtctagcacctgagggacccacattgaaacggaggattgggcagtgagactgcagtgttagtccctctttctctacatggtgaggcaagaggaggcagcctgggaaaagaaggggttaaggcttggctagattagggattggcaaactgtggctgtgagcggaatctggcctgtgcctttttttgtacagccctcgagctaagaagggcttttacattttttaatggttgaaagaaaaatcaaaagaagaatggtattgtatgccacatgaaaattttatgaaattcagattttagtgtccataaataaaggtttattggaacacagccatgctcattcatttacatatcatctgtggctgcctttgtcctacaatagcagagccaagtagttgcatctgagaccatatggcccataaaacctaaaatatttactatctggccctctatagaaaaaagtctgtggacccctgggttagatcaaggacagagagtagagacaagagatgatacagaagatgataaatagcaaacattttctgagctttgccaggcactgtggtaggcattttgcatgcataaatgttcttattaacaacacttataaaacaggcatatcattatctccatttttcagatgggcaaactgaggcttataacttgcccagggtcatagaacccttaggtggtagacccaggatatgaattgaggcccagctgcctttccagtcgggcttgtaaccactgcactctgctgcctcatggtgctatgtgctatgtggatcagactagaggtttagggtctctgaaatgcatcaggcagtggctgggaaggctgaagggagacaggggtgctttgtgatgtgatgaacactcaggaagggtgattagattttgaaatgtttatgtgcctcatttaatggaaagaagaaaagcaggcagggaggaaaaaaaagtctttatcgcagcagatacctcccagcttaagtcatgtgctgccccttagcccagcaccagcacccctggaaaaagtgtttatccacttctctctctcctgggcctgttagttggttgggagtggtcattctgagcccacagcaggctcaaggaaggggaatgagagtcagtgagtagggactggacagtagagaattctgttgcctttttgtctgtaaaataagaatgtcaagtaacaattgtttcttcatccctgtgaatgtgagccttgtgttttcaaaggtcagtgcctgtgagcacatcatggtttcgagtgggttcctatggtaatcaggccatcgtgactgagggcattttgtgtcaaacaacggggtgctggattttcaaccttctatgcagtttcatgcttgtttcctgcaaatgtaaccatttctgtttttccccttttcttgttttcatcctttctgcaccacgtgtaggtctggagccagagccttcttcagcaggtatggcttctcttgcattctcacctttctggccttctaccaaggaccccggagttacaggggaaccagggagttattccctgtgagtgagagattttttcctctctatttctcagatgagtggaggctttcttccagtgctgatgccaatggaaatgcccagccctcttcactcgctgccaagggctacagaagtgtgcatcccaaccttccttctgacaagtcccaggtaggcatgtgcccaagggcagggtggggactggtgagtggtacctgttcttgagtctcttaacttagactggtgacttcctgcttccccagttggataacggaataggtttcaagcttttggacaactctggataagctctgcaaggacctagctaagggaaagttggggtcaaggggagcagaggcatggaatgaggttggtctgtaccagggtgttggaaataggccttgatgcctatttaggtttgttctgtatgtagaagtgttctgaaagagggaattcatttagccttggatatgtaggaaaaaggtctgagacgtttttaaaaaaaattctttagagtgtaatattcaagagaagaatgcatcttgtgtttattccagttgttttctggagatggggctgtaagaactccagcaacagtatccttacagattaagatcaggtagctgtggccagaccctaagtccagcagcccaggaacaggcaaaatggcagtacagcccagctgtatcctacaaaagaaatcccccaaagctgtacaaattggagtaaggatacttttgcttaagtctttccccctaggtggctttcctgatcttttctttcttccctctcctgttgttactttgtcattttgatgatgggaatagaccatgttttaatttaggtgatctgtgatgaacatttttgcatacaggagccacatctgtggagtcgactactacttctctctctctctccccctctctctcccctctctctctttctctcttcctctctctttttttaagacagggtctctatctgttgcccaggccagagtgcaatggtgtcatcgtagcccactgaagcctccaacggctggcctcaagccattctcccaccttggcttcccaaagtgttgggattataggtgtgagacaccacacctagcctagtcctttctcttaaaggaagctgtgctgctcaaaaactatagcagaaatgtgttccttgtgtggtccgcttccctgtgccttccttctgtgaaggtgttccccgaactcacaaggagtccgcaaattctgcaggtccttcctagttcccaccccacttctccaatgatcctctggttcctgttgtgaggatgtaaaaatgcacttgctgctgaaatgaagctgaatcagagatgatgtttttctccctctctacagatgcttatcctcctcagcgtggaattggttgcttaattgtctgccttgtatgctgagcaacaaacacatttagcctttctgccacctgctatgacttgcctccctaggtacagccgtatgcatcctgggtcactggttagaaccaggagctgcgaatgagcctggctttttgaagtcttcattagacagagggactggggaggtcacttgtccggtaaatgacttgccatggttttcccgtccctaaaccctttcacagtgtataaatgtgctgcctgtggcagacatacttcttttcaaccatctcaagaatggatgccatcagctctatgcagatcaagaaacagtgctgattaattcaaagcaaatgtagaagcatgtcctcttccactatcagtgacttagttcaaagggtaactcagtaattctttttggcttcttaagcagctcttttgaaaagacaattttaaaagcatgtgaagtaaataaaaattcttttaaaatttatttaacacagctttattgagcatctccgtggtgttcagatcactgtgtgaaacattgccctcaagaggtttataagggtgaacaccctataatatcttttacaaagtatgttttcttatctgtcactatccaagaattttctttctactggggttcccttttaagggaacttggtaaattgctcataaagaggttttatcctttatattcaatgtaaaatcagccattcaaatttcaggaacctttaggtcatgcattacctcttaggtgtgttttctgaatggaaacatgacttcttgtctatatagtgattgccagagctgtaagtatgcactggcttagaggagggaattggtagtttatagaactgtataaactataaacataccaggattttccagaagcctcatattttcactgacccaccttctgaaaagataaatagaatttcatttatagccaactgggcagaatgcagactgcctgtgtggttcctacaatgtttacaacaaaaagtagttccctgcatgtaaagtcactgtgcctatcccctttcttcttcaggactaaaagaagccccagggcaggagacctttggatctgagtgcactgttgatgctctggggaagcgtcctctctacagggtcaaagccctgggaaggctcatgcctgatgtaatgcaccatatatggcgagagccaaaataagttagaaactcactgaagctgatttctatctttggacaagaagaaatcacatatgggacatttgagctgaaagtaaaagtaaatctgagctcaaatcaaaatgatcttttgcttacctccctactgccattatcagcatacccgccagtccctttggtgcgtgctagcccacgtgttttgtttctagaatcgtttagtctgtaaacatgttcactgaaaccaagtgagttcacctgaaagcttttgctgttgctgaatactagagaggggctattcattttgttttttttttggctggtgcatattcactggcactgccatgggtgccctgtggaaaggataggcattgaattagtcaaggatatccaaatgagctgcttgtccaatgagcttatatgtgtgccttgaaaactgagtttaaggaataggttatttactatttctgggttgatgttctaatctggactcaaaaaactttttttttttttttgacagtcttgctctgtcacctaggctggagtgcagaggtgccatcacagcttactgcagccttgacctcctgggctcaagcaatcttcccttctcagcctccttagtagctggggctacaggtgtgtgccaccacacctggctatttcttttttaaattttttgtagagacagagtctcgctgtattgcccaggctggtctcagactcaagtggtccttctgccttggtcttccaaagtgctgggattacaggcttaaaccacagtgcccaacctataaaacttttaaatatttttcacctattcaccctttctaacattctttcttcttgccacctgtatgccacaaatataagaatgaaataggccaggtgcagtggctcatgcctgtaatcccagcactttgggaggctgaggtgggtggatcgcctgaggtcaggagttcgagaccagtctggccaacatggtgaaaccctgtctttacttaaaaaaaatacaaaaattagccaggtgtgatggcaggcacctatgtataatcctagctactcagtaggctgaggcaggagaatagcttgaacctgggaggcggaggttgcagtgagccaagattgtgccattgcactccagctggggtgacaagagcgagacttagtctcaaaaaaaaaagaatgaaataaaattggccgggcgctgtggctgacgcctgtaatcccagcactttgggaggccaaggcgggcagatcacttgaggtcaggagttcaagaccagcctggccaacatggtgaaaactcgtctctactaaaaatacaaaaattagccgggtgtggtggcacaggcctatagtctcggctactcaggaggctgaggcaggagaattgcttgaacctgggagacggaggttgcagtgagccaaggtcacaccactgcactctagcctgcgcaacagggtgagactgcatctcgggaaaaaaaaaaaaaaagaatgaaataaaattaaaaataaattcaaaatagacccagatcttgcaccctccccatttttggtcaaaattcacttaccgatattgatcagactctaatatacttcacttgcgtaatttggaggaaagttctggttttcttctagaactgggatatctttaaaaataggagccattcacgcctgtaatcccagcactttgagaggccgaggcaggtggatcacaaggtcaggagctcaagaccatcctggccagcatggtgaaaccccgtctctactaaaaatacaaaaaattagctgggtgtggtgacatgggcttgtcccagctactcaggaggctgaggcaggagaattgcttgaacctgggaggcggaggttgtagtgagcctagattgtgccactgcactccagcctgggtgacagagtgggactatgtctcaaaaaaaaaaaaaaaaaggagccattaaagaaaacctaggctgggtgcagtggctcactcctgtaatcccagcactttgggaggctgaggtgggcagattatgaggtcaggagattgagaccatcctggctaacacggtgaaaccccgtctgtactaaaaatacaaaaaattagccaggcatggtggcatgtgcctatagtctcagctacttgggaggctgaggcaggagaatcacttgaacccaggaggcggaggttgcaatgagccgagatcgcgccactgcagtcccgcctgggtgacagagcgagattccatctcgaaacaaaataaaacaaaacaaaagaaaagaaaatctagcaaaatgcagtttcctcatctcatagtctaattcccagttgagccgcagattgccagatgactcttgttgacatgaggatcagactggagggtcatcccatttcctgaccctcttctccactgagacccaaagaggagcagtgttgagaagagagggatgctgtgtgagcctctggacctgcaaccagagctttgggcttaagctgtgaatctgaggctgatcatttacctctggggctgattccctttgtgtggtggtgggctgggtgagatgggcatggggctagattttgagaaactaggcacagtccaatccggtagaggccaattcagtccttcattgcctggtccccttttttgtgtacatcaaaaatgggagactgtgtgcttttaatctcatgcttgtcttccttctaataattagcttcatcaaattctttcctctgagaaaagagcacatgtgtattcaaaaatccttagcattctcttcttagggcacgttaatttgttatgcttatggaattgagtgctaaatctcagtgactcaattaagacatctgtctcctgtgaacacaaataaggacggttcttccagttctccttttcctaaaggaaaagaatgaaaggcactcaaaagagttccagtgaacataaacttctaaggccaaaggctcgaagataaatcttgagggaaggaggtttgagagggagttgggggctttggtgcttctcccactggtgtttagttcacttggctcccttcttgagtcaggatgtctaataaagatgcagtcagccaaggattggtgtcacaattgatgtagcatgtggcctgctacgggctgggctcagcctctctggatacaaaggagagtcaggcctacctctccaggtgagtgggattcagtctttggcttcacttagaattgtggatactaggaggagtctaacctgaggatgtgctgaaaaacgtgttaagaattgtttttgcttgaatcatgttatgctgtcgtttctaatgatcgtccttctttccatttcccctcctctttcttttttccctgtttgataacatatcttgaaaatattgctaaaggttctctctcccccacgccctcctctccctcaaaaggaccgctttgcatggcagtcccccaccatccacaatacctataaggattccctctacctgagctcaccaaagccttatgtcccactcggcacccccagacagcagaacccctcacaaccccagcctatctctgtcctcctggcagctggatcggctcccaaaggtgtggtgtgccctggttccttgcttccggactccacgttccccagtgcttcatcccaaccccagcagcgctatgcagccaccaggacagtttatcataagaatgtgagctctaacccatgtcatgaggcagttgggattaaaaaggtcagcagcttatatgtaccttgtttatccaataacatttgcctggcggcgtcagaaaactcctctcgtgttgcacgtgaccctgccgaaggcactcccttggaggctgcgggcacccgagcaccggctcccggccttgtctcccgcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggcaagaaattaggaatgtttgtgtgtcttctctactgtctctttcaaaactgatgcgagcagctcattgttcactgggctgccctaccctccctttcctcattaatgttgttgtggcttgagtcccgaattcttctgtctgaacctttcagcacagtactctctttgtctgtctctcttttctgtaaatgtgtaagtatgccggagcgtggaatccagagactaataacatggtgagaaactcattgttcatgttttattacaaggtgccaaagaaattgtatttactcccaagcttttaggctctatggtggtgttgtggggttaaacacagcctgcctgcctgttctgttctttctctctcataaagtgttaaaaggattcaaaaatagatggatgaaaagcggagttggatggggttccctctgtgtcatggagtgtcagaaggccagctggccagctccgactgtctcatgtactctgaggaaagggcactgattaaatatttctcagagtacctcactgcatgcccactctcaaccgtttaaatatggaattctttcctcgtatcatacccctttccataacgacccccttatttccacaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgtaagcttgctggactcccctcctcacggcttttctgaatgtctcctcccagcagtcacattccctttctcactgaagcactgagctctgaggacagcactggctgccgctgtgcctgtgtgatgactggagccgtgtcccctgtcactagcgtgcatgcttcccgtgtgtcttccctgggtctctcggggctgttccccatctctgcagtgcctcatctgctctgtcctgttgggaatgcacatctttctccctcagaagacaacatctgtggcctttatgttgactggccatgcttttcacaggccaggtcgggggtcgtgtggtgagctgaggaaagctaagaattatgggggaaagcaacggcaggcgtggtgggtgctacttaccagggagcggggagatctcggggaggaagcgattctctgattctcttgttgacctagtgagtaaataaactctctgtagtatacagaaatgacagagactaggattttttttttttttttttttttttttttttttttgtgagagagttgggtttaagtgagcaagtgggtctgaaagccctgtacaaatgttaggacttttacctcaaaaggcaggcaattgctagggcccctgaggagaaggtcccaggagcctctgtgacaaaacagtgccccagtggtcacaggaagtcaaagggccctgctgcctcaggtcccatcctgtgggtgggggaatgagttcccatcacagccgggaaagcccaactgcttagagaaaaagctgagtcaaagtgcttgggtctcctttttccttaggagccctgggaattgagagaatctgataacttcattgcgagttgtaatatgggaatacgtgaatctactcacagggcttcgggttcagtaggatcgagtgtaaaagttcctgttatggagcttgacatagagaaggtgcctagtgaatgttagctatgttgctgaggacttaccctggcaaatgagggccagggtcactcaaaagcaagtaactggttagttaacaattcatcattgagtttctgccgtggtctaggcattctgctaagtaccctgggtacaaccatgagtcagggtcttgttctcaaagggatttttggagtaggaggtcacttctcaagctttgtgtacatgggatcatctgagggtcagggaggcttgtttaaatcgtcaccctcaggttatactcctagaatttctgactgagtgggtctggagaagagcctaggaatctcacttggtagcaagtgctcaggggtttcagatgctggggtccacaccctacattttgagatacagtcatgtagtgggtcatgcaattggctgatggaactaagcgtttactgacatccctttgtgtaaagatgtatgcctgcaaaactgttccaaatggcttgttaagctgaagccagtcatgcagaaatcaggaaggaaacttttcatttggcttattagataaattataatgaggcatcaaacacatcaaagctgggaaccgttacatcctgagctggggcctgttctgaaatctctagtgctgtgcagtgtagttaggtcagcaccaggcccaatgtgacccacggccttggatatccttctagctttgaatttcgcagctcagtcccattgaagaaaaatgctagatgtttccctggtctattcccgtctaccttcagctgaacttagaatttagaagccactcttgttttggggagttcaagcatcttccctttgacacagattatgtttgcctggagtagcaggtaaggtgtcttatgtttagtgtcctcatagaccattgtgagtagtttgattgtgtattctataatttatttgtgtagacctaggttttcatatcgagttggttttaggtgtaccaggacagattcgttgggacagggtcctcagtttctcaaacctgactaatcagcctggtgtagacctcccagaaggacctcagtttggcctgatagcttcgggtttggccctgggtaacagaggtgaaaaaggaaactacttggattcctcttcctcctctgtcaagaggaggagcctctgtggatggtgtctgagctgtgagctgatgcctgctccatctgtagctagttgagagaaagaaggaagaataaaagtcatgttaattgatttgagttattttaatcaatagctgtttttgtgatgttccagaaataagacacaaaataaaatctgtaaagtgcttaatgctcatatgatccacccaaacatcacattaggcatttatactttaaagagctgtatgcctgatattttgtgtttcttggatgcattcaggcagtttttaatgatatgtcatttatcataattatatcactttggagataaattaggaaaagtgtagttatttttcactttctaaatggaggaatcaaggtgaggcacttttgtataaaatcatactgtgcttctcaagtcttgagaaaaggttttattcatgacattgagctgcccctcataactaaatagcggcggctatttagtggactttcagaagagatagactgacctaggcagtgttgtgaagttcctactgtgtgttgggagctgtcctgggtgctgatgcccatatcctcttttgataagcatttgttttcttgctacaaacatttgctcagacacaacattgctgaaagatcccacctgtcagtcacgtgacatttactagcacctgctatctgcagggcattgggctaggtgtgagtgagggggtggccctcatcttgtgggtacgttcacaggagttgatctttgattattgcttcaagataattattgcctcaaaagtaactatttaaaatcttgttcttaaagccttttaagaagagcatcctcaatttatggtttataaactcaaaaatagaaatgtatagatatcatgaaggaaactgtctaaatattcttagtaccttttggggtcttattttgttttaaaagactggcattatccccaatatgcagattataatgttagtattaataattttattggtatttctggcagagacctcaggtttttaaagtcaggattctcacaagtcttagggatctttgtcactttaatattagagtgaaaaaaatgtcacagtaggataggataatctccaaatctcagaagcaagcatcagtaaaattgctcggtgatgctgatgctaagagtagctttctgaaaaaactgttgctcaactcctccctgttcttacattgatgtcttcttgtcctcacattgtcttacatttctctgtacagtgtactaaacttccctgatttttcccaattaaaccagctcttgttcttggatcgcatttggaattgcatgggttttgcatgttattctacttggatttgaatttggtttttcagtaaccagattgacccacaactgttaacaggtggacctaatgaatgatgttgctgagacttgcagtaacattcaccttctctctctcctccgccccatactaataccaacaaagaggataagcattccggcttaaacttctaactggaattaatgatacgatgtatctcattgattgcatttctttttataattaagatcattgtaaagctttaaatttcttctttttaaaaaacattaacactagctttttatatttacagttagttacattgtttgtttgttcgtttcaggattccagtcctctactaaatgaagtttcttcttcccttattggaactgattcccaagcctttccatcagttagcaagccttcatccgcctatccctccacaacgattgtcaatcctactattgtgctcttgcaacacaatcgaggtaagagaggcttgtgccccactcccagcccactggaatcaacatagctattccatgatacttgggtcagaaattctgttatttcacagaaattttcacaaatcccattgtttcccaaggccatttgccccagtttactcactctcatggcccataaaataaatcccagcagacagacagaggcccctgatctgaggtgatatcaggtgtctgaataagtaagctgggttcgttccacttcttgggtgttcatgattgtcttcttcaaatcgtaacaccaaaaaaaaggagaaaggaaaaagtttgtgtctcttgatggtaatagagatttaacttcgaaaatctaggtacaataatacctcttttaagtagtatcttaaatgatttatttttttgacataatgaaatttagagagagcagaattttgagtatcaaatttaaaaaagaaaacatattgtgtagacaattttctggaatgtaaaacacgtttttgtaccttgaaaacagagactattgaatttttcttgaagactcactggccttcattcttgccagctgtttgtctctgtactatgtggctctaggcagctctgcttagagttttcatgtttgttttctgtagtgtctctgactgcttctggttggtttttctgcttctctgaaaagcagagaagctttgagttggggtgaagcggaagttctttgggtatatgttgacccttctgctttaaaattccagacgatgattctaaatcccaagttttcctttttggaattccatacaggaataaactttgtctttacaaaagtcctttgcagcatgaaatgtaaagttttcaagctgtttcctcatgtagaaagggcttgttagtctgaatttctgataacagtggaggtttaattattttgttcagagctcacgtcttccttttgactctgtgctctctgacttcacagttttcctccactcctccccctcccccttcctctctgcattaatttgaatgagaatgggactggagtctatttttaattgttttccttactaaatagagtttttctgtttcctgcttctaacttgaaaagcagatgaataaaacattttctttcacttcagatctttccactaaaatcttaaggttgttttagtagttttgtatttttttcactatgtgtggctcctgtattaattttcacccatgaatctgggttcttaataaaaagggccccagctcccacacggaaccatgcaggagcccattctccttcagcggtgccatgccccttactggcagtggctctccttgcccagaaagtgtctgtaatgtgggacaaagtgaaattttgtttctctgaacttccttgtgactcatatttaaaaaaaaaaaaattcagtcaaacagaattaagttagttcccagaaggacaggcagtttctttaaaaatgggatttattcccaaggcaacttggtttttgggaaatgccaagtgtaatgtcagctgcttctgccaagtccctctgatgacacctagtgagacatctttgggcacagaaatgcctgtagttcctttttgtttcttccttgaatagatggattccttttatttacccaaatgcctttggttcttgcctttctctgttgtccaagtcctgcccttgggtttaaaaatcagaattgtgcagcctgagacacacatccttcagaaaaggatacaagtaatgacattcattttttggaattaaatgatagatttccataaagagcaaaaccatatgttcactaagcaggtggggcaggaagcatcaggaagaagagaagagcctcactggcccagccccgtattactaatcataaatggggtttaggtcaagtgtttttggcattgctttggaatttgcctaacctggcagctctgctttgcttcataaacagtacccataaaaataatttcttaattattgcaaagtctcctgagggaataactttactccacttctggaattctagttttgtcatcctaaaaaatgcctccctccctgccccccccccccttttttttttttttttttttttgcctagactgtcccagggcatagtgtggcaataatcctgtctctccaagccagcttacccctactagaaacagaggggcactgagcctctggcctggtactgatggttgtgaacaacacagccctttccccttctttcctgagttttcacaccacatgggtatgaagacaaatcgcttaccatctgtctgggagggaggctttgaatcagaaaactctcaggatgaaaagaggtgcgtgggtccccttgcttagggcttctcagtctatgtgcgtcggatcctgagagtcttgttaacttgcaggttcagcctcaagaggtttggggtggaggagacgagattctacattttcagcaagcttgctaggcataccagtgccactggcccaccgaccacattgagaactagagctcagaggttcccagacttacggacacatgaagcagtctagggatcaccctagggtttttcattctaatgctttaaaataacaccactagaaagtggccactgttacctgtgttgcatgtcatcctatgaaagaaaggctatttcacacctcaaaactggagacaacatagtctttttttttttttttttttttttttttgagacaaggtctcactctgttgttgaggctagagtgcagtggtgcagtcatggctcacttcatcctcaacctcccaggctcaggtgattctcccacctcagcctctcgatgccagtagttgggaccacaggcgtgtgccaccacacctggataattttaaaatattttttgtagagacggggttttaccatgttgcctaggctagtcctgatcccctgggctcaagggatctgcctgcctcggcctcccaaagtgctgggattataggcatgagccaccgtgcctggccaacgtggtctttttcatttatttatttatttattttttgaggcagggtctttctatgtcacccaggctggagttcagtggcacgatcttggctcactgcaacctctgcctcccaggttcaagtaattctcatgcctcagcctctggagtagctgggattataggcgtgtgccaccacgcctggctaatttttgtattttttagtagaaatggggtttcgccatgttggcaacatgatcttttaagtggaatacattcacttctgccagctggagctcagcagccttcagtgtagtgtgtgggaaccgtaggtccccttagtaccaatagggccctttgacataacagacaaggaaactgaggccgagaggtttagtgaattggccattgtcatctgaaagttgctggcagagctgaggccagagctgcactgggcttctgcatgttcagccagtacgaacctcatccatgtggcagaggtggccaggcaccgcttcccaggctgtgagctcctgagctgctcgctgtttacttctggttcacactgattgtagcaggagggtgggaacgcagccaaggggaatgatgacagtacccacgggttggcaaatgttctatttttatctatgtggctgctttatatttagcggctgtggaaggtaaaggtcatttttgtactctcatctcatagcacgtacacattaggactccacaaaggagatgtggcttcccttccacatgagtgcccaggatggtgagaaaccaataacccttcaatgccaaggaccagcaaggtcttgatgactagaattggaatgaactctggactaggagtcagggatccaggttctagatccagctgattttcagtgttatcttgggcgatttgtgccccttatctgaagtttctcggccattgctgattttttaaggatttttcttgtactccggacaagccagattactatagtgactaaggccaggctttcgtttcctcctctgtacaatgggaaagaataatcgtacccaactactagagttgttgcaaagtttacaagtgttatttgcaaaagcgctaaaacagcgcctggcatttagcaagctctcaggagacggtcactgtcatggttgtgattataattacatttccctcaaaaggtaccaagactggggtcatataaggccttgctcacttgaagctggagggttggatggattcccttctatgatggaatcatcttgagataagatgtaaacagctagaaaattgtggcagtcccctgaatcctggtgtagatctggaagcggggcaggctgggagacaccacactggcataatgggagccacgctaatacccctgcagtcagctggctgcatgcacattgtaccatctaagtccagaggacagtgaggactcagggttgagatcctaacgagttatgccagggcttcttggtcttactatgtgctgtataaatcttacttacactgtgtgttcttttatcacagaacagcaaaaacgactcagtagcctttcaggtaggtgagaaatatttatttatgtgttaatccctgttcctgttgaaaccgtcttccggtcaccgcccgatattcaatcagcaatatcttccaagatcctctgatgtcttggggagactctttgttgctggactaccaagatgatgaaaataggcatagttcctgcctccctggagcttgcagggtggtggacagaccagaccagtgagccacactagtaaacatgtcccatggaactgtgataagggccttgatggataagaacaggatgttctgggttaaaaagaaccaggagtccagctttagatgcagtgttcatggcaggcctctctgaagaggtcatctttctgctgcttctgtctcccttctggatgtgaggagtcaggggttgggagatatgggcaagttctctcctttttgggtggcaagcccaaatgccagtagatgcccctggggtggtgggtccaggtgagaaccttccgaccagcagtgcccagaagacagtgtgagaaaactgcttcttgaatttgagcaggcatcagaaattcctggagagcttgtcgaaactcagattcctaggccatccccctagagatttggatttaatggtgggtatgagtaagaatttgcatttctttttcttcccttttcttttcttttctttttttttttgatacagcatcttgctctgtcacccagactggagtgcagtggcacaatcatagcttactgcagccttgaactgctgggctcatgtgatcctcctacctcagcctcctgagtagctgggactacaggtgtgcaccaccatgcccagctagttttttttttaaagtttttttgtagagctggagtctcactatgttgccaaggctggtgtcaaatcctgacctcaagcaatcctcctccctcagcctcctaaagttctgggattataggcaccagctactgtgcctggccaagagaatgtgcatttctgcccagctccctggtgatgccaatgctgccctctgtgctgaccgcacttgagtgtggcaggtggcaagagttgacaatggtggggagtgactgcaaatataatcagacatatacaaatataattagctcaccctttgataaagtgtgtaggattgggaccatgtcagagtagggagggaacccaggaaggggaatgtgtagctatttccttgtggcttcctgtagccattctgctttgaatcctgggtctggtgctgcctcaggcaggttatctaagtctctgggcttcagttttcttactatcaagtgaggaaagctgtagtgcctcccaggttgtatgacgatcagatgagattccgctcattaacagctcagcactgagctgctgcttaatagatgcatgacttaatagatgtgcattcctgttaccaggcggcgctctgtgggttcacttaccattgtattcagggcttcctttgtaccctgcactgcacggggctctgaggctacatcagggaactgtgctgcccttgagctgctaatagtgtggcgcaagagtgtgtaacttttctttgttaatggactccttgagagaagctattgaaggcaatagattgattctaaaaaaaaaaaaaaaaaagccacacgtgtaaacatgtgcacatgatttctgtggatttgcacacactcatgaatttcagggttcagaatcactgattggtggataacaaaagccactgttttctgaacagctgctacatgatttctgtgcaacttcatgccactgctgttctgtgattggtggcgagcctgggtggggaggacatggggttctcacaccctctcagccttatcaggacttggctctgagaccaagacaggctgtggttgacctcaaggtgtccttggctgtccctcctccagctgccactctccagcccacctcattctctggccccagccgaggttgctaagagtggtggctctgaaaaaaaaaggtggctcctgtgggctccttcctgttggtgggaatttgaaagaagggtagaatagataaaaaaggcctccagccatacgttaggagatgcagagtttggtcctagctccttcttcttggagctgtgtgtttctgtgtgagtgacttcatccctctaagccagtttcctcatatgggaaacaagggtggtaatccttgccccagcctggaggaggtgttattgtgacaggaatggggaggatgttttgtgcattgagaaaagacatgtaaaaatttgagggtgggccggacgcagtggttcatgcctgtaatcccagcacttagggaggctgaggcaggtggatcacaacgtcaagagatggagaccatcctggccaacatggtgaaaacccgtctctactaaaaatacaaaaattagctggacatggtggcacgtgcctgtagtcccagctacttgggaggctgaggcaggagaatcgcttgaaacagggaggcgaaggttgcagtgagctgagatcgtgccactgcactccagcctggtgacagagtaagactctgtctcaaaaaaaaaaaaaaacaaatgagggtggctccaccgtgctggcagctcaggcttattccttggctctaaaataagactgatgctatcgctttctctgagttttgggacagatctgctgatgatgtttgatagagtggggcctaaagtaggtgctcactaaatattagtttatgctttaaaagaagtagtacagctttgttcaggagctcctgaaagagagagggctggctgggttggcactctctagtctcttagagcaagtaaggcttagccatcacctgtggggacgggactccagggctgccagcctccctctctgtagcagatttttgttgagtctccatgaggcttgatgttcagggagagtcatctgggaatgaagcctacatggtgttctcaggtacctctcagtccccttggggagatggatgggataataagataagggctgggagagagaggctggcatagggtgtagagaggccatcgttcttctgcagagaagtgtgagcattgctgtaatcctcagtcaccagctctcagtgtgaagaaaagggaagctatcccacctccttcaaacagaggccccatctgaggttatcaatattgtcatttatttagtggcccagaaccttccattttaaagcacagtataaaactagaaggaggctagatttgcagtggctcacacttgtaatcccaacattttggaaggccaagatgggcagattgcttgagctcaggactttgagaccagcctgggcaacatggtgaaaccccgtctctataaaaaaaaaatacaaaaaattagctggggccaggcgcagtgactcacacctgtaatcccaacactttgggaggcagaggcaggcagttgggaggcagaggtgggcagattccttgagcccaggagtttgagaccagcttgggcaatatggcaaaatcccatttccacagaaatacaaaaaaactagccagatgtggtggcgcacacctgtagtcccagctacttgggaggcaaaggtgggaggatcacctgagctcagggaggtcaaggctgcagtgagccatgatcatgccactgcacttcagcctgggtaagagaataagaccctgtgtaattagaaaaaaaaaaaaaaaagactaagaggaaatgcccccaggatgtcatgtgaaggatcagcattttcctactgagaaaatagcaagccctcattgtaatatggatgtcaatacctggccctgtcacctgcatggtacagttaagtgtcactttgggttttcattatgtaaagtgacactttttcttcaggggctctctgtatattgaaatccactcagtgatgagtcacatgaccacaagctttcaagtaaaacaattcagggctaaattttgtagatcaaaaggacactggcagctttaggagaaatccatggactatcagcctgattttttcagtcaagtgtgattgttgttagagtcacctgccttgaccctgagtatggcatgtctgtgatcctcaccatgatcttaaagcaccatgtaagactgagcttgaactcagcctcatctgctcctttctgctcacattcaacagaaggcctttccaggtgggaggagaatgttcagcagagccacattaagggtagacttgggtaactcaaaatccctctacacttccaggcttcctgccaaatccttggccttgcattgcaattttctgggagcatgagaactcattccataaagccaatctgttcttaacatcctttgacattgatggtgatgatgccagggatcaggctttctgaagcacttaccaagccttgaaatcatttggatgtgggcagtcacgaccccatggaggagaatgaaagttgtaaaacctgagcatgctggagtcattgtttcccccacttctacagcgtctcctccacttacagacatctctgactttgtcacaactttgcatgtgtcctcacattcttccttttcacccgagtgtagtcccccagccagcagtctgcacctgttcctttcttaaagacgagaacctgtccatagtcaatcaataagcaggttttaactgagcaattactaattgccacagcacatcttgatgcccttcatccttacctcatgggcctcattctcactgacaggattttaggctcccttggcctaaactttttttttttttttttttttgagacagagtcttgctttattgctgaggctggagtgtagtggcatgatcatggcttactgtagcttcgaactcccaggctcaggagatcctcccaacttagcctcccaagagctgaagcaacaggcatgtgcctggctaattttttaattttttgtagcgatggggtctcgctatgttgcccaggctggtcttgaactcctaggttcaagcaatcctcctgcctcagcctcctgatatgttgagaggcatgagccacggcacccagccagcttaaacctttttgtccctaatcctttgacctcttgaattaccatctagtacattccttcctctgtgctgaactccccactcactcccccaacttcctgcttacaccttcaaccctctgtgcaatctggcacccacccccactgccctcctgaagttgctccctcagagtgttcctgtgacttctctcttgcctaatctaatgccgcctcctcctctgcttcaatttctggggtttttttttttttttcttttgagacatttaaccacccacttcttggagttctgtcttccctggttcagtggcaccttgtgtacttttctggttcatctcctgtccctcggattactttgcatcactttggggattcttttgccttgcagctataactgtggtgcccttccatgcatgactttagcgctttactctggccttgcttctgtccaccactgagctctgccatctccctggcgtcagccatcacttttgggctgatgcctccaaagttgcactcctgttagggtgtctcacctgggccccttcatagttcctctagggatctctagggcattcctacttgagtatcttgctgtcttctcaaagttaccatagtccatatggaagcagccatttctccctcccattcctaacccaattctaacttctccatttggcttaggccaggcttccagacttgaaaccttggtaccatctttgaaagaggcaagacaggatgtggttcagagaggactgctagagtcaggtggacattaggccacatcacagcttggctatgagctggttgtgtggccgcaggcagggtactttaacttctctgtgtattgatcctttaactattaaaaaaaaaaggtgataatagtttcttcctcatagatctttgggaggataaaatgagagaacgtaaatgaagagtttattgcattgcttggcacataattagctcagtagtccagaggcccccaagcatttatttaagctgttcctctggagcacccttcgcttcctgtgagtctgattggcttctcttctgagaatcggcctttgtcaccctgcattctcattgctggctcacttggtttttctgcccactagactgtaagctccctgaaggctaagattctggaatgctcaccttcatgtccacaaggcagagcacaatgtctgcccaataaataaatgtcatagcttggaagccagattctattaagtaattttataatcttaggtcatatgtggtatctttgttagtgctctatatcttccagtcttgaacaaaaataatctataatgtatacttagcaatgtacagcttcctgaacactttggcataagttatcctgataagtcctctcaccacattgctgtgagcttgccaatagaagtgttatccctgtttttggataggaaaactgaggcatggaaaagttaagtgacttcctcaagaggaatcgaaaactttcaagtaatgttagccccatcctgtggttctacctgttccttaatttctagaacagtcagaactactcagttgaccagagcacgatgtgcatacctctgcaaagctctgatcacactgttggcaaggcttttttttttttttaaggaccagatgataaatattttagactttgcaggccatatggtttctgtcacagctactcaactcggccatcgtagtgcaaaagcacccataaataatatgtaaaggaattggcatggttgtgttccagtaaaatcagcccatgggccaaagtttgctgacccctgctctaaacagaactaattccagttgagaattagcagacacgcttccccccagctagcctgttcaggagcgttttgttttgcagctaccaaaagagcttcagctaacaattgcttttcatttccagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccgggtatgtatattgacttagaggtccttcttaggcttcatcttaagctgtgacaagtgtacactctgagtacatgtgaaccccatcacaccatcgtctctgtaagccccatgagtgccagatcccccagaagctatgctccagacttggtgtacaacagcttttcccaaagtgggtgttggatgttataagtcctatgaataaagggtttcgtggtcaagtaaatgtgaggaaaagctgggtggaccaagtcagagagatttctctgctgtagaacttttcagaggctttgagtatgtgagtgttctagggacaatgttatgggcagtcttcattattgttctgtgtggagcatgttgagaaattcctggtccagggtaagagaatcctggggagagtgtgaggcccaaggtcccttttgacaggttcaggaagatctccctggatgggagatcacatgtcatccaaagtgagtagggaacactaagggaacctcagaatggattccgccagccaagcctccaggacagagcaggtctcatggcatccctgacccagctctccccggcagcacaggcctgccagtcctgcaggccctaaggaattccagggaacaggctccaatgggcaagaaacatttaacataaagctaggcaacttttggaactggatttgggtgaattccattcttttccatgtgtctactagaccattgcctgcaatatgttccactgtgatttccatttaacaaatatgtccctttggaagaggccaatagaaaccacagtggactaagcctcaaaataactcttctctggttctaagtagtaatatagaaggagagttattcctaagagaaatcacagctaccatttgctgagtacattatctcatttaagcatcactcatccaagtgagtaatggatactaatatcatttccatcttatagatgaggaaatggggactcagggatttgttactcatccaagattgcacagcttgtgggtgacagaatggtctgtctgactcccaaacccttacccctaaccgtcacgttggatggcccttccactcaccttctcatcagctctgtgactttgggcagtttgctttgtcattctgtatctcatttcctcttctgtaaagtgggagtgaaaatatctagccacctatctgtcaccttccttgttttatttttatcttaaaaaaaaagcccaaccattccaactttgtggttagggtgaaaactctggcagtggatgctataacgagttatgttttaatgtatgcattctaaatctggccctatgcaaggtgactcggatacattgctgttgaataatctagaatggttgggggcacagcatgataagcaaatatcctttgtctcttatatttctaggagactttccttcagtttggcacagtctatatatggagagattctatctaaaagtgaaattttaaaaatttaaaaatggatacctttcaagtgtatcctcatccactgttttcaaaatctgtatcctttcagccaaatattaccctgtagattgaggtttgggactcttggtttttctctttctaaaaagttttgcctttttaaaaaagataaatgtggctgagttttgaattcagatattgttactttccattttgattttgaaatcataggaggtctgaaatgtgtcaagatagtcatttaattttgctctttgcctttgtttttctacagaacactgagagatcaaaagactggtacaagactatgtttaaacagatccacaaactgaacagaggtactgattttcatttgtagaagctgtgctgtgctatgtgccaatacacgttttgtgggcctgaactcactttgctaggatgccagaagactgggtcctgcagttggacctcattaggtactggtctgcctgagcccagccatgcaccttcagagcacaggagggaggaagcacttgtgtgcctgcctcagaggtggaatttgagatctgctctcaaatccttcctcccagatgtggaatgcagcaggctgagcccagcactctgcctgtgctccagcatctgtctgcctgggatgtgagcagctccatcacccacctgcttccagctttaggtacatctccctgtgtcagcccatgactgccttgtgggcagagtgagttgagaatgcactgaactgggaattaagaacactgttctctggccgggcgcggtggctcaagcctgtaatcccaggactttgggaggctgaggcgggtggatcacctgaagttaggagttcgagaccagcctgaccaatgtggagaaaccccatctctactaaaaatacaaaattagctgggcgtggtgccacatgcctgtaatcccagctacttggaggctgaggcaggagaatcacttgaacccgggaggcggaggttgcggtgagccaagattgcgccattgcactccagcttgggcaacaagagtgaaactctgtctcaaaaaaaaaaaaaaatgttctcacctggattgagtcccccaagcactcgggtaaccttggaccaatcatgtacctttctgtgtttgttctgcttcctttcctccggagaatgtcacaggtctaaaggagaacacatttggccttgtgaagtagaatgcatagtacgcctctcaggctgtgttaatacgaacaataatctgccccagctgagagccagcccttggcaggtagccctgagagtcagtcaggagctgacacaccaaagcccgctcaagctgaaagagcagcacttccaaatcagatgccggctgggctatcagcaggtgacccagcatggagaaccgcaggccagtgcttgggcaggacatgaccccaccggctcccatcgctgcctgtgccgccagtcagctgataggcgggatgcagctgcactgtgggaagggtaccacttctcccacaggcagagcatcctgcccttccccttacccacatccagtctggctgcctgtcatggatgacacatgaaggcaaagagaaagtgttctggtcagtgttcccacctaagtgcaatctctctgatgagctgcggatgccagctaacatcactgttaattaactcctgctgggttcaaagtgaacctgggtgtgcccctgttcaaactgtttctaaatatcgaagtgctctaaatattgaggcgtttagcatttccaatgaagagtaaatccgctgtggttgggtggatgagcgtggtcacagtggtgaaactaaatgcttggatttctgtgatcagatggggtcatctccactcatcacttcctgaagtcactgcccatttcgtcttgcaatctgtgactctcacctttagacccagctttggaagcctaactgcagagacattaatgcatgtaaatgtgcaaaatatgtaattttgccccacaggcagctttggtgttctcatgttatagttcttaatctaaattgtaggtgctaaacaaaactacctgccttaatggtaggcagaggtatttgaaaaattaatgatctacttgtttgctgaatgtccacaatacaagctttgatttaaaaaaatcatgttaggatagcatgtttattacatactatttattatcatacttaatatttcttgcctatcaaaagtaaaaacctgatgctttatgttaaatgtttcttgcccattggagcctgttcatggcaattctttgtccaagaagagtaatggtattgtctctttctatgtgtctcggtaattcaggcaaaaggactggatttttaaaagcagtttgaatttctttcatatcactagtgaagcttagtatgttccagaattcaaggagcctaaattgtatgtggattcctactcgtttattctctccatttgtatcttcctctattctctctcccaaacctgctcctctgcctagacactcctgaagaaaacccttatttccctacgtacaaattccctgaacttcctgaaatccagcaaacttccgaaggtaccataaacttagacagcatatctgttgtccgagctttaaattaattcttatagttccattgtaggcataagatttgggcttttagattttattttcatagtcatttttggctggtgaaaattttatttcactcatttgcatgatgtgctatgttaaaataactaaatcctttctaattcattaatctatttttaagtgtgatgcctgtgtgctttaataacactaaaataggtaatcagtcattcgaaagagtcaattgggatttgtcacttcctctacttcctggtggatagtttcaaaatccactgcttttctctgctacagaggacaatccttacactcccacctaccagtttcctgcatctactcctagtcctaaatctgaaggtaattaaaggaaaattgtgtgcctctccgtactggtgctgctactttcttttttaccttggggtttttcctggtggctaagggctgtttcccagtcatttgcttccctctaaccttgtgttttgtggtggtgtctcactccttgctgactgtatcaccggagtctatccagatggtattttagtcctattcccctagggtttacatgattaacggggtagccagtgttagcttagttacaatgttttgaacatgtggggctctggtcaaagctgcctttacccaactacccaaggctttgtacctgaggtggtcacctgatgctggtggttgagcagtgactcagggaagctgagtcattatagcgggtgggcaggaggtagatctgtaaccgtcaacaggaaaattacccagttctcatgcctgcaactaactcttttcatgggccctcagggtatctctctttggtagggaattcctaaagaggtatccaggtataagattcagtcatagtgggagatgacatttcttgaaaataagggttttagctaagctggaaaacatttaatgaaagagctggataggaatttgtacctgctggggaagacagtcacatttgtgtctaagaaatattatttctggggaaaaagtctaaatgtcaaggaagtttctaaaatgtgagttaggggcaacatcttgagaattatcctaatagcagggattatctgatctttggatgagtaatccagatgagggtgaatagatacggtatggaggaggaagttttgttaaatactgttctaggatgagatgttgagtgctctgaacttcattcattcaagtagtattgaacacttgctgtgtgccaggcactgtcgttggaagtaatgccatgaataggacatgtaccccatcctcagaagttcccatctggcagagagttcagcaaggtcacttcagctgactgagtccagtgtgggggcagttgtgagagcgtgtgtccagaacgccacagaaaaccttgccggcacacagtgggccctcagcaatacctggaaaacagcgatgatgaaggctttggactgtggagccagagttctttcttagggatgaatgccagtgccaccatcttgatgcttctctactctaatctgctcagcagaccatccctctcagcccttctcatcattggtaaagttgttcattcaatcattcaccaaactcttactgatcagtcatatatgagatgacacactgggatgtgttggatacagttaaaataccataggccatttttggtctctcatatgccccagtaattggtttccaaccatttcatacctggggcctattttgaatgaaaagaaaggtctaccaaacaaacccagacttacagaactaaaagctgataatttaattctgatcagtgtcttcctcaaggccaagaagagtctatttggtgtagagagcgcagtctttctgtctcatgatactgattaccacacaaaagcattggtgaagaaacaactgactgagttgagttagggagttttttcagagtaattttgactagttgcaattttcgatttgtgctttatttagacttgcaaacccagccaaactcgtaagataagagtttccttcaaggcaacaagcacagagcatgcagaaggcacagtatcccacggacacaggcaaaggaaggcccacttgaagaaatcctgtggagaggaacagtggctcccatcagactggaagactgccttaggcctgccacaggcagcacccacagcttccacagtcagcttggctgttggtccaaagacagggtttcatggccgcacagccagagctcctgtgtcatcagccaccatacctagcaacccctgctgacgatcacgtctgatttttggcatgcatcaagtccagcatatggggaactggatttattttgcatagaggcataaacagtaagggatgtcatgataacttatcacatataatttagaagcaaaccttactatttttttattttcagagaccgaaaggaagaaatagtcttaaagaataaaaaggaaaaaattaggttggatataaaaaaattaatagcaaagatgattagactttaacacaagtttctaaaaagacatcctccctggagatcttttaaaaatagggtaaattccatctcacgcccccactcctgcctagatgacatatccgggcatagatcactgatgtattcaattagatcaaggcttcttacaagtgatggaaacatttgagctagatcatttaaaataatcacagggtttttggttttgaggtttttttttttttttttttaaaccatttcaagagagtctctggatttcttgatccttgatttgtggttttcatgttgtctgtgagctccagcagggcctcatcagccctgtccgtggtgctgctccagctctgtgctccccgataggtggccctgcgctctatgcacatccttcttaacataggaaagatgtatgcctttcaaagaaaggcattcaagacagatcagcaccaagtggaggctctacccacagatgttaatgtgcattaagaaacagcgttactgagaaatctgagccatcattccagagtctctctcctggggagaagtttgtttttactgctgggtttttttgtttggttttaattcagaatttggaactagaattatttgtaataaacctatcaaagcctagcctaagggctgccatctctgtctaaattctagttgtttatacagtataaaaaagacatttctaaagctctcaaagctgatcctcctcaatagtaagggactgtgtgaaagtttgtttatgctggcttagcaaccttcttttttcccccagctacagtgaaaaagcaaacttttggccagacttttagactataaatagagttatcatgtctcagtcaatgagggttaaaatgttctttttaaaaaaagaaaactttggaaattccaagaaggggcagtcacttttaatcattttgtaatcttggagactgctgtctacgggatggaagagatgttagcagaagggagggggcaaactgtgcagaaacagcttcagaaatgcagtcccccactttcttccctgctgctttaaggaacagcagtgtggtggccaacatctcagcagcccagagtggtaatcctattaataataatagtcttataatgacataaccaccacctcagtgactatgtggctgtcattaattgagcccttgccacatacaagtttctgtgctgaatatatcactattgttatctcattttcattctcccagcagccccatgaagtaactcttcattttatcaatgaggagtatgaggttcagagagattaagtaatatatgcaagattacacagtaagtagcagaaccaggattcaaacctaggtgtttggggctccattaacacaggcttttactcaacgctgctatactgccctgcagattcctttccccttcctgactctgtgttcttgcttgtccccttcttgtccagaggctctctggtatctgactgcaggcattcagcttcccctgagtcagtcctgcctcagtctgctaagccagtacctcccagatggtgcctggaaatatatagttagggacccagcacggtggctcatgcctgtaatttcagcactttgggaggccgaggtgggcagatcacctgaggtcaagagttcgagaccagcctggccaacatagtgaaaccctgtctttactaaaaatacaaaaaaaaaattagccagtgggcgtgatggcaggcgcctgtaatcccagctacttgggaggctgaggcaagagaatcacttgaatctgggatgcagaggttgcagtgagccgagatcgcaccactgcactccaccatgggcaacagagtgagtctctgtctcaaaaaaaaaaaaaaaaaaaaaaagaatatatagttaggaaaactcctcaagtgattgacagacaggattgagaaccactgggatggggaaataccactcttcccagcccccaaaaagagatgaagaaaattggccagatgcagttttgggaatatggatataggatgagaatggagaatgcagattttatagaattagcgccccctactctgaacacgcccaaatgatgttggctcacttggcacatttgatgtcaagaagagggaaaatattttcaaataatggctcagaatttgcagcaaaaccagataactggtatgttacttcatggtccgtggcttctcctgactttccgtgacctgtgaggacctcctggaccatgtcagtgagaaggcgagtccaggtgaagccccagagaccagcttttttcccatgctttgtgatgcctcttctaccacttcaggctggtggtggccactgccacctctcggtgatgtcactcaagacaccacctctaggcatccccaggttgtggtgtcaaaatggtctgtctcagtgcttcttcctcattcctagaagagattgcactaaggcaaggatttaaagaggtgcatcttctcaggcacagctgtagttgagttaaaataattctctactggccttacaggatttgtaagaatagctttgttttgtttgagttcaagcaaataattctattgtgaagatgcttggccgggatctgtgcctcctgccccagactccagccagtactgcccaggggagagtctgagtcgttctcctaatgagagcttcccaggagatctccgcctagcaagtgcaaaaggcattgactggcctgtgggacagttaagaaacggtagcagttactccctttccaccttcacggcccaggagttcgatagcagatgaagacggtgagtcttcttctaaccctatggttctcccaaactttctcctttaacttattttttgccccacctcattctcttcttcagagttctatttttttctctgtgtcttctataactactgtacaccctatcctggtctttttttttgcattctttagaacttgattgccacatctgtaatcccagctactcaggaggtcagggcagggggatcacttgagcccaggattttgaggctgcagtgagctacgatcacaccactgtactccctccagtctgggcaacaaagtgaaaccctgtctcttaaaaaaaaaaagaacttgatggcctttaactaaaacatagacagctttgtaatgctttcccccaagctctctgggcttcctgacgtccttgcccttttgtttgttcttcctttcccaccccacccagactcagtacccaactctacatctgtgtcttttcccctgactactatttttgttcatgggggtcatgtatgactatctttacccttttatcctttctcttcctaagtgtggggggtaaagccagaggaggatttaggttgagcagtggaagaaagattgtgtcaaaaatgagccattaatatttggaaaattgttttaagtttaaaggcctgagaaatgcataaaattgaaatttaattgatataggcaagtggttatgcaaatgatttttgcccatcctcccattttagtcaggcaattttttagaacaactttcaacaactactttcttcagttgtctttgagatttttataaattaaagaaaaagaaacaggaaaaaaaagtgatttggaagctcatttaaagtcactgtggttgaaaaggcaattatgtggctcctggcagttgtaggagagtggctgtccccaaatcgagctaccaaggacagattgccaaagcccaagaagaatcattgtgtaaacattagagctcagctggaccttcagaggcctaagtgagttgtttaccctgtgtaaatcccatgcagtgttacagcttcctgcaaatcactggcataggaaggtctgagtgttgctgccaaggtttgatgtctgctgcttggagctctgaggagcacaattagcatgtggttccaccatgagcagaaaccacaagatttctgcacagctgagcccactctagcattgttttaaagggcctttggagaaatactgaaggccgagcttcaggtgctaggtaatagacaatttgagaaacatttcatttaatgtgtcttaactatattgagcacacttgtcccatttggctggctctagtgtggagaaatgcagacatgctccttacactgttttcccattccttggtatttctaactgcatacccatcatccccagtgttgacttagcctcccaggagaaggcagcaaggaacagcaactattaatagaaggtgtagaggccgggcagtggctcatgcctgtaatctcagctctttgggaggctgatgcgggtggatcacctgcggtcaggagttcgagaccagcttgacaaatatggtgaaaccccatctctactaaaaatacaaaaacaagctgggcgtggtggcaggagcttgtagtcccagctactcgggaggctgtgacaggagaactgcttgaacccgggaggcaaatgttgcagtgagccaagatcgcaccactgcactccagcctgggcaacagagtgagactctgtctcaaaaaaaaaaaaaaaagaaaagatgtagcaagagtgactcaatgttatccattgtccctggagaccagcaagaggaaaactagaaatgtgaggcaactcagaaaacttgcttaaacatcactgagggcgaggggatgcaaaaatcgggcaaaggcttcaggggctggaaattggcctggccagcagtgcagtgcatgccttgagtttcaagacagcatctttctctgcctcttccataataacatggtaatagaatagccagtctttcagctttcccaggattgggcagatgaagctggggtgaaagaacacagtaggcatctctgtcacggggctactagatgacatagggaagtggaatctgaaagaccttaaatccatttctgctttgtctgtctcactctgcagctaagggcaaatcttctcaacctacttgggctttcatttccttgtctgtaaaatgaggtatttagttcctcttggagttttttgcaagggtgaagtgagatgacgttagtaaattaccagccattgttagtcacttaatactgggagctacaattattatttttattcataagctgaggtaaaatatccttccattagatttacaagacaagcatcgaaaattaaaataatggattttacaagccctagaacttgtcctgtgttatagttgttcagatgaatctgtatgacttgtttgtcctgttaaaagttcatgagctgaaatccacatatcagaacctgtggaccctttgggagaaatgaaaacttgttcacagatactctcctgccctgtgttagcctggcgtgggtgagatttctctactgacactgaataagaaacaagtgttttttgttttttttttctttagagacaaagtcttgctctgtcatgtcacccaggctggagtgcagtggtacagtcatagctcactgcagcctcaaactcctagactcaagcaatcctcccacctcagcctcccaagtagctgggactgcaggtgtgtgctgccatgcatggctaattttttaaaaatttttttgtagagatgggatctcgctatgttgcccaggctggtcttgggtttctggcctcaagcaatcttcccgccccagcctcccaaagcactggggttatagatgtgagccaccaggcccgtccaagaaaggagctttaagcacattcagttcttcagacgcctctgttacctgcatcccccaactccaactttcctgcttctccctctccttttcaaagtacatacattgttaaacttcccaagtagtgctgtttttttccgcatcttataagaactatttctcattttcttcttcttactttttttttttcttttcaagacagagtctcactccatcagccaggctggagtacaggggcacaatcttggctcaccccaacctctgcctctggggttcaagcaattcttctgccttagcctcccaagtagctgggactacaggtacatgccaccacgcctggctaatttttgtatttttaatagagacggggtttcaccatgttggtcaggctggtctcaaactcctgacctcaagcgatacacccacctcagcctcccaaagtgctggggttacaggcatgtgccaccacgctcaaccagtatttctcattttcttctaataaaccttctagagttccacattagaaagctctagatagaaacattttttaaagagctcaggcttaaaaaaaaaaaacaaaaaaacctgaatatttaaatgccactcctctccacccagtgaaaactttgcttcttacttcatgaaccaggtaatagttataaattaaccttcatcttatcatctactgataagctataatttctccatgattcagagatgtacagggttttgagctaaaatgctaggctacgttttaagcagtgcatacatcagcttctaactagctaacttttcatttgggcattttcattgcagcattttttctaatcaagtccctgtaatcaaagctcatttttagttttctttgacatcatggcattttgtcagtataatcagacgttctgtttaaaaaaacaactgtcaacacacaatttttcagaataatctttcaaaaaatctttttctggatcccactttatctctttcccctgttctattttcagaagataacataaataagcttacacactcaatttaaaatagtgaaaggcttggctatgttggtagaaaaaaaccttaagccctgttcaaccttgatattgataaattcttgaaagtgagggaaggaagtaggggaaaaggtaccttggtacccgatgcctgtcccttatgtgggccaagggagacctgagacaaataaaaatggggaaaagaggggacaagaaggagtgattgttagagaggctgtctgaataatgctttatcaaaataatagcaatgttagcttatttatatttcataaaatattctggccttgtctcttctgaaacttaaaatgatttgcatagaaacaaggacttgattaacacgaagtcaccaccatacagtggattctttgacttgtctttgcaggttagttcatgtgctttcctaaagttgtcatgaactttagggaaggaattgggtcttcattccatgtatgtgaattttgaatccagattagcaagatgttagaaatgggaaaggctaactatttcagactaactctttttggtgtagtgctttggagggaccatcatggatgtagtgactagataaagtgcattttcaggacagtcccactttaaaaacctgttcccatcaatgtgcctgtggtctgatttttagttcagaagatacagccacttccacaagggcttcaggtcttgtataggttctgcaagttttagaacccagtgtctagcctacgtaggaatgtgtgtcatgcctttggagagccacctcccaccatagagacacgcgtgagtttgatttgctccagagatgcagtttagatactcactccgagtagtacctttgcagaggaagccgtttgacgatgggtctgttgtgttcccaggaaacaaatctactcagggaaccagattgaggtggaatcaaaacaaattttgatgagggttttctcaaattcttctcttagctgcagaacttctttgttaatgatgtgtatgaaagcttaccatataaaacaggtcaaagctgaggcaagaagctagaaaacccaccctctgggcctctccttcccacccaatagcagcccgaggccccggtaagaggcctttcaagacactgttgaactcggtgagcttaaccgtacactgagctggtgcagccggggatccatctcagcccctgcttcccactcagccagacccagaccctgcattccagctttggttgtgtggattctctagagaaggacccttggctgtttgtccccatgcatttcttgatgtcaggcagcagcatctgccagttgtgactgtcctgcctggactacaggtttggttgggtgtgccctacaaaccttgctcctctcaaacgtgctctgccgtggtgtagcttctggcgcttcactcttctgtccgctgggatccctaggggggctggatgctcgtaccagactgtggaaatggggaacatacaacttggttctcttaccttagccagacttctcctgactacattttgttttgttcaatagatgatgattcagatctgtactctcccagatactcattttctgaagacagtaagtgacttcaaataacctggttgtgggggcggaagggaaagtggtggatgagggaagataattgccctgttctcagttttcatgagttttaagtcttttgtctgcactgtctttctccagcaaaatctcccctttctgtgcctcgctcaaaaagtgagatgagctacattgatggtgagaaggtagtcaagaggtcggccacactacccctcccagcccgctcttcctcactgaagtcaagctcagaaaggtaagtgcccgcttgtctctcattcattcagcctgggccttgttgttcattgagacctaggagcctccattcttaggaatgtggaatttgagtctgtcccttgtcacctattagcagtgacttatttcttagcctcaatgtcctcctctgtaaaatggggataaaaatagcatgattcctagtaaggatagtgcaaggttaaaatgagataatacctgtaaacattcctggtagcacttagctcctagtatgggagccaagttaagagtatgggcttaattaatattgactatcattatcataactttttgcattttcacaagagaaatcttaactgcaagatttgtcacatgttgtcatattctttttgcatactgtgttcacatattcatagcaatgactataacttaaaaagaagccacactttttaatgtccatttactcatgcaacatgtattattgagacataagccttggacttgttctagtgacagcattaataaatctcttaaaatgcctgcagcaaacaaaacagttttctttttcttgagttttttttttttttttttgagacggagttttgctctgtcatccaggctggagtacagtggtgtgatctcggctcactgcaccctctgcctcccaggttcaagcagttctcatgcctcaggctcccgagtagctaggactgcaggtgcacacaccactcacggttaatttttgtatttttttagtagagacagggtttcgccgtgttggctaggctggtcccaaacacctgacttgagttcttatctctaaaaatgccctctgaagcaatctcctcatgctatttggacaggagttccatgcatcttctagccccaacttacaccacttctcaacacacaaaaggctctggccaaacaaaattatttacttcttccttaaatacacatccaatttcacacctctaccttttccaacctcacagacaaattaatggctgtttttaaaagcaccacacgaacttaagtggcctctacctgaggagtttgataattaatttgaaaagaaacctgggtatacccacaaatcctttatagttgccttcatccagaacccactgggtgtattccctgcagatttaaccatatatcatggaaggatataggtatatataaatcattgtctctgccttcaagaagtttacagccttgcatgaaaaacttaatcacagtgcaaagtacggtaatgcacaaataaaaaatttgcaaactagagcttatagtaaacaaaacagcttggtactagcataaaaacagacatatagaccaatggaacagaatagagaacccaaaaacaaatccacacacctattgtgaacttattttccacaaaggtgccaagaacatacattgggagaaagacagacccttcaataaatggtgctgggaaaactggttatgcagaagggtgaagctagacccccatctctcaccatatacaaaaatcaaaccaaaatcaattactgacttgaatctaaggtctcaacccacagttacctcttccctattccagtgtggaacagggaagaatgcaattatggtagcaactgacatttattgtgtggttactatgggcctggcactttgctcagtgattacatgtgctgtctcatgtaaattgtttagtccttacaacaaccccatttttcagatgaggaaactgagataccaagaggtgaaatacttgtctaagatcacctagttagcaaggggtgtggcaggatttgaaccacagtcaactggctccaggacctgtgttctctctcactgctctagtgtgaatgggaagtacaggcatgtctgtggaatgaaaagcccatagagcgaagcaaggtgaaagatttttccagagccagctttgctgctgccgcctctgttcctgttgctttgtccactccccttcctggtgcctggttttgagcacaggacatctcaagccttgtgagaagcgaacaccaaactttaactggttgttttgagaagcaaaccaacacaactaaattgttcaccctgactccgatgttatgctttggatataacagttctttgattacactacagccatccaaagtcagaccgtgtcggaagctaatgccagttgtcatgaaaatagctctaatagaattttctttctgcagaaatgactgggaacccccagataagaaagtagacacaagaaaatatcgtgcagagcccaagagcatttacgaatatcagcctggcaagtcttccgttctgaccaacgaaaagatggtaatgtgcatattaaagttattttgtctcaccgtgcccatgttctttaatcagaatgcattgtgcagttggattacattctttccccttgagatagacttaactttgttttgaagataatgacaaaaatgaagtacttttacccttttcatttttgcaggtgttcataaaataagtcccgcgagtctgcttttaaaaaaccctcttattgtggctctgttgctttttttgtgcatggttttaactaatattaatttttctactaacataaagattgattttgctgctgtctttttttgaatgtctaagtgttcatttatcaggcttgtcattaagtggactgaagtccagttttttttaagtgactctgaacaggcataaattttgtacaagttactagaatgtcattaaaagctacataactaataggatgttgtgacttggaaaaaaggcccaggctgttagaatatatcctttaggtcttccttttttgacaagtgcaatattgaggacaaatttcatattcgacctggtttatgattccctatacaagtttacatctctaagcaattatgagtggggaaaatggtttgtatgcatatagcagaccaccctggaaaagcggcctcttctgtgaaacaggaagaattcttacacattgattagtttcatacctgccaatcatgcatccttttattaacccttcattgggaaaagctgttttggaattgtgatcctggttaaggggttctccaaagctccataaacattgcagtcctccagcaggacagcaggatggaattattatgctggagtttggtttttattaaaatacggtcaccacaatgtctacagaataagcaggcctctgaaatgcaggctcaaattatgttccctccgcctcatcggctctacatgttttgaaagaagaatcgatttgacttctactgagataaaaatgtgacatctctaaaagcactgaaggataagtcattttaattaggaaaaaaggtcaacaggtcacagaaatacttagagttgtcattcttcagcgttcactatgcaccagttatttcaagcagaaagttcagagaggagcacagaatttcgccttctccccactactgcccttctttggaggttctctgctgttagaagatactgtacgtaagaaacatagaaggtaaccttgcacccaggtgctcctgcaaagaaagtcgtgctccttgggtttatttccaacactgggacccaccattacatattaatacatttaaatgatttcagggactctgtagacctttgagtgtttttgttttggcagtattaccattcatagattttcatggctcttaccgaaggctcccttttcttaatttctcctttgtttccagctcctttccctggttcttagtcatttaaccactactcagaactaggaaaaacaacatagtttagtttttctcattgataccgcaatagtttaccaggatcttccataccacagttcttgggatcatttacgttgtttttacaaaccctgaaaagtaacacatagtgccccacggggccttcttggagaatggtggtgagcacgtacatggattgcaaagctcctctgtgtagtaccaagccctaagccaagccactaatggggcatgaacaccaaaggcaggccaaggaggagtaggaatgtccaatagtttcacccagtttagctctgttcctccaaagagaagttttagttgaatcttaatcttttgacagtctgcccttcacagtagttgaattcatcctttatgtttgattttgtttcctgctgtttttatcacatggacagaaaaggtgaagtgtgagtttcagcatgtgagtcttggcttttggtatctagtatctggtttgccagaatttgagcatacacccccatcgccccaaaacacacacttccgttgttaactgtgggtaagtatactaactagtgacagatgtagaatgtaagtctgctctcagatatgcactacctcattttaggagaaaaaatgctttttccatttgaggtacttacgtctgcttaactctggcaatttaaattgtgacttcataggcacatctatgcatggttagcaggagaggttgccctagagctcaccttgccctggagcatactctaaatcattccagaaagatgaaagaaacactgtactgccttcaaaaccccctacagaagacttacaaacttgatgacctagtcatctatttgaaagactcatatgaaggtctttttttttttttttttttttttgttgagatagggtctcactctatcacccaggctggagtacagtggtgtgatgatggctcactgaagccttgacctcccaggctcaggcagtcctctcacctcagcctcccaagtagctggggctacaggcacgcaccaccatgcccggctaatttttgtatttttagtagagatggggtttcaccatgttggccaggctggtcttgaactcctggcctcaaatgatccacccacctctgcctcccaaagtgtgggattacagccatgagcccgtgcctggcccagctaattttttattttttgtagagatggggtttcaccatgttgcccaggctggtctcaaactccttggctcaagcaatctgcccctcttggcctcccaaactgctgggactacaggcttgagcgaccaaacctggcacgtatgtgggtctttatctctacttggtcccctcttatcatagtaggatacttttttctcttctagccttggaattggagatctattggtcagtccttgctttgtcagaaatggcctttttcaggactcattcttttataccttcctctaagtctcttacagaagttcagttcagttaaatatatacatacatacatacacacacacacacacacacacacacatatatgtagtaggacggacagatattaaaagagggattacagacacagtgtacattttagaagtgtaaaacaaggggatttccccagcttggtttcttcccagttcatcctcactttgtgttcctttcctggcttttcagcatggtcatttagccctgctttagcttggtgtcatcgcaaacttagtgggcctgcccccctgtcatgtggaatatgaaaaggggaatatggtatagtgtaaagaacactggactaggaattggaagatggggtgggtcaaatgtgataatatgggtacaataactgaatattatgaagtgctacacagacataccacattcaggcgacttacttaattggaatttgaagctggtctctggcttccattcaagaagcaaaactgtctttgaggagaagttggcatttttctggtgagttacctgcccttttccaaggattttttttgagctgggagaatagcctgtggtactaaagaactttgccaggcattatggaatttttccctgtctgccaggccagagttcctgctctgtgtccagaaggatgtttttctattggtctgttccataacaggatccacagctgagttatacttggcaaaatcaaatgcagatgtgagggctgtgtggtatcacctttttagctttatctctgggcagctcaaaggactgaggctggttgctctcacccatcgctgtttgacataacctcctgattctattattgtcacagcattaacctccacagtaaaacgatctgcagacaacctttgggaataaaataagttaattacttcaggatcatgagtaccaaaactttcaggcagttccccgaaagagctggtacattttatttaagaaaaaaaaaaaaaaagcctaaccattcccagagggcagtttataaatagtctttgtaaaaataacaaacatgaaatagattcatgaaaccccatcatattaggatctagaaactcccaatgtctaaattgccactactgagtagttgtgtttttgtaggtattgtacctcctttcactgaattgaataaatatagaatccatttactacagggagggcaaggcttctccttcaggatttaaaccgtaagtccctaaagacatttggaggaagtcttatctggatgcaggaggacagaccttgtgtttcagtatgattttccctccgatttcaacctagcttggtttcagttaaaagaaggttccctgccatatttccatagtcctctacctgtagcaaaagtgaaagtaatgctaaagattcttttaaagatcttagaaaaagggatggtaaaggtcactaagaaagttagcagccatttttctacaagctgcaaaggggatgttaactgtgttgtaagtaaagtacaagaagagctgctttgtgaagcactagcattaaagacctgcacaccacacatggcaaccccctccctcaggtgttatagcccagaagtagtgaagtttgttgtgcagtgttttcaatctcagtagaaagtgtatgcattttatatttcaggttattgtagaaaatcaccccaactctctttttgcgattatcaatgttttttgaaacatatatacatacttaattagtcatgaacctcaaacacttttccctgatgtaaacatttctccaatttatgaaggggaaaacatgatttgctttgcacacattcattttccaactagttatttccagaaacacgtgttattccatgaaataaggtgccagaactttatacttatttggttaaatattatatcccatgaaatcaaattatcagtctattgatacctcatagtgttatataaagtgagaaatctaacttatttttgtcatataacccagaagtttttttcccctttgttctgttatctgtcttgtctagcttttctttcactttattttttcccaattctttaacatttatttgttaaaacacgaagtatattctgtctgtattcatccgccatggatacttgtttaaaatgttttttcactgtgtcctctgtctttacttatatcatttttcactttcactttactgtgtacgggacatggtttcctacctactcatgtgccattaaagatgcagtattaaccaattggcttttataaagtgtcaatatttgtgtttatttcgaaaaccttaaggcagctttgcaaataagtactaaagttgtactagcccataaaaatcagctctactcaactggcatagatggctaaatgtttggtgtgctcaccaggtcatttgctcataactaatagttctttgtaaagggctttcttttcttccacattactgaaaattattgcagaatgctgttatgcccagattcagacttgttgtgtaggcagcagtgtggtgcagagttgtccatctatagtccattttcctctgccttagggctgagaatgattcacttactgttccctgcctcaatttccctgtttttataaacccatcctctccctcctgtttttgctgttgtcagtaaaaacagatgattgctgctgttgaatgcagctcctgtatatacctggaaaccactgcatctctactggcctgttcctatgtaatctttgcataatgttatccttctctttcttccatttctctatcaccaacccctatagagtcgggatataagcccagaagagatagatttaaagaatgaaccttggtataaattcttttcggaattggagtttgggaaaccggtaagtttaatagcttcagtggttatacaccttttaaactaatgctgtggatgcgttgttgctgctaaagaatcagatgtttgtaaggaattcagaaagtggggagcagtcatgttggttgtccgtagtgggattgtctcttctcactacaacctctgagctttcttttgccttacttcactgagaaaggatagtgagctctggaagtatatcttgctggaatatcccagagaaacacaaataatcattgcttgtcttagacctccccccactaacaacaagtaccacatgccttgcggatggcattatttcagccattgttttcacttccttgaccaaagtctttatggtctgtgaaagacaagctgaaaatgtgttacacactgagaagaccagcattgtctctgctttaaatagcatttttaaaagcacatatgtaaatgaagtcccagagcaggccaacaaggacctctttgtgcagatgtgacccacaaatgcaaccccattataggtgacttttagggaatgatttctatgatgtaggatatttcccaaagtttgaaatgggagtaaggaattctagcatctttagtattcagcctacagttgccccatgatatctctgaattggctttggtacaaattgacttttggcacttaaaggaggattttcttagccttgcacccaaaggaatataaaatagaagggagaattgagctcatccttcctctagagataacgaaactgactttaaaactctagttattttaaagtcttaattattacagctgcaaaaagaatttacaggtagaggagttaagtgtataaacacattttattcaatgattgtatgagactttatgcattggatccagcttttgagtttctgtggtctgggatgatagttttatttgcagacaggaatgtattttatagttgagtaaataaaatgttttaaaattttttattaaaacaaagacaaagagaaattaagttggtgcttaggaattgctctttgatttggcagtgctgagctttgaaagttcaggcatcttctgagttaagagcaccagacttgcaaacagcctgcttgttcctctcttctggtccctcctagacactgtctcccgatagcagctgagctgtcctggatgaacagcgccacctagtgaccagtggagagggacgcatctgacccaaagtctgcaccctccttctcccctccccaaagcattggtgcacacctcatttcttctcctttctctcctttctttttttcgcctctgctgttcaccattcagacatcagttaaatctacctcaggcaatcttttccacgtgcagtatttaacagtatcctaaccctttctcttttctccttttcttaaaacctggtcaattatgtcaccgaaaaaagcttttgctgtgtgtagttgtctccccacccccaaaacagaccatgattggtatatgaaacaataatgccatactttagtcaaggaaagcaaaagctattaagttatgtttaatagagtccatgccgttgatttttcaagtctgtttcagaatccacacatttctgcccatctcatctgccaaacaactaaattagttttatctaaaatattagctttcaggaaaaatggtggaattttttccctaattagttgtgattgttttactaaatctatcattacaaataatttttgaggataatatatagtattttaataccagcatacatttaaatagtctccatgcatagcttgataaattaacagtattgctgccaaaaacttcactccaggtaccacacagctaacttcaaacaaatgttgagaacacagtccagttgtatactggggctttcctctagcttgtctccccaccccattgctctaacaacctcttaattatttaaagactcagagatgctttttcaaagtagcattttctctgaagccacatgcattctttgcacaggcctcagagttcttctaatgagactgcttctttttgtgtaggtcttactttaaaagataatacttgtgaagacttgccaaattaactaaatcaatgcccatatcctgaggaacagtcctgaaatgaacagctccttatggtctgaggcatcctaatggtgggcttattacctagttgaactaacagggtttgggaggaaggtgtggtaaggataaattttttcttcacttcctactgcaaccactctgccacaaaagagtaagagacataaataaaagtggcataaaccatggaagctgttttggaaagcttttcagccattcagaagcagaatcaaaatcctaccagatcatgggaatcagcatttctactttttttttttctcacaccaactggggaccactttccccagtaaagcctgccagaactttgacactagacatttaccctgaactccttgcttcctccaccccttcgctttagccacccaaaatgaactgaaatttcagcaagatcctgactaaaaagatacctttttagctccaacaagttgttagaatagcaaatagttcaagactccagggaccatttttggacagattatttaaaaccagtttaatttgtaaacactgccctgtttattgcagtaaagaaatgatcgtaagtcattaggctttaaaaagtctacttctgcagatgaacagtccaagtgtattaagtgcttaaagatgaatggtaattggtaatatcacttactttatgaaatgcggaatatacatgtgcagagatgacattactgacctgttgctgtcagtggtgaacacaccttggaatcagattacttctcatttgcagatttattacaaagagcctgggaatcagttttttttctgagttgttttcctctaatttctatagaaattgacatgatttctatatgtaagagcaagtcaaaatttcacaatgtaaaccaatttgaatgcttccatggagttggctataatgaaatttgcacaaaattttaggagctattaatgatctcctatttcttatcaccctaggggtcattatgtaagaaaattcaagtctaaatagacagaacaagtagaagagaggatccagagttagaagtcacctgtaacctctgaatgttccacccgctggactcttccctcattaaacttacaacaatcttttggcaaatttctgtcttaggaatgcagctgtaaatctgacttgaagagttaaaagacaaaacaaaaataaccttacagtcccctctttaaattctgggtttaaactctgttctctaagggggatgaaaagtatgtttctaccactatcaaggtctagttaaactgtaaaaggaggttttaaaactactggtatgaaattgtctagtgtactatttaacacccattttatatatgaatttctttgctacaaaccacagaaagtaaatttggttcagtctgttgaccaaacctctagattcacacatgtgttaatacacaatgaattttacagcagaagactgcctcaaaaatgtggaatcttcagtgtcaatcttagtttgaagagaacaatgaggaatttaaaagtttctgtttttgttcaaatttgttaatgctttttttttcttttttcccccccgtcttttcttaagttttcaatatttagaatccaacgatgatttgctcttgaaacatagacatagaaacagacttcctaggtaacagtcccagctcccaaatcctcaggcttccgctccagcaggcagccttgtgtccgtaggcagcacccactccccttgcttttgagttcacctttctgtgttgatacagttctcccagtgtacccctccttgtttgagccagtctccatgtttgtctttatgtctttatgctcatttcttcatttcctcctctgcttcccgtcagcctcccaaaaagatatgggattatactcctggagactgctctatccttcctagagaggatagaaaggtaattccgctgtgcctcctccgttggactgtgtgtgctctctagccttggttagtgtgagtgtgttgtgggtttgtttgtttgtttgtttgttttcttaaatcacttttgaaaaaacttgatgcttttttttttttggttaggtaataaaactatgtaacaaattctctaagacatatactaatgtttagaggtttttaaagcaattacgtattcttctgacatatagtatttgtcactgtcaccacactctgaaaaaagagaaaataggcatttccttaaaggtaggtttttgtagttctccgtagcaagtagaatagctttttgaagctctgatgacttcaggatttctgctttatatgcctaatgttacattctctgttttcatgtcttcaactaatttccagtgagctcttgtgttttaatcatgctatcttggccgtatgaaagtataacactaagaaaaaaattcatttttttcaaacgtaaccttccattctttctccctttcctctaaactaaaaccttctttcccatcttttctttcttgaaccagactaatctagacaaagatctcagcctctgccagacagagttagaggcagatttagaaaaaatggagacgcttaataaagcacccagtgcaaacgtgccacaggtatttcctagtttttctcatgccatcagttccttttcaagctgtgctttgttttcttctttgttctatggtttttgatgtagttgaggtgacggatggtgatgctggctattttaggctgcatggctttctgactactgttttagactccttcccccacacctacccagttcatttttgcttggttttcttttgagcttggcatcttccttaaaggggattcttcaaatatatgcagagaggctgctgattgaaactactctcccaccttattctcttcctctgctttccaggggcgaccttttaagttcccttcctttgcctctgtctgccttctctgaattttcagggagccatttttggcagtttccatgtcttttttgcagccctgggagataccaacctcaaagatcagtttcaaaaactcagcagcagtgctttgggtaccctttctgtgcatggtgctctcagagtagtagtgtttgtcattttaaagttcagaaagttctcaatgaaaaatgcactcagaggtcagatggcctggacacacaaaaaaagtgtttgaaactgagtctgccatgatattttaaagggagctatgtcaaaatgtggtttattaaagggtatacgagagagagtaagagagagagagaaagacatcatggtaagtaggtttccaaggaggaaaaaaccaaatgttcatagaactgcctggagggctccctgacaaaacaaaagagactcttaaaaggaaaaggtatctttagagaaggtacaaaaggaggccgggcgcggtggctcacgcctgtaatcccagcaatttgggaggccgaggcaagtggatcacttgaggtcaggagttcaagaccagcgtggccaacatgatgaaacccagtctctactaaaaatacaaaaattagccaggcatggtggcaggcctctgtattcccagctatttgggaggctgaggcaggagaatcgcttgaattcgggaggcagagctgagatcacacctctgcactccagcctgggtgacagagcgagactccgtctcaggaaaaaaaaaaaaaaaagatacaaaaggaatatggagctgaggaggccaggaaggtccacaaaccatgacaggaaaagtggaaactgctgatggacccatgccacacttaagcagaaccaagacagatctccagccccagtgacttgggcacaaaagtcatgagagcagcagagactcaaaccagggaaggggtgaagagaccggggatttggtctggggtaagagagtcaggagccaaggagctgcaggttgcttgagggtgttaggaattggggatccagagacagcagagcatgaggaagccagcagggccaggggttaggctcaagctctccctcagcacttgaaggagccaccagaggcactgcacacatgggtgaggcagacaggtgatgggtggggcaggtggggtggggttaggggctgagtttccaattagggtgaaggaaccagattagccactgtggaattgaaggtcccaggtgagaagagatcacaactagccctggagtgagaatggtgactgtggctgtggtgagagcccttgctgggtgtgccagcatgcagtgaggagggcagatgcaagccaggtcactgaggatgttgcagtgggatagtttaattaactggtgtaaagagcaaagaattgggggatgggattaagacaaagacaaccttaaggttttggccaggcagatggaagaatgaggatgtgagcacgtcacagaggacagctgggaagaagatcagggcagaggcaaggtgagggagttggctttaggtaattgacctttgaggtgttggttgggtgtcatataggtaatatccggtaggcagttggaactctaaaactagagttcttggaagaggcatgggcttaagatggggattggagtcacctgaggagaggcgatggttgaagccctggggatagaagaagatacccaactagggagtagatgaaagactgaagaggggattgtgttgagagaaaggatgtgaaaccaagaactacccatggggacgttgggtgatgtggaacaggagaaggggagagggagagaaaggagagttcacagaggcggagggaaaagcgaatgatggagcaagaggagaaagcatgagatcttcccagatgtccagaaaggtggactcccaggaaggtcagtggatgtgatgactaagatgtttccaaaggctttggaggttgctgggtgagtagttcttgggagttagagtatatggcaaagaatctggagcctgcagaggtacagcactgagtgaaaagatgtggccgtgggaggaaggaagggaggggagtgttcccagaggactctacagggtcaaagttttttcaaggtggaagactggacaggacaggtgttcagagataggagactcaagaaggagaggatgggcaggcaagacagtgcagccaaaagggctggaggatggatgtgaaggtaagaggggtgtgctctctgaggaataattggggtggcgtggggtacagtcctcatcccagagcagaggtgccctcagaaatgaaagcatacaagcccaacaggtttcagcaggcagggggctagtgggtgagtttgcctctccttccctgtcatttccttttctctctttcacaatctcttccttttctttctgtcctttccttaaatgtctcttctccaaatagctagtttttcttaaaatggtcattattagagataaggccattatttaaggtagaagtatctttaaaattaacctttgcattgatttattcaactactcccttatttttaaaaacaagcatatcaaagcatttgcatttttctctccaagacaacagaaaccctaaactacagaattatgttgctttttctctgcatgtagctcttggttgttttcttccttttgcgtggtgcctggtaattttataaagcattcccttattcatgctgaagtgatcattaatgtagttggtgaaattgcatttctccccatttctgcactcctaaatttgcaggcatacacaagttatctaaatacagtgtggtattttaaagtatgcttttgtacatgctggacctaaagtgttgggtgaccctctctctggatgtggcatttggggtgcatgaagggctctgcattgggctcagaggggggtctgagggctgtggagaagctggtggaggatgtgctgtccatgtcactaaagcatgttggcccacggtgggccattgcccagtgacctgtgacagaagatgagtatgagccaggaggccttctcctgacccacccagagggccttggctgcatccactggaaggcaaaagaccaggagtaggagagcccacctgcccatacattctccttccagagaaagagcaccaccctccaccagcaccgaagaccttttccttccagcccccctgacttccagaggtcctggtctaaactaggaaaaagaaattgacctctctctttttcctcttggcttgaaacatatgagtcaaaataaatcatctacattatttttttcttcttttttttcttttttggacatgtacagagctcagccatcagccctactccggaaatttcttcagagactcctggatagtaagttgccattttattttgtttacattgcttactatgttaaatgtcagaaatgggaagagagaagtttatattttggacccagagtgtgttttgtttgtatcagcctaatggctctgaatgatgtacagtttggtgataaaaagtgatctaattatagtcttcaaattatttttcttctgttctgtcctcctcttccaaattaattttgtgatgatttgtattaccttttataaagttttccccattttagcatcttcacctttagaatgggagtttatttgtctaagtttagaatccaagttcttgcctggcatggtggcttatgcctgtaatctcagcactttgggaggctaaggcaggaggatcacttgagcccaggagttcaagaccagcctgggcaacatagaccctgtctctacccaaaaaaaaaaaaggaaaagctgggtatggtgctatgcatctatagttccagctacttgggaggctgaggcaggaggatctcttgagcccaggagactgaggctgcagtgagctgagattgtaccactgcactccagtctgagtgaaagagccagactgtgtcccaaaaaagaaagaaaaaaaatctcatttgctggttcttatggggaggggagtgtgactgagacaggccacatctggtgtaaagattgtgggagggggctgggtgcagtggcttacacctgtaatcccagcactttgggaggctgaggcaagcagatcacctgaggtaaggagtttgagaccagcctggccaacatggtgaaatcctgtctttactaaaaatgcaaaaaatagctgggcatggtcctagctacttgggaggctgaggcaggagaatcacttgaacctgggaggcggaaggtgcagtgagctgagatcgcaccactgcaccccagctcgggtgacagagtgagactccatctaaaaaaaaaaaaaaaatagacggggggagggaggtgccgagaaggggctaatttacctgattctcacatagatgggcatctgttttcctctgtcagttcttaggactctggatgatgcatgcataccccactcctttgtggggtgccaccagcctcttcccctgccaaaccatcctgaatcctatagcagattgcctttctcagcactttgctgtgaagctgttatcccagctgaaaatgttcagtgctaccctcacctcctgttctatatgtgataaatagcaaacattttagcttatatagataggccctcgtggagccttcctgtacccaggctcacgttagtacctctgtggtccttacttctgttgctgtatacctgacatatactcttgtatttttataattgctagtgtattataaactcctcaagggcaaggccccagtcttcacagtgcctggggcacccagtgaatttaggaaaggagcttgttctggtaggagcttttcttattttgtcaccatcgcatctgtgtcttgttctttgaaatatgacaatgaggggaagacacacctattacctatgctagtagggttggataaatccacaatgagcagagttgctgagtgtataaggtttttttttgacagatattgtggtctctgggacatatcctacctacattgctggagaatgtgctttacaggaagagtttcatttgaaagtcagcagggatttgggtattttggtggaaaaatggaaaaatttaatctatttagggtagtgatcaaaagctctagctagatccatcatgttaatttttcttctataaatatgtgtgtttcatgattaatatacccaggagcataagaagaaattaagaagacatattaagacagcagctagagaaggactgccttaggggacagttcccaccttggagaaggactggtgtaaagtctcttgcattcactgtggggttggtgactcagtcgccaatatgacaggtgtcagggctcaggtgtagcatcacaacccgtgtctcctactctggctttgcagctcactcccttttaaagagcttccaattgagccgggccttcagctctaaaaatgacaataagtcacaggtcctctaggtcctaggatgtgccttcagagatgaagcccaccagatgaccctaggctacctgcagataaagggtgtcctcaaggccacagctccgagcaagctctccttggtcccccaggccacctctttattctcagcttgtcactttggcagtcctgactgcccgtgttaaccctgctgcctgctctcctcgtttacctcctcacctccatccccctaaactgcacaagacggaaagggcttcatgggacagctggcagagtgaattccctagctctactggatccaaggcactaagctctgtattctaataggaatgtagatatagtcccttaatagttttgggacaaaacacacacacacacacacacacacacacacacacacacacacacataaggttagtaaatgaaaaggccaagtggcaaatgctaccacaggcagtcaggataaaggagcacaggtatcgaataacatcattttaacaatttatcaggcatttactacgtgccaggtcctgtgcttggtattttatctaccttacctcatttaatcctctgaacattccaagatgaggcattatttttaatccccattttatagatgaggaaataggcacatcaaagcagtgtaatgccatagttcctcagcaggttcagggcagagccatatccagattaggaacggtgaagctctaggccaagggactagggttggcagtaaactctcatctgccccatactgattcaaaattttgtaataagttagcagaagatatactaaggtttaatgttttcaagctattaaaaaacaatttagacctggcgtggtggctcacgtctgtaatcccaacactttgggaggccaaggttgggggatcacttgaggccagagttcaagaccagtctgggcaacatggcaaaacttcctctttacaaaaaatactttaaaaattagctgggcttggtggtgcacgtctgtagtcccagctactcagcaggctgaggtggaggattgcttccccgggaagcggaggttgcagtgagccaagatcgcaccactgtactccagtctgagtgacagagcgagactctgtctcaagaaaaacaaaaagcaaacacccccccccacacacacacaatttaagcaactatttatgatattgggttagcaggattggagggtactaatgtaagctgactaaaagagcaaattgttttcagacactgtgaatgtgcgtgaagatattcaatctgttaatttaccaagaattcttatttatatcactgaaaataggtcttcaaagcctctgtttttcagctctcatgaaatacttggcaggaataaatgagttttttcctcctgctagtctaccatttggggatttttcagtaatcgggcttggttttcccccagtttatccaaatgaataagattttttcatatctggaattggtgaggaaccagcctaaatggggtgcctgacacaaaggaaagcatacagtaaatgtttgctcaatgaatggatggatctgtaaatcttaatcaactgaaatccaacttggttagcactgaggcaggcagcttgtaagttgaacctagtgcctttcactggttggacaggaatgatgtgtaggcagaaacattggcaggacttgaccttaacccaaagaatgaaggaggaggagtcacaggtggcccaggttcacagttttgtggcaactggagaagtgatggtgttgttttaagtccactttaataaattggacagacttcaattgataattttattaactaacactgattacatatgataatattaaaagaactgggaacagagaggaattcacccatagtcccaatatccaatacaactacaagtccttgccttcaatatatatattttttataattaacatcacagtgtgtgtccagttttgtactttattttcctagcatttcagatctataaatcagtagtggtaactactcattactttcatttcaatgtatttcagcattgattaaccttctttgcctaaccaaagagctttactctatttgaccagcaggtggcactcaagaacaagctgttcttccctatatggtgatggtagactagcaaacgctttttccccttaatctgatttgagaacaaaacacagatcataacctgaagaactatatgaaacagtagaggtcctccgggactttacaaatgtgtcagaaatctgtatgcatgtaggcatttaattttatagaatcatttattccattaatatttattgaacaaccatgcaaggcaccagatatgcaaggattaagaagataaactttctgccctcaaggggttccaggtgtaataggggagacagatttgtaaataaccagagtccagtggggtaaatgcaatgatggggcccaggagggaggagtgagcacctattgttttgtggaggaagaaaggttaagctttatggaggaggtgcaaataaaatgtgaataacaatatcagtatagatataatttttttcatgcagtacaaaaggctataaaatgaaacttctagaggattatctagactccttcctgcaaagccacagttaacaacagttaggttttttttcttcttcttcttcttgaaataactaaattattttgaatggtgaatgtaagctttatgaggctggaactttttgtccgttctgttgcctgttgaatcttcacctaggagagcgattgacacttaatagatgctcagtaaatatttgttgaccgaataaatgagcagtagaatgacatgatgagatcttttctagacagagatgactggagggcatcagggctggagactgggggagcaatgcgtgtttgttgtacagttgtaggtgagcaatgataaggcgggaggtggagagtaaagggattaatgtgagctgtgtcaaagatagggaagaagcaggacttggtgactgattaggcttaaggagcaaggagagagagagaaggggaccgatttcctgagctttctgggttgtgtgatggaagatggtttgggacacgttgagtttaagatgcctgagaaacattcaggtggatgtctagaaggcggttgaatgtatgtgtctggagctcaaaagaagggtctgtgtacataacagatttgcaggtgggtttcttgtacaatctccccatgcctattagttttgcaagtgaaagaaattgaggccaagagaaacagactgttcgcaagtttttaaacaagagtgggtttgcctctactgatccacattccttgttggagtcaggtgggaatcccagtctccaggactctgtccactgcctccggaacctgcccgttagcacaattggaaacagttggccctaggatgattgctctgttctctcactttactcttccagtgagtgtgtttttgttgaatccccttgaaactcagcagccagctctgcatcttagccagaggctgaattctctgtgctagctcttcttgcttgctcttcctgaaccaaaatctgggttaatcaaggctgctcagagctgagcttctgaacttaacttgttttgttaagtactcagctgctattcctgattggacctttctcaaccagctgaggggataaggctgcttctctcatcctctctggtacacttggacagagcaagtactctgtgaccttgggcaaatgcctttgacattctggtcttcagtttccccttttgtacagtgaaacaaatggtctctcttcaacattagaagatctgatggatatgatacacttaaaaacactgttgtggctgggcatggtggctcatgcctgtaatcccagcactttgggaggccaaggcgggaggatcatgaggtcaggagctcaagaccagcctggccaacataatgaaaccctgtctctactaaaactacaaaaaaaaaaaaaaaattagccaggcttggtggcaggcacctgtagtcccagctacttgggaggctgaggcaggagaatcacttgaacgtgggaggcggaggttgcagtgagctgagatcactccactgcactccagcctgggcgacacagcattgttgtagagctcttgggtattgtttttaaacaaggagtgcctcagtttcaaaatgttacccatctggaaaaagcatgttttgttagctttggtatcagaaaaaaaacaattggcttggcaaatccattctgagagatttcctgagtgctagtttatcattctggtaggaagcaggaaaaaacggtgataatgggtggaataaggccagagagtgaggtggctgaggggttggggtggggtgagatctgactgttggtgaggtagagcagagatgtgaggtcaggcagccagttatggtcaagagtcatgacagaacaaagttattaggaacttaggaagatggcttagaagttctggacaggctgggcatggtgattcacttctgtaatcccagcactttgggaggtcaaggtgggtggatcacctgaggataggagtttgagatcagcctgaccaacatgatgaaaccctgtctctactaaaagtacaaaaattagccgggtgtggtggcgcatgcctgtagtcccagctactaggaaggctgaggcaggagaatcacttgaacccgggaggcagaggttgcagtgagccaagatggcaccactgcactccagcctgggcgacagaatgagattctgtctcaaaaaaaaaaagttctggccaaagctgaggcaattcaaaggatagcaggcacagcagaatggaagctgctgtcagtcactctgttaaaagaaaaactttagacaaattaaatttagcagatttatttaaggcatagaaggatttatgttcaggcagcccttagaaccaggggcagttcagagagcttcacccagcaacatgggcaggcagcatttataaacaacaaaagacagcaagtacagctacagctggattggttgcagctccacagttgcctatttgggcatttatatagatgtgggctgatcagttggcagcctgggattggctgaagcttggctgctgtgattggctgagactcagctacttgttataagagcatactcttagattgtactttgtttacatagttaggttgcagaagaataggaactcaaagtatggatgcagcctcaagcccaatttagtttactgatctccaatgcttaaggaggtgtggtagccccaaaccaaggtgggaggggcttcagacaccataccttcaaaagagacctcagtcaccacagctgttggtcagcaaagataaaggacatctattcatggatgtttttgctgttgaagttatacaaaaaagaggaaacatagcattaaactgaagggcaaaatcagaaaatgcaaccaaagggaagagggtggataatgaataggaaatttagaaaagggacatatttatttttaattaggaaattcaaaattataagccagtttagatcaactcacatttatttaaattggcatatggtgccacagccttgcaagctaccctcaggttcttccatctcctctaagtaaagaggaaaagcatttgacctccacatccaggccagagtgaattaagagggtcctgggggagctctgacccccaccctcggcagtcccctgaaatagggtatataaagcccttagccccaggtgggtacaaggtgaggctcagtaagtggcagctctgcgaggggattaccagtgccagaagcaatagtattgctcaggggactttattattctaaggtggagatgtcgcggtattctaccagagtccccacctcttttccatttctgactcctgtgtctggtgccgcttatcttaggggtgtattcatggtgagtaacactcagcagtgatggtgtatacggagctggagcatccctgagctccctctggttcctgtggtgtgcaagccactgcctcctcagttgtaggaaaatgttgtatctattaataaaacagcagctgaaggttgggcacagtggctcatgcctgtaatcccagcacttttagagggcaacgtgggaggattacttgaggctaggagttcaagaccagcctgggcaacatagtaagaccctgtcccaacaaaaaaataaattaatgagcagtaaaataaaacaggagctgagagagaatactatccgtgtagtgctcaatggcctagttcaagttccagccctgccattctgctaacctgcctactttgacaaattactgaatctctcagtgccttgtttcctcatctaaaaaatggcagaagtaggaatgttaggattgaagtgataatgatcaataggcacggtgcctgccacataggacgcctcaccaagaggtgtgtagagttgtttttgctgtcattaccagtgaccatggggactcagaggctgcaattatgcacagaaagaaaggccagtttcccggaatgtaaaagcatcacattattgatcgttgctggttgagtagaggaaaatatagctggacagatgtgtgatcaagcagtcacagtttgtggcccccgtagaagctaggtggggggaatatgggtgttcactctgtaattctttaagctgttctatatgttagttgatgttcacaatgaaacagagggatgaaggaattccacctagcaatgggtcttcagagctgaaaaatctattttgataccagtaacctgagttgggtaggaataaaagaagctcagcagaagcctatgtggttctgcgggataggagtcattcacttaactgagaaatatgtgtgtgtgtgtgtgtgtgtgtgtgcgcgcgcgcgcgcgcgcatgtctgtgcatgtgcgtgtctgtgtgtgtgtgtgtgaatgacagtgtgttagtggcaggcatagaaaagtgggattaggagaagggagggactcagtgagtaagtacccttgatttttttttctgtgcctcacctcattccaaaaggaatttgtggtaacttgcagaaatacctcgatgttaacaagataaaaataaatggaggctataaaggagcaattgtttatgcttatactacatgtcaggtcataatcttctgaacacaaactttgaaagaagtgagtgcaaatgtggctgtgatactaagagcccatagaatcccaggttccaatttcacttggtcactgatttttctggagacccaagacagttgggcttccccctttcattgatgattttatattccaaatgcttacgaagaataaccaagaaaaataatccaggtagtggacttgaagtagctgacactgcctggctacgtgacagaggcacgtctgacagagagcttgactgcaccatcttgcgtgcagccattgggtcctcctgccctcccctatgtgtgatcctccccctgttctcccctatccttcctccaacccttcttccccaggcagcgttccacagaatttttcttttaaagcacaaatgtagccattccaattagagaactttgctgtttggtcaagattcctgagcattcagggctccatgggcctgtctgtagaaatgtctgtctaaataagagcactctttagaaaggacagttcttgattaggataccaggtgtatttcttgtcctcagcaggtaatgtgctgtttgaaaaatgttaaaagcactaactcctattcttatctttattttttcccttttctctctttctttcaaaattacctgttcatagtatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaaggtaattaactgggtgaagcctgcaggcctctgtctcccatccacctccattcactgagcgtcggccgtggtgaacctccagcaatggggataagtcctgccttgttcagacccacattcaggcctcagagccctcttaaattccctcccctattttcttaccggccatttttctttctggttttaatagtttctgttcctttgaccccccaaccttgttctccttcaagatttctctctctctctctctctctttctctctttctctctctctctcattctaattaccttttcttagaaattagctgagctttagccattcctaactctagcagggtagccatttttttttgttgttgcatccttgcacctgctttgcagcacagattattttgcttccggacctcgactggaaattttttaaaagcccttatgacaaatgagcatgttacctctcctttttctttttagcagctttcagctttaacctaatgggtctatttattttattctgcatgcttaccagtggatcgtaaaggtgggaatgctcacatgatttcttcatcttcagtccatagccgaacgtttaacactagcaatgcgttaggccctgtgtgtaagcacaagaagcccctgtcagctgcgaaggcctgcatttcggaaatccttccatccaaattcaaacccaggctctctgctcccagcgctcttttgcaggaacagaagagtatcctcttgccctcagagaaggctcaaagctgtgagaacctttgtgtttctggttctttaaatgattccaaaagaggcctccccctccaagtgggagggagcattgagaacctgctcatgcgctcccgacgggattatgacagcaagtcgagcagtaccatgagcctccaggagtacagcaccagcggcaggaggccctgtcctctctcaagaaaggctgggatgcagttcaccatgctttatcgggacatgcaccagatcaaccgatctggcctcttcctgggctccatctcctcctcctcgagtgtgcgggatcttgcctcccactttgaaaagagtagcctggcattgtccaggggtgagctgggccccagccaggagggctcggaacacatccccaagcacaccgtctcttcccgcatcaccgcttttgagcagctgattcagcggtcccgttccatgccatccctggacctgtccggaaggctgagcaagtctcccacacctgtgctgtcccggggcagcctgacctcagcccgctcggccgagtccctacttgagtcaaccaagctccatcccaaggagatggatgggatgaactccagtggggtctatgcttccccaacatgtagcaatatggcacaccatgccttgagcttcaggggccttgtgccttctgagcctctctccacctgctctgatgacgtggaccgctgttcaaatatctccactgacagcagagaaggcagtggcggcagtgttcatggagatttccccaaacatcgcctcaacaagtgcaagggcacctgcccggcctcatacacccgcttcaccaccatccggaagcatgagcagcagcagacctctagacagcctgagtggcgcctggatgccagaggggacaagagcaccctcctcaggaacatctacctaatgagcccccttcctttccggctgaaaaagcccctccaccaccaccccagacaaccttcccctggtgactcctcaggcctcctggtgggccagaagccagacctccccagtcagccccatcaggaccagcccccttctggggggaagcccgtggttcccacacgcctgtcttcccgacacaccatggccaggcttagccgcagctcagagccctctcaggagagacccacggccctggaggactacccaagggccattaataatggaaactccgtgccatactcagaccacagcctggacaggaacaacaacccacaaagtgaactggcaccatcccgtggaggtggcattttgtgtgtttgcctagtctcacctgcccgtccctccactttgcttgcattatcccgtcctcctctgtgcccttggtgctcattttctggtctgtcctttgttttctgtttgttttgcttggcaattaatcatggctcgtagtggctgcacttctttaaaaacaaagcccccatgtcatttagactaaccaccaaactgtgtttcgaaagaaaaattggccgtttagctcaactgagaaatgtgttcatttgaactcttgaaccccttgctgtttgcaccaatccccaacataccccatggttttttgagaggcagcctctctcaatggccctatatgtgtgtgagtgtgtgccttgtccctataaggtcctgcacgcctctttgtagggacactttacaaagaaagttctctcattttgctcaccttttgccttttgagtagttttctttgcattaaactagttcacaaataaatccaaaaaatggggtggggggtggaatttttttttccttcagaattcgaccattgatcattaatcaagaatgacttcaaaattttgatatttataatagatgaaaggtgaactcttttcgcaagctggtttccagcgaaatctttgcctgttttaactctactttgttgttttaaagattcagaatcgccaagacattttataccagctgattacttggaatccacggaagaatttattcgaagacgtcatgatgataaagaggtaaatcccatcttttaaatccattagtttttgcttggaaaaatgtatgaagcaagtacagattcttgacatctatcagagaggtgacatgatctagcaattagaggcaaaaattgaggctttcacaagtgattttttcatatgacataggctcaatcatgcctcttttagtggacttttccaaaaagtaggactgatttccccacaggcactagcttataaatgccaagtccagccagcactgctgcatgggagatacagagattgtccactgctgcacttaatgccctgtaagctagaaaccagagtttgctctttcatccccgctcaaccccacccttgataatccctaaagaaatccacctgcatatttctccaatactgcccacccctctgttggcacaaagcattgttcaaattgagaagggtgcaacaggagaaagaggaaaatgaaaaatagtaatgaccttgatacattttataaaacaatttgaggaagttgcctataactctcttgctttcaattcagaagaaggcagatacaccaagaaatgctggaaaaccccagccaagaacttcaaaatgtgtatattttcttgtagctactgaaatgcctgtcctgccatggggtgactgtcagggcctgagaaagagccccttttcttggggatttgggaagaggaagttcttcatatcagccaaatgggcaaaatcacaagcttctgctgggataaagcattgtgatgatacatgctttctgggcctcacatccccaagaaaaagagtcctagagattaaacaagctcccaagcccatattcctgaaatgaattaagagctggaaaaatcaccttgacctggtagcagtgggggagggtgtgcgtgtgtgcacaactctgtcctggtcacgttcaagtctgaagccctttttctctgttgttctgctttgttgagtagttccagagtttaggtggggtttcccgaaggatttaggataaggctgacttggggatgagtaggatgatgataattattgccaccagatggtgaaacaaaagacaaaaataaaaccaccgtggccaggtgcagtggctcaagcctgtaatcccagcactttgggaggccaaggcaggtggatcacttacttggtcaggagtttgagaccatcctggctaacacagtgaaaccccatctccactaaaaaatacaaaaaaattagccgggcatggtggtgggtgcctgtaatcctagctactcaggaggctgaggcaggagaattgcttgaacctgggagatgcaggttgcagtgagccgagatggcgccattacacaccagcccaggtgacagtgcgagactccgtctcaaaaaaaaaaaaatgaaaccactatacctctccccatctccaggcacaattgaacagtactcagtaagaaacttgcacctgtccatggaaagaaacaagaggaagcatttgatgtatagttattatttgtaataactcactaatgatgagtgtccatcaggccatagagcagattcatttctatagctctttgttaaccatttcctgccacaagatataagattcccatgtatgtaggccagggctgctatgatgaaggaaggtgaaattccattttagtaatataagccctagtctctgacctagaaggttttatgggacaattcttgcctaccacatgggaggtgtagtttatctagtggtttagcaattgatatattagaagttacataagaaggtgagcagttgtctcctaaataacactggctcatagattcttaaaagttttgtgtctttatccatggtttttggcttatatggttaaactacagggctgagggacttactaaggtgagattcaagtactagattgggagctttaccccattcgatgtccacttccactgattatgtttaactccagccagaacacaaggggccttgagtaagaactgtggcagtttcaagcatcactccattcccgtggctacagaaacagctcacactccccagctcatggggtgtcagtcaggccctccccattgcaaatactttatcattgacatggattttcagaaaatgagacatatcagacttggcaggaacattagtggtcatgtagtgaagcccctggtttagtccaggaagggaccacagcaaggtagtaacttgcccagggctggatagtaagttaacttataccaatagcagagctagaaaccagggctccagatgcctggaccagcactctttctatggcactgggcttcgcagaggactttctcatgtcttttctaatttaatctttacaacttatttgagtactggaaatcccacagccatttgatgagttgtcacttcgttatttgtagtctttggagaaaaatcgggcccaccctcctttaggggtgcaagtcacatgaggcatttaattgcctgctggacgaagcctactgtcttccaatgctaagaattatccattctaattcatgctttcctacaaggaaagttaatcccaggaaagtaagattgtttagtatcagaaaacacattaaaattctattccatggggtcattttaatgggcattgagggcatttggtaaaaagcaacattgtttgatttttcaaagaagcctttaaaaatagaaatagatgactttttccttactctaagagagaatatttcttctaatcccaggtagcgttattcttagggtttttttttaatatttatattctctgtcattccctttaactcagcttcatttcacccagtgaagaagtcattcagtaaaaaagtaagtgatgctgtcagccacataattagcctttggtgcatatcctaaggccttctaaaaattgtgcctaggggaagagttggctgcctagaaggggcatcatcctttctgaaatgggcaagaacatattagagtaagagatacaggaagcacaaaaatgacctggtgccatagacttcactagcagaagcctatagcaggtttaataggcctgaggtgggtaggaggaattggccagccctggtcctgccaggggaatatgctgtaggaatatatccctgcctaaaaacagggtagagatggcacttccagcctcctgctgccagcccagcatggttgggaatgccctggatgtgccccctggctcacctggccttttgctgccagaagcaagaggctttgggctgagccgggggtaggtagtttgctggacagtgtaatcatgtggaatcatccttcccctatcccggcttttccagtgaagtgctgcctcctttctacagtgcttggagggtggttatgatgggagtgtaatagttgtggctctacagccgttctgacagctgagtcttaaagcttctgccccattcacccagtacctccttccctaattacttttgttggcagttttctaatatgctggaacagatgattcactgcccattttatgcaattttatggcagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagaggtctgttttggtcacctcaatctgctgcttgacccaaagcaatatttgcctatttgcctcccctcagcattgtcctctgtaggccagtttagttctccaaacagcatctgtcatcctggcctcccttaggcttgctttggcttcttgcggctggtaaatagacatgaccccattatgtcctgtgctctgtatgttcaagcatgcctggctgggggaccgggatctgctggcacatgcccctgttgcatgccttagaccattggctgccttcatgagtccagccctccacatcctgcattttatcatgctactgtgttgcctgtgcattctgcttagaaaccttatacctgagtccatatgcattggtagctatggtgtggacagttacacaattcttctttgaaaagatggttaatgaaactttacgaaagttagcttaacaataatttatgccatttacaaaggcctccaaatttagtgacattaattttgaaatatagaacagtgctgctgctcacatgtaggtggatgaattgtgtgaagtgttcagcagtgctgcagtagtgcgcctcactaaagaattttgaagcccaaagacttttgcagttaggaaaaacccacagagggtaagagagttctccaagggacgtttcatttgttcttttagttttgacatttccaagcctagattatgaaagcttaatattataagaggaaagagaagaacaaactttgaagtgatttttatccagatcttggcctcctgcactaaggtcaacatgtcgaaattctcatgctagccaaatgctgtatcttgcgtaagagtttatgctttgccatgtaacccttaagtagcgctgctgaagatgatctcttttagggaaaatgggtaagtctgggatttagggtgggagctaggggaatgggggaataacacccaaagtatgtactgttttataacctttcagtacagtagattaatatttgtttctatcttttttattttattttttatttatttttctatctagagtatcattgcctatcttttttattttagaaatatgactgggcatagtggcttacacctgtaatcccagtactttgggaagtcaaggtgggagaattgcttgagcccaggagttcgacaccagcttgggcaacatagtaagacccccatctctaattaattaattaattagatagattggtagatagccaggtgtggtggcacatgtctgtagtccaaactactgaggaggctgaggcaggagggttgcttgagtctgggagctcaaggctgcagtgagtcatgatcatgccgctgcactccagcctgagcaacagagcaagaccctgtctcaaaaaaaaaaaaaaaaatgtgtctgggaagaagagatagtgaaaagagggaaccaaattaaaagaaagaaagctggctgggtttagtggctcaagtctataatcccagcactatgagaagctgagccagtaggatcacttacggccaggagttcgaaactagcctttgcaccatagggagacctcgtctttacaaaaaaatgtatatatatagaaaaattagccaggcttggtggcacacgcctatagtcatagccacttgggaggctgaggtgggaggatcacttgaccccaaaagttcaagactgcaatgagctatgaacacatcactccaccatggatggcagagtgagatcctgtctcaaatttaaagaaatttgaggctgtctcaaattaaaagaaaaaggaaagctggggaagagaaggagactctaaaatgatggagagaaagaaaatctatcaaggaagaagcaaaagttagcgaatgttaattgcaagggaaagatagcccttgagccctcaacattccagctcctcctcaaaaaggcccttctcagaaggctctgggcatggtttgtcctcactgacagtcctgcctgcttgtaggtagaagaagatgggaacaggtgaaggcactacggctgcacacttacacatgtacatgatacatgcaaacagaaatgcaccgtgggtggaataaccacagacagaggcaggcaaactcagctcagtgagcctgcctcccttctagagcaatgcttctcaaactctgacaagtgcgttagcatcccctggagggcttggtaaaatacagaccctgggtcctatctgcaaagtttctgattctgcagtggggcctgaaaatttacatttttaacaatttcccaggtgatattgattataccagtttagggaccacattttgagaatcactgccctagaggttgactgtggactagaaaaagtagagaccaacacatcccaggtgcaccacactgtgtcaatgcacttcaatcccattcggtaggacttgggtgaccacaggttctgtgtaagaccctatgggaggcagaaagaactcagtctgtgcccttggggagctgatagtggaagtctccctcttatacagttatctctgtcctgtagtaagtaatacaatactgtgaaagccagaggagggaaagatggatttagccttgggagctatagggagataaagaaggagaggatgttgctttgtataaccatcgatgactcacatacacgtctcaagagttcaatggaatcagtgaattttaacaggtctttaatgaaaaaaatctcaccaccccacattattaacctaagtctgcttacaaagtaaccataaactacacagctatataattatattgatttaattgataggagatattgttttgacagaactcagttaccaaagtgtgaatgctgtgctgctttggtatacattttttaaagttcacacagctctacagctgggtgacatgaggtaacctacttccttgtgtttttctattgaaatcactgtgaaattcgtatccttataattttggtcatttagttttctcttgtgaacttgtcatttatcattaaccccacatccattattttcttgttcacctgcaactgtgaaattatgccctttggttacagacacaaacacaggtattgaaattgtgtggctttaactagattataaggtgatcattcacttggcccccgtacgtttggtatagatgggtagatagatgaaaacatcaatgtgaaaatgcagactttaaaaatgcctgtggaaggctaggcacagtggctcacacctgtaatcccagcactttgggaggccaaggcaggaggaccgcttgaacccaggaatctgagaccagcctgggcaacattgtgggaccctatctgtataaaagttacccaggcgtggtggtgcatgcctgtagtcccagctactcaggaggctgaggtgggaagatcacctgagcctggggagtcaagactgcagtgagccatgattgtgccactgccctccatcctgggcaacagggcaagacgctgtctcaaaaaaaagaaagaaattccacagccgggcgtagtggttcacacctgtaatcccagcactttgggaggccaaagtgggtggatcacttgaggccaggagttagagaccagcctggccaacatggtgaaacccagtctctaccgagaaatacaaaaattagcctggcgtggtggcacatgcctgtagtcccagctactcgggaggctaaagcaggagaattgcttgaacctgggaggcagaggttacagtgagctgagatcgtgccactgcactccagcctgggagacagagtaagacactgtctcaaaaaaaaaaagaaattccagatagaggagagggtaggagggggttcagctgaggtgtagcaaatagatttgactggaacaggaacagtgtagtagagataaaggcaattctgtaagagtagggagaaactacccaaaggccttcacctatggcaggaattgagatttgaactgagggaaagttgagagcagcagccaacttcaaagcaaggaagagatgtgaggaagaatgttaggaatgttatttgtgctcctgggtgacagattagagtgaagagaatgtgaaatcaaaggaagctttgtgtcaatggaaactagatgtcagctttgagcaacagggttgtggagggatggaggtgtggagggaggtccctcctgacttaatgacacacttgatcaggaagtggagaaggggcagaggctgacttggacctgggcatctgggaacagagggctacccaacaggattggaagtcttggcaggagtcatttgagctcagggaccactttatctggctttttggatgatgtcacagaccgtaagaaatatatggagttggagatgatgtgagaagtgaatcggcatttcacctacttgcatatcataatttaagcaagtagatgtctctaaggaataagacagtagataaggaacatcttaggacttctggctgactttgtctttttgtttgtttgtttttttaatagccatggttcacatgttttgaggaactgttacctcagctttgggacctttctaaccatctcttccccagatctggctgtttttagggggattctcatgaatgacatacatagttgactaaacatttatctagtgttctactaaggtcagacaaatgcaattttgcccagatttctacactagaacaaactggctagagtgaatttttctgctttgctttctagaaatttgtgaaaatgtgtccttgttgtccatgaatcctgattttaacttgtcattgtttcttatgttcagatgagacctgccagagccaaatttgactttaaagctcagacactaaagtaagtgccaccagttatatttatttgtctttttagctgcctttttgaaacacagcagtttgtttgtagagttggagaaataacaattataaaaattgttgttaaaaaaaaaagaacaaaacagtagttcatagagtttgctatgtgccaaacactattcagagtactttgcttatgttaattccttatggagtgggtgctgtgatgatccccactgttcaaatgaagagaccaagagactataaggttaaggaacctgctcaagctggtgtgatagagttggaattcaaacctaggcagaggttggggtcttataccctgccccaccctgcctcctcctatgtagtggctctatttgctcaagtggtggcttgatctgacccatcttttctgtggaaggatctagaccagtctctagggagataactttacccattttgctacaacatcccaagagattaaaatcttacatgaacccacaggagactggcgtttctcttaagtgtgttcttcagagtgctagccctgtaaaatttttctcaaaaagagagttctgttgtagaatgagttgggaaacactgcatgctctatctatacctcccacccactttgaagagatactttgttgatgacatattaatagctccagaagtctttcaagaaaggaacctgaaacacgatttgggagatgctaccaaagactgggttccataaggaaacagctggctttttatctaataatggatttaaatagtccatgagttctcattggcagctaaaagtacaatggtcagtggccaccccattgtcctgcagatggatggttgtgcatctggtgatcagagggagagctccctgtccttagatgctgggaaatgctgtgtggagctaaccaaccatggttctgatctcctggatcacaaaatgagtgaccaggccacagtgtctagagcctaggcacaaatctggtatagttgggtttgtgtgtattactccagtcctttagttggtcagctaaaggaggtggctgtgtaatatactgcaaagattgtgggctttagagtcaggaagccctgtgttcaaatcctgactatgccacttactatctttgtgactgtagtgaagttatcaacttctcccccactcaattttctttatctgcgagataggggtaaaaatgcctctcttgcagggaagctggggtaatacctgtaaaacattttgcatagtgaccaaaatttaatactcaaaatatgtcatcctcttcccccccttttttttttaaaccagaaaggataacagagatatataaattaatttgcaatttaattaatacacttatttctttgaattgaggagtctttgtaagatttattaaatggtatagtgatgataatattacattttcccagatttcataaagagtcttaaaacaatttttttttagagcaaccctgtcaaatagaacaggtgagaaagcttagatccacagaaattgtcaccttttatcaacattgctaatgccggagagagggctccttcctcctaactcagtgttttcatcacgacatgctgcctccaaaaaaatgtccacaaaatttagtgaaaaaagtaaattctagctccatggtcttttaagcccttcagtcacttggttttacatttcgccatagtcaattactcaaaaaagcatgctgtcggggccaggcgtggtagctcacacctgtaatcccagcactttgggaggctgaggctggcagatcacttgtggtcaggagttcaagaccagcctggccaacatggcgaaaccctgtctctaccaaaaaatacaaaaattagccgggtgtggtggcaagtgcctgtaattccagctactcaggagtctaaggcatgagaattgcttgaacccaggaggcggaggttgcagtaagccaagatcatgccactgcattccagcctgggggacagagtgagtctccatctaaaaaaaaaaatagcatgttatggaatacttggttcaacaaagttaaacaagtttctttccccctggccttctcagggcctctgctgtgctgatgtacaccgtgatgctccaaaaaagatctaaagcgaatcatatttctcaaaccctctcaccagcagtggttctttgggagctaggggtatagtccacagcagtggaagaatggggccccaggtttcccatggtagtcttccatcagctacaactacagacccctcagttcgtctctcacacacaagtgggtcctttgcttaatagtaggaccattatgctcccatccccctccacagctgcgagatacttagtatagcagaatcaggagcctgcagatctccataggggtgaatatgctgagggtcttgctcatctatgtgcctgtggttggggatgaagggagggggaattcgtaatgccccccaaagagggctgtggcaaaaatgtggcccgagacattccttctcacagagacaaatgtccatatcccctttacggacctcttgagagttagaatcctgtctgctaatgtgagacccacaaaggttgccttgtgcttttattcagcacagaactgactttctgtagttttccagatgtgccctcattgttcggccagcacccctcacataccgtgggacttcctggcatcctgcaaagtgagcacaccccttccaagttacaattggagacctttccatcctattggtttgactcaaatgaaaaagatctaggtcattttttttttaattcaagaaaatgttacaattttaaaattatttaattcaagaaaaagttataagggccaggcgcggtggctcacacctataatcccagcactttgggagtccgaggcgggcggatcacctcaggtcgggagtttgagaccatcctgaccaacttggagaaacaccgtctctactaaaaatacaaaattagccgggcctggtggcgcatgtctgtaatcccagctactggggaggctgaggcaggaaaatcgcctgaacccgggaggcggaggttgcggtgagctgagatcacaccattgcactccagcctgggcaacagaagcgaaactctgtctcaaaaaaaaaaaaagaaaagaaaaaaaagaaaaggttataatttttatccttcttttttcattttgtttaaaatttgcctttgtctcatttttttttttaaagagtcctggttaaaaattaacataatctgggccaggcacggtggctcacacctgtaatcccagcactttgggaggtcaagtggatcttgaggtcaggagttcgagaccagcctgaccaacatggtgaaaccccgtctctactaaaaaaaacacacacacaaaattagccaggcgtggcgcctgtactcccagctacttgggaagctgaggcaggagaattgcttgaacctgggaggtagaggttgcagtgagctgagattgtgccactgcactccagcctggtgacagagtgagacatcgtctcaaaaaaaaaaaaaaaaataataataataataataacatcatcattattgaggcaagcaaaggaatggatatggaaacgttgcaaaggggtacaaagagcatttgaaggaaaatctacttttctttccaacatcacttttccatgtttaaaagcaaaggaattaggccaggcgtggtgactacatgcctataatctcagcattttgggagactgaggcaggaggatcacttgagcccaggagttcaagaccagcctgggcaacatagcaaaaccccatctctacaaaaagatacataacaattggccaggcatggtggtgcatgcctgtagtcccagctactcaggaggctgaggtaggaggatcacttgcacccaggcggttgaggctgcaatgagctgtgatcatgccacttgcattccagcctgggcagcagaatgagaccgtctcatgaaaaaaagtaatggaattaacatttattgagtgttacctacctgtacaacaggcaccatcctagctgtttatttttaatttgttgaagcattctccagcaactctgagttagctccaagttcagctaaagaaacagtgtctcagattaagtattgtgtccaaggtcccagagctactaaatttcagaactggattttggaccagatctgcctaacttcagaacctttctactgcatgatgatacaaagatagatggtaaaatggatgggtggacaaatggtgaaattgatggaatgatagaaggatatcaatatatcacaaataatttgagggcaatttaaagcaacgaaggcatgccctgctagggcgtagaagaggatagtgaaggtatccaggagacgttttgtttaacaaacatcagttaaggcagctgagtgcattgctctgtgttgcataaattttctgagcataagacaacattcacaaaaaatgcatttagaaaaccacaacaaattaataaggcctctgagcactttcaagggctagtcaatttgaatgttaacatccatcctgcaaaagagtggaaaaatgccaaatgtgatgtaatttcctgaatagtggggttcttacttccaaatatggaggcccctctctggaatttgtaccctttgaccccacttaaaagtctccttttgctacaaaactgaagtgtcttaatcttacacatattgaaacatctgctaaaatgccgttgaccttctgtcaacagggagcttcctctgcagaagggagatattgtttacatttataagcaaattgatcagaactggtatgaaggagaacaccacggccgggtgggaatcttcccacgcacctacatcgaggtaccgcagcctcttttctttctaaggaaaagcctgacagtgcccaaagcaccatttatttaccaaatgcttatgttttgtttcctccttttcctcttgtttccctgctttcttctcttcccttgttctcttttacctctttccctttctcagcttcttcctcctgctgagaaggcacagcccaaaaagttgacaccagtgcaggttttggaatatggagaagctattgctaagtttaactttaatggtgatacacaagtagaaatgtccttcagaaaggtaagctgcacttctcatgccttgctttggggctctcttggatggcgcagctatgtggggaagcgtggtgttgctatcacaccccagtctgggggtgctgtctgtacccttaagagaagtatgccaatcaataattgcattaagggctgggcacggtggctcatgcctgtaatcccagcactttgggaggccgaggtgggtagatcacttgaggtcaggcgtttgagactagcctggccaacatggtgaaaccccgtctctactaaaaatacaaaaattagctgggcatggtagtgggttcctgtaatcccagctattcaggaggctgaggcaggagaatcatttgaacctgggagacagaggttgcagtgagctgagatcgctccactgcactccagcctgggcaataggtctccaaaaaaaaaaaaaagaattgcattaaggcctgtaatcccagcactttgggaaaccaaggcaggaggctcgcttaaggccaggggttcaagaccagcctgagcaacgtagcaaggccccatctctactgaagaaaaaaaaaaaaagaattgcattaagggcaattggagaattttctgaggtaaggtatttttaaaataaaccctaggctaatatcagggtttaactatattgagctcactgattaaacatagtatttctggagtcttagacatcttttataagctgttttcaaccaacacttaccaactaatgatgtcataatgcattgtgttggggactgggttttacaatatattggtgtgacctagtggaaaaaacaggtccattgataccaggagaagtttgaaaagctttgaacccaaaaggcacaaaccaactacgcagaatgtgggagttaaatactttttccaagccaccattttcttatagaaaaaaaatgaagatagatggctctctcctaggtggttgtaagaggcttcggtgaaacaacttatgtgaagcccccagcatgacacatggtatcttgttggtgcttagtaaacaggagatgccagtattattattatcaccatcatgcttattcagaacataattacattgtgcagagaagttgttctttccagaatccaaacactctacatggcaaaattctctggcttgctaaagttactaagttactgattttattgaggcttgagggaagtgagcacattgttagaaaaagcactggaagcaacccagttgcccaacagcaggggatcagtaattaaatcattatatgtgtgtgcgacagaataccctgcagtggtccattaagctatgcaatgccattaaaaatctagaattctatttcttgataaagaaggaggtttactatgtgctattaagtattttttaaaaagcaagttggaaaagggaaacacagttcatactcaatttttataagaaaaaatatgtgcaggtttaattcacatgcatagaagtaaatctggggagtccatatgccaaatattaagtgtttatccccaaatgactatgtgatgggtgatgattgttttctgctttacgtttgtgttctgatttttctataatgatacattataagtatctataatgctacaaaagaaagaaaaagtgaaaccccccaaaatctttgccttagaaatgaagattgggtatctgtttcacattaaatgagtcaaaaacactacatttgttccctggcttagggacacaaatctgatgttctcctttactaaaatacttaaagaaccaagctgaacttcccagcatcaagatagctcctctgccattagcatcctcatcccagtggtgttaattccctccaggttcagcagggaaggtttttcctgagctaaggatgtgataaacaatgcaggacattgaagcatgcaggcagaggccccaggcatgcagaggcatgctaggacaaggaccctctctttgctgtgtcttccagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacaggtatctaagcttctcgtcactggttttcatactcagcatgtgaatttttgtagtcaacagtgctgatggcacacagcctctctggggaggtttttgagcactgcaattaaaaactgtctgcaggaggccgggtgtggtggctcatgcctgtaatcccagcactttgggaggccgaggcgggtgaatcacctgaggtcaggagttcaagatcagcctggcaacatggtgaaaccccatctctaccaaaaattcaaaaattagccaggcgtggtggcgggcgcctgtagtcccagctactcgggaggttgaggcaggagaatcgcttaaacctgggaggcagaggttgcagtgagccgagatcatgccactgcactccagcctggacgacagagcgagactccatctcaaaaaaaaaaaaactgcaggaaagcagactgtacactggactttgtctttatgcatacaaatggccttttccagtgcttggttgcagatatatctcaagggaaaaggaatagtcaagtaattgctctgggaataaggtgactagggaaagagaaacagagaaacaagagcctttatcagttggcccctcttgggtgaagctgttggtgtgggtaccaccactgtgtcataaatcccatggtccaaatgcggtcctcagtcatcttggccaaagttgacctgcagaagacaaaggctgaaagagagacttacaccttctcatcagccatatagaccagatccaaagtattatttgcattcactggaaccaggtgattggaacaagtaacttacagcatctcagtctctgtgggctgaaaggatataggtttataggcgtaataagatgttggctttcccaaacattaattatgaacaaacttgtttagaaatataaactattcctaactgatccccactttcccaaagccaagaaaatgtcagaaccttgagttcagggtgacacggtgggggtgacatccctgtgaaagagcctggacaaaccaccatgtatgttgtaaggaggttggcagaggaacaagagtaggacctgggggcccaggttgaccctgagatggtgcctcttgtctggtcctctaattgtttcctcctctgccacctgctcatcactgaccccagtagagggttcttggcagaaagcattaaacgggctgacccagggcttcctggacagtgatagccgcatcctgttgtcttataggacagagtgtgtgactggagtgggacattcttctttgtaaggatgcagggaactcaactacatttttcacttgactagccaagagtgattgtaaaacaaaactagtacactactcatactcctctctggaagactctgctgagctcccagagaaaataaaaccccagggaagggccatggcagtgtggggccacctttccccgtatggttccgggtcagggatctggatgcacaggggctgggttggctgggatggggagcttccaatgtgtccctttgaaaatctgattctgcaaagcagggcggcctcatccgtcactactctgacgggaacctctccccatctccacacctctcactgcttcctccaccccctgcctgcacacatcaggatcacgctcgcacatgctcaaacgcacactcacccatcctggtttctccccagatgtaacctgaggatttcctttttggacaccagagtgtccttgctcatcctctccatttcattcctctttatataccccttgtgattattttccttctttttcctttatgctgacacttgtaccttttgcttctttcttttgttttcctctcttttcttctttttaagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccaggtaggactgcagcatgccgcgtgtgcacttggcgtctcacttggcagggtgggctgcacgtctcgcccctggtccatctacggaggccaagtgaatgctggtgagaccatttgcttgcctcaggagcaaagagatggccccagagggaatgggaggacatgaattcaggtgccaggactggatacagttggagggaaaggacaggctatatctggccacttgaggtcatttggaagttatctctactttgaatgcctcctggcctgctgcaagggcctctgagaaggcagaccttcctcacatcccatgtatgccttagagatgaccctcagtttgctttgactaacacagctgagaacaccaggctttggtgtggtgtggtttgcttttatgtaagatgcactttgtttccataacccatggtgctctgctagtgctcggctctgtcaggtctttgtcctgtctcgtgtttgtgtgggagcgcggggcctttgtttgctatgaaacaaaggtgttttggttctggagaggagaatgcaggtctcctggggccctgactgacatggggtatcctcgaatagccatgccaggttttggggtgagtgtaccatcttctctctgggtcagctacaaagacccagagagcatttggacaaaggtagccttagggtgttttgagacctgaaaatttttttggagaaatgaacttagcaactaaacaaatcacaattctgattttggctatgctgttgactactgcgaaagtcaaagactttcggcaacttctcagaagcaaccaggtttgaatgccagctccacctcttacagtctagtgacttgggagttgcttcccctgtctgagactcagtttcctcatctgtaaaatggagatgatagcacctacctcaaagagtggttgattacaagggcttatgatcctgggaacatggtcagcactttataaacggaagctatagagccaccatcttgggtgatctagaattgcttctagaactgagaatatttttagaacttccttagacccagattgagttcctgaagatgtctccaagccatttattaagtatctagtatgtctgatgtccacagtaaatagtgcttaacccttaggcttgcaacctcagtttccctttgaggctgtagttattcagtctatgaataaggcctgcaggtaccagcctctgggcagaatacaaaggtcatttgtctctcctcttgagaaccctaagttcaaggctcctcaaaacaaggaggagcctagcaatatcaccagggcaataatagaggcatgcttgggggacacaggagcacagaggcttgagacacactaggccagacttccagctccagccaagcacatgtgggcccatgggtgggccagcacatcaggagtggggatcactgagggtgagccggcatggggcagtttataagaaatcaggcttagccttttgctagaaagccacttaacctctcacatgctaagcaggagtggaagcagtccatcccttgtagggcagtcataaggattcagtgaggtaattcatggaagtcggtgcttggcatgtgccaaggctccatatgtggggtcacccgctgctgtggagggctgtaggaaagcagtaatacctggcaaaggctttgcctggccctggaacaggttgaggaaggaatagaagagatggtgaagtggctagttgaaaagaattaaacgtttctgacacaggaacaattctataaacattctaagtcaacccaaggcacccggggacatccttatcgtcagtgttgagtcatcatcccggcccaattccaggatcctgtgtgtataggaagtgcgcacggtgccggatctccgagtaaggttaggggtatacgcttcctgcttcctaaggcaggataggaggggagtagctggcaacactgaagattatgttgattggaaagccaggcttgttgaaacttggtgttcctttcttggtgggcctccagaccccaagtgtaccacttcctgtcccctcccttcctcctgccctcctggcacaagccccttctccatgggtgtgcacaggctgtggcctggggctcgctcccccttgagagctggcatttgtgtgaaaagggctgctgcccacacctccccttcagccccctcactttcccctcctgtggctggagcaggagctgacaactctggaaacggggtccttcagaaggggctcctgtgtcttgggccccctttgggtgacagacatgctaaaaatgggaaggacttgtatgacaactgttctctggcagccccatcaggatgacgtgaccacaggctgtgttgcttatttggaaaaatgcattccagaccagtttgtgtatcaagaaaattgtcagccattattctccttgctgaactaaagagctgaaacaaaagttcacttttattgtaggtattggggaggtaggttgagaatctgaccaataatgggagggaattttacctgagaaccttaaatgaaaagatattctgaaatgttatgatcatttattctttgaagcatttaggatattccaggtacttagctgcaagagatagagaggggtgaacatcatcagggcttccatttagatgtaacttctaggaagctgttggggccaagggaaagtttccctcttatccttgaagtttccctaaaaattactgacaagaagcaaaaatttttttctttctttttttttttttgagacagggtctcactctgtcacccaggctggagtgcagtggcacaatctcattgcaacctctgcccccaggttcaagactccttcaacctcagcctcctcaagtagctgggactacaggcacatgccaccatgcccaggtaatttttgtattgtttggtagagacggggtttcaccatgttggccaggctggtctcatactcctgacctcaggtgatcctcccgcctcggcctcctcggattacaggcatgagccaccacgcccggccaagaagcaaattaataggagaaaaggcatacagatttattcgatcatagttttatgtgacacgggagccttcagaatgaagacccaaccaatggggtgcagaagcttataccatcttgaggttacagaagagtgggggctcagaggatggccaaagacaggttatggtggtaaatcagattttaagcagcaagacacgttatgggagggagaaaagcaaggcttggctagcaaaggggtcttgttatttagatgaaagctcacaggtagcagcctcggagagaatagatggtaaatgttccttttaggcctttaaaggtgtcagactgccagttaatcttttctagatctagacaagggaaagcctcagagaaaacctggctgcatcaatgcagatttttctctacaaatacaaatctcctgcacaaaagacagctttgcagagctacctctttttgctggctctctgacagccatgtcaaaatatgtcaaaaaaatatattttggggtaaaatattctgatttcctttaacacctttcctgacagcctcccccacccctgcatgagtggattagtgctctgactttgggctgccatagcccctgcaatggtctgtgtgagcctctctcagccccctttgcttccctgtgttcccatacagtatcagtgctccaaaggcgggaccgtgatacctaatgtatggaaggcacttcagtgaatgtttgttgaatgaaagaaaaggcaagccagacatggtggcttacacctgtaatcccagcactttgggagcctgaggcaggcggatcacttgaggtcaggagttcaagaccagccagcatgacgaaaccccatctcttctaaaaatacaaaaatctcttctaaaaaaatacaaaaatcagctgagtgtggtggtgcatgcctgtaatcctagctacttggtaggctgaggtgggagaatcacttgaacccaggaagcggaggttgcagtgagcagagatagggccactgcactccagcctgggtgacagagcaagaccccatctcaaaaaaaaaaaaaagacaaacaatgactgactccaactaaaggagtttaggatcttcaccgggggagtaagacctgttcccaaatagttacaatgcaaataaggaaagagagtcacaaacagtacatcctggaagatcaagatggggagaaataataaccgggaaggaaggtggttgtctggagacttcaggaaaaaaaaatgccaggcagggtgtcagagccccagtatgaggaggtggttgacttgagtgttggtaagaaaaattgactgataacagtatagatttgaagaaggcaagtttattagaaagaaagaacgctgcaaaagggtgcagcagggcactcagtgagagaggactgagcgcactgaggtggattttccttaggagcatttatggaccttaaggcagaagcttaagggcaatttggaccatactggccacataggtcatgatacatgattacatctgtagatgttttggtgccttaacgtcagcaagggttgcacagtgagtttcagcatgccattccagagatgtgtagaaattctagttacttataaatttggagggaaagaaatctgggaccagatgcctgctttaaatgatagggaagtctaattacttctaattttcccagataaggaatttggcctgtttgatggtcaccaggtggtcattgctcccttctaaattcctcagataaggagtttttgcctctggggcttgctggatggtcaccaagtgattttgctctcctcaaaaaagtagcatttaatctgagccttaaagaataagaggttttctcacagatgtacagcaggagggtgggactcgaggcaaatagctcaagcaaaggcccagaggtaggaccatgaaaggtgtgcatagagaatgatgcattccttgtttgggtgaggcttctggtgtccacaggtgaatagaaaagggggtttctggagaaggggctgggaccagaagttatgtcaggagtcacggtgaccctttgaatcagtcacctgcccacctccctcaactctgcagatgtgtggacacttcctgtgaaatggtttgacttttcactcctaaactgtttcacattgggtcagttgcccatgtttttaggtgtgttttttctctgaacagcagaagagagtgaatgaaatgaatgcaggggtcttcagggaaatcaggatggggtggggaagagcactggattgagagtcagggtcccaagttctagctctagctctgccattggcttgccaagtatcttttgttgagtcacttctctttcctggcagctactctgtccgtaaacaaaagattcagacaagagaaatgccattctttttagctttgatatcctttgattaggtaaaaatcctgcatgaattttagtttaaatgagaaagaagaacacatacaaaaatttaagtcaggggtttattgtcaacttacagaccttcacaatggaaaaatagaagttttgccttttagtttttgttctgagggacaacttaacttattggatgaaaaatgtgcgtacaaaatgcccaagcagtcagaattatcaaccaagttcttggattttcttgggcgcaattttggccaacaacatttagaacaatcaagaaagtaggctggggcgtggtggctcacacctgtaatcccagcactttgggaggccgaggcgggcagatcacttgaagccaggagtttaagaccagcctggccaacatggcgaaaccctgtctctactaaaaatagaaaaattagccgggcgtggtggtagacatctgtaatcccagctactcgggaggctgaggcatgagaattgcttgaacccaggaggtggaggttgcagtgagctgagatcatgccactgcactccagcctgggtgacacagcaagactctatttcaaaaaaattttaaaaagtaaacaaaaaaaaaggaaagtaagggggacaggtctgatggtagtgagttatctcaattcattgttcacagtcagttacagatcaaactggttgttccactaaaaaaaagaaaaagaaagcaaagggaagatcatcttgaaaaatcccatcgtttgcatgatcaaatatttactgagtttctctgtgacagaagcactatttgttgactggcatctagccttggtttttaagtgtttttacaaattgtgagagtacttcctagaatttttgaattaaagagaatatttagagaccatctactccagtaactgacaactttttctggatcacagaacctttgagaatctgaggtcagccaaggactctaggccagtagtttggggaggagagtgacacacagttttgcatcatttcaaaaggcccacacccaagtctacctgtgacagatcaccaggttaagagcctccagtcttttacaatgagatgaggaaaccaaggcctgaggaaagtgacagaaattttgtgatgtcagtttggttcctaaagggaaggaagctaatcaaataaaatctcaatatactggaaagctatgtgtccttaaagcatctgtctgagaagcataagaacaaactataggcttagagaaaggagaaggagggaaagtgactcaacttgagacagaaagatgtgacttcagagggaacacttctcaacacaaggaaactaaattagttcccagaaagataagaacagaggcataggcctgccttgaggatggaaatcagaaatagaaaaggaagctgtgatggaacctgcaagaaaaaaagaaattttaaatgttaagatactcaagtaaatataggaaacattttcctttgactcactcagaagggaaatctctaaatagagggcgtttaacagcttacgggatggggagagacgttggctgcggtacttacaaaaataagcagcaggtattctctcatcactaacggtagggaactggccaggcacggtgactcacacctgtaatcctaacactttcagaggccagcacaggaggatgtcttgagctcaggagtttgagaccagcctgggcagcacagggagactacgtctctacaaaaaaacattagccaagtgtggtggcgagtgcctgtggttccagctacttgggaagctgagatgggaagagcgcttgggtctgggaggtcaaggctacagtgagccatgatcacaccactgcactctagtctggacaatagaaaaaaaaaagggtaagggactaagacccaaagctaaagtgtctacccttataaaggtgttaggagaatggagcatgtcagtaggaagtgccagccacagggtactggacaaattaaggtgacctgttggtgagcatctctctctagctcttctgatatcttcctctggcagagcacaaacctagaagtttggggtgtggtggaatgtgcagaacttggagtctgagagacagatgttccaatactaactgttcacattcccaattcacacacggcaggtcttcgttttctcatttgtaaaatgaggtcaatgttgaccaccttcttgagttgctatgagaattaaatgaaatataatagagatgaaagcagctagcgcagcctgtaacgggaccataaatacctgttgtgtgatgtcgaggtaccagggaaatgaaacaaaagtagtttactttatccaccttaccctgttccacctaagagagaaaaatggtgggtggggaggatgggaagagaagaaaatagagaatgatgggaaaatcattttactttgggttacacaaatcgagaatttagaaaatctggaatttgtgctccccaaattagtttattctaccttcagtataaaggcataagctattcttggaaagcctttggtttcttcacacttgaatatgtatctgccattaccccccaactgtcttatgaaaggaagagaagactgtatgatagtctatgaagagaaggctgagcattggttgagtatttactgagcatttaagtttagtgttgtaatcagattcaaattacaacaaagttaatgtgttgtctagtgagtgacttgcaaggagataaaatctagatggtaagcaattgaactagttgtttgtaattagttttatatttaagctgtgatctttttctcagtaaactcaataagataactcagtggagtcagagactgttttgagggtgctctggtggtttcctggagctcaaacccaggagactgactcattcgggcctttctactcctctggaagagtttgcccatgatgttccagtaggtgcaaatctatcactattttggggcagtcgcttgggatacttccagaagtgagcactccatccatatctggaggctgcagtcgaaagccttcctcctcccagtcttcagtaagcaatgagtagagtgctgcctcccttaagccaagtcagcccctacccagtcctacttcttaacccatgggacaggcacattgcaatcatagagcattaaagccaaaaagacatttatgtaaattatgtccaatcctcttatgtattttagaacttgaagtcctaagacgttaagcattttgttcacaagacaatcagttagtacagagcatggcctggaacctggattttctcactgtcccgctgggaggtcagggtaggtcaccagaaaggtggggtggggtctgagaagacttgggatgtgagatgactagaggagtgccatctctgtgagactcaggcaggttaggggagcagcagagcctcgtgctgtttctagaggggatttggggccagggagaagtagagtttctctgtcctgtccacatcttcaggacttcctgctgttctgtagcctgtgtgcaatctatttgggcccacaaggctttggcacacacccaaagctggaagcggatgcttagtaactccacagtagcgccaggtgttctgtggatccagagggattaacagctccagggaggctaagatctgatttctgggggatttctgtgaactgaaagtagaagggcaacagcaaggacgcatgcagggtcacccacttgaggagaatgaagcaagctccaggccaggagaggcgacttgtgtacaaatacagaagaaagcactttctggatcaaggactgtcacctgcttcctattaatgggggaaaggaggggagtgcagtgtgtgtgtgtgtgtgtatgtgtgtatgcatgcgctgggctggttgtttttgtaaacacgtgaaaaactggaatgccgtcaccagagttggaaatgtccttagcattttttttttagtcttaactttattcttttttattcttaacactagatgaagtccttgttagaacttgtatcttctcttaggcttaaataagggcagatgctgagtacctggggagggctcagagaggcattgtctagtagaaatataatgtaagccacatgtgtgattttaaaatgttctagtacacacagtaaaatggaacaactgaaattttaataatatattgtaacccagtatatctaaaaattattactgagattttacattctttattttgtactaagtttttgaaatccagtgtatatttttacacataacacatttcacttcatacttgccacatctcaagtgtccaacagccacctgtggctgctggctacaatcttggacaggataggtccagaagaagcactgtacaaagctgtaaagtggttagaaaatggggacaggaaaagaaaacataactagaggggaaaaaaaacctgaggataaacagccttcaaaatgaagggctaattcttgtgatagatagtaatggtttccatttccactgagggtgtacccccatgccatgtctccgtcccctgaaaaaaactggtttacatttcagttatatgagctatttcacttaaatctaaacagagagaaattgagtcttaactaatagaataaatgtttatcttgccttcttccttcatttattcaacaaacgctaagtgaggcacccagtcatccctacctctcaggaatggggttaagtttgtactatacagatgttaaagctatgatgatgattatccttagctttgggcatggcctgagaccaaggaaggtacaaggtggaccatcaatgtcccttccggtactatagttcacaattaatgattggacgctattaccgtacaccgtatcttttacataaggaaatgtctttgaacacctagagtaaaaagtattcaagaagagaaatgatagatagtgcctgttttcagacaaggcagaaattgggtgttgctgtcatagttacacaagcaatctaatcatgatccaagagggaggtggcaggtagtatatggagattagatgtcaaagggctcagctttcacactaccttgtacaaacttcacaaggtcaggtcccagccacctggcaaaggcccaacatcctgagacattgtagaagaagcatgaaatggcctctttcgttttgtctcttcctttacccctgtcagagtccgaggtgactgatttgagtgattgcagtttagaaggggtttggagaacttgaagatgcttcccaaaaggacaagagtatagaagtggggtcgggcacagtggctcacgcctgtaatcccagcactttgggaggccaaggtgggcagatcatttgaggtcaggagtttgaaaccagcctgaccaacatggtgaaaccccatctctactaaaagtacaaaaaaaaaaagctggacatggtggcccacgcctgtaatcccagctacttgggaggctgaggcaggagaattgcttgaacctgggaaacagaggttgcagtgagcccagattgcgcctgggcaacagagcaagactccgtctcaaaaaaaaaaaaaaaaaaagaaaaaaaaagaagtagtgcctgggatggaactcctctgagccttaaattccttattctgcactcctcaagtcagagggttagtacaaaagtcagatatgtaatggatctatatatgcttgtaaaatatcaggttcttcttactatatttgattcactgatcctcttttcagcaccaaattgtttgctagataattgattccagtcactcctttgggatgaatgaagttgagtggaaggaggctaggtttctgtaaactatggagatcttgccaagagattgtctacatcctctctttataccgcatttgacctgaggtcatgaggccaccagctggaatttggaaatattttgttttttatgagaacttttgttttcatgaggtgtgacccagaccaccggtcttggcatactatagccaaagaatctcagtgtagggcagttgaggtcctctgcacccttgccgcctacagttggtctgtgaaccagcagtgtcagcactaccaagtagaaatgcagaatttcacaatacagcccaggtgtatcaagtcagagtccacattttaacaggatcccaaataatagctatatacattaaagtctaagaaggatggctctacaatatcccagttagtcatagtccacagcagcctcagcttaaacagctgccaaggcagccaactcatttccacttgaggcagccccttgtattgttggattgtttggaagttctcccttctgtcatgttaaaatctgcatgtcattgtcacccactcaaggtgacatttcagacgtttcattcttctgaaagcccacatagaaggtacttggaaatgtccatttctttcctttgtgatacggacaccttaatccagaggcagtgagtggagggtgggtggtgttggagccatacaaggtcggctcccagtcacccggcaaagacctaacgtccagagtcattgtagaagaagcatgacgtggctcatttagttccgcctcttcttttactcctgtcagagtgcaaggtgactggtttgagtggttgcagtttagaaggtttttggagaacttgaggaggcttcccaaaaggacaggggtattgaaatgatgcctgcaacggaagttagtcctgcagggcttgctaacggttgaggacatttccaggggaggtgaacaggagagggtggtctggtggagcggaaagagcagctgagccactttacctcttactggctgtgtgatgttgaggaatgcatgaaacccctctgagcatcagcttcctgggttttttaagaaaacaatgataaaccctgtcctgcctgactccagggtttctgagggagtcactgaagatgaggtcagtgagcacacttgataaggcagaagatggtctgaggataaaagacaaggtcagttgggacaatagatgaagccaggagaaaagcctaccactgacttgatgtgtgacctcaggggaggctcccactttttctatgtctctctgtgaaacaagtgggtcatgcacaaaagatttctaagcgcccatctagaaggccctggagttgtggcctattgctttatttttttatttttgagacagggtcttgctttgtcacccaggctggagtgcagcggtgcaatcatgctcactgtggcctgaatctcccgggctcagttgatcccaagtagctgggactgcaggtgtatgctgccacatccagctaatttttgtatttttttgtagagatggggttttgctttgttgcccaggctggtctccaactccccggctcaagcagtcctcctgccttggcctcccaaagtgctgggattacaggcatgagccaccatgcctggccagcctgctgctattattgcatgttacctggaggattttttcaaggatggctcttcagggtatttatttagaaaaacttcctagagcttggaattgagtcctgtctgggggacatggttccaaacactctccaagtgaaggctggcctctacaatggaagccccactcaaaaggcaggtttgcttggccatgtttgcacctgtgtttctatgttagcatgtggtacctgggttggtaagtgaagagtgacagtttcgtcacacacagtcctatttctggaagcaagctctgtcctacaagctatctgaattcatctcatacctcactggagtgtgtcatttgcagatttttccaggggaatggtcttggttggtacttcatatattaccaaggaagttttcaaaaatgttattccctttttcagtttttataagtttctgaaatacagcagacttgatggttctatgggcctgctctgctagagggggcttccagtcaacaaaataaccaaaactggctttgggttcagccaccttccctagatgcttactagctgagcgtgaggggaccaatatgtgtgaagggacctggctaagatggcctttctgagtctctctcctgccaatctggggaccctgtgttgttcatcctcacctcactgcagccatgtttccaatttcccatttcatttcctggatgcttgcttctaactctacatttgcattttcttctgtgcacccaccctgttgttgtggagacttggtggccataggccgccggtatctggtgtcatccaagcgtgatggtgtggtacgtggatttgctcatgcttttattttgaatcctttccaatgtgacatctgctaaaatgtctcccttataatttgcttggtgatcacagctttctcatcattcattgagagcaggaccagatctcacagaatctgaaaagagctatgtggtaagatgcctgttgaataagactgcagcttttctaaagagaatttttactgatccttacttctggaatctagactagagtgatgcctggttaacccacagaaatattatttataagaattctgtggctattgtagtagagcgagatgttaggccactgcattacccccagcccctggaaaaaagcagaggaatttagagacgatatttctactctgcctatatgtgggattaaattaatgtattagtgcatgattggggatacatacttgcatttctaccctaaagtattccatttgtgacagttactcactaatttcaggcttttatgctgctgcctttttttttttaatattcttactaaattccaaattcttctgtatcttacctgtttttccatgcttacgcctggatccctcctgcactccactactggaatatctatttttttaacctggatcttcaactctgttttctccctggacttatgtgcttcgtctggaatgttacatctcttcctctctttcttttttttttgtccccatgttgactgttttattggggtttctggatatctcggggccacctcacaggaagcggtttgcaatgagatcataaacattgccgaaaaatctgttcattactgcagcactgtttctcatccccttgactttcatcacaaggtatccccttctgacaataaatcatctttaatcatttctcagcaacctcaagcccagcagcgaagagtcacccccgacaggagtcaaacctcacaagatttgtaagtactcctggtgaacttcgattctcatgttctcagaggactgttggtcttagaaagtgggtcgctggctgaatatggggcagtcatttgcaggaatgagtgaattacacccaggttctctcctgaggatttctagtgaaggccatgttctgcatcagccaaggtgaaaacaggtggcaggtaaataaaggccgtcatagactgctgggagagagagacaggtaaagattaactgctgtagaatgtcaaatgagagctgtgctgactggtttcagtgctagtatagtgggaatatagaggaaggaatggttaattctgaccagccgtgaatgaaagggttgcttcattcattcattcataaaaaattattggatatctcctatgttttaagcacataggagaaaactctgtgcacagagaaagagagatttggaccaaacactgaaagacaaattagattctgagagctagaaaagggaggaaaatatcttcccagaggtgaggaccacatgtgcaaaggcatagagtgggtggtatttggagaacttgaaagggcccgtgtagctgcagcatatggttcatggaagagatagagatgaagcttagaggtgggatgggaccagatggtagattccagaatgcagttgaagtaagtttggattttattctgcaggtactagggagccattgaaggtttttgaagtaaggaacatattgatcatattttgttttagggagataactctggcaacagagtggagggtagatttcatagatcagggacaaagatgtttgttagaagacttcaatccagctaagaagccatgagggcctgagccaggacaaagtgggcattttgtaaccgtggaagtgagtataattaccaacagagatacatgtaaagaagcctagccagccacagagacagagaagggcaacaagagatgccagtgagggtctaagacgttcactttcacagaacagctacagcatctggtcagcagtgtcacctgccccagagaggccaagagtgggaaatgagaaatgtccaccaggcattttccatggcaactggaaaaatccctggtgacctctgatacggcagtattagtgttggtaggggtggtggcaggtgctgtgttaggaagggtcaatggtgagtggaaggcggggggctatagatcaagggaatagcagagtcaggggaggtgtttttagggtgcagagacaagcaaattttaccagagtaaaatgccagttaatgcaaataagatgtaagtgaggccaggtgcggtggctcacacctgtaatcccagcactttgggaggccaaggtgggcggatcacgaggacaagagatcgagactgtcctggccaacatggtgaaaccctgtctctaccaaaaatacaaaaattagctgggcgtggtggcatgcgcctgtagtcccagctacttgggaggctgaggcaggagaatcacctgaactcccgagacggaggttgcagtgaaccaagactgcgccattgcactccagcctagagacagagtgagactctgttaaaaaaaaaaaaaaaaaaaagtaagtgaaggaagagcccaggaagggggttcaacgtggcttggagaagggacctttctttcctcacatgtgtgagcaggggcaggaaggtgagtggaggcacagagacttaaatctggaggggaggaggattaaggtgctgtccacagcaagcttccatctccagaagtgggggcagagtgagagctcttggctgagcgtggggcaccaggattggcaagagagctgggggaaggaccccatgggacaatgttctgaggagtatgaggttcatcccaaattagagctgactggggtacccaagcagcaagagtgtgggactttgtccagccagtctccactgtctgggagtgaaaatagagaagcagatattggagttatttcccagggctgaggctggcaaagcagccatggtgggagttaaagggcccaggcattctaagaagctggcaaggggcatgtgttgggaggccagtaggagactccaaattgagtaggagacagcaggcaaatacagaaacatgaaaaaaaaaagtgtttatttaccaattggaaattgatctgcatctcttaattcctcatttgagaccttccttctggcaaccagatccatcctccaaattatcaatacatttggataaatatggaaagtgaagttgtccctctggttttagcagagcagaatgaacctcttgtttttgagaactgactccacttgcttgtttctagtctttcttgcttgcacactggaattcattgacatctactggaaatggtagatgactggctcatttacagttttgcctgctactgtcttgtctcaaaatagtaaacagagttgtgaagttggtacatagtaggtgcctcttatgtatttgttgaagaaataaataaaaacaaagcttttccttgatgccaaagcaaggatcagatttcaccacaagcagtccagctgtctccagtggctgctagaacagacaaaacagcacagacccaatgccttaggccaactagcaagtaaataaaaatcttgccctcaatgctcactgggatagaaaaaagaaaaaagctttcaagggtttcagaaaaatgacatccacatttaaaagcagtgaatgaaatgtgtttaggcatgtaaagaaactcaagatagttttgctaaacagtgaggcaattggaatgtacttttaatagcatatatatagctattatatatggctattatacacacactttttttaaaaaacaaatgttttatgttctccatatatatgaccagaatgtaatgtctctgggcccaaataacttctgattatgcttgataatctacatatattatcctgtgttaaggaaaaggcttagtttactttaaagcaggggtccccgatccccaggcactaccacctgggctctgcctcctgtcagatcagcagtgcattagattctcacaggagcgtgaaccctattgtgaactgcacatgtgagggatctaggttacgccttccttatgagaatctaactaatgtcctgatggtttcatcccaaaaccatcccccccaccccaccccatctgtggaaaaattgtctcccacaaaaccagtccctggtgcctaaaaggttggggaccactgctttaaaggcagaggtcagagtagagtaggaagtgctctagataaaaaggcttggctgtggtaaccaaatgaagcgaaataagagtgatcatggcttgcttgtcagaagttctccatccctcagtcttaattatatgttgaatgcatctccccaaatgctaagttattagggaaatagtcaataaaatgcttttatccctactgataagtaggaaacactgctgaaaagtttattgaacttgaaatggagtttaaaaattccttatttaatcctgtcgacatttgagtcacttactattcatttttttcatgtatagatttagctatcaagcattatatagctatataccacagaatgatgatgagttggaactccgcgatggagatatcgttgatgtcatggaaaaatgtgacgatggatggtttgttggtaagaatctcatcatgcttttcttactagttgtgtattgagggaataacagggggcgatgagccatgcaaaaagcaaagcaatctcctctgcacagaaagaagagccttctcagatttttatgaccttggaaattctgggccaccagtctgtgttgctattatgatggtgtggatgttgctaatgttgaacctgaaaccaaatctgctgcacagaagagcagttgtcagatttattaattgggtttccatttattttttatatttatttatttatttatttatttatttatttattgagacagaatctcactctgttgcccaggctagagtgcagtggtgtgatctcggctcactgcaacttctgcctcccgggttcaagcaattctcctgtctcagcctcccgagtagctgggactacaggcgcctgccaccacgcccagctaatttttttatttttggtagaggtggggtttcaccttgttggtcaggctggtcttgaactcctgacctcaggtgatccacccaccttggcctcccaaagtgttgggattacaggcataagccaccgcacccggccctagtctccacttatatttatattgtgcatgtgtctattttgcatttggaaattttatttttaaaacccttatgaaataacacaagaaaatgttgactgagcctatgtctctaccatgaaactcaggcatacgtgtagacattctaaagaccttatttactccaggctttcaataatattagtcaaagcaccctgcttaattaaaggatttgcctttacaaggagagagatcaacatttattgagattctattacaaagcagacactgtgtttgatatgcttttattgacgttctctcaacaaacagccctgtaagataagaattatcctcatttatcagattcaaaaactgaggcccaaagaagttaattaactatgccaagatcaccagggtagcaaatagtggggccaggatttgaactcaggccacccatctctcctgaaatctgtgttctttctgctcaggcatgaatataatgttgggagatattgacccactctgcctcagtttctccctgtacaagtggctttaccttcaccttctttccaaagaccagcccttccctgatttttctggcaaagctttgctaaagcaaagtaatatcagggctggggtggtaaggacagcaagacctcaacatgaatgagaagtcagtaagatttgccttgtcctcaccagcctcttagagaactaccccatcctcccgaggtcctcagaagcccacggccctcactactttgagtcgtctgttcagtagaaatcaggtctgagaagtcagtgaccactctggtgcagtgcaatccaatagaaatgcaatgtaagccatgtgtgaaatttaaaattttctagaagccacattgaaaagaagtaaaaagaaaccagtgaaattaattctaatgtattttgtaaacccagtgcattcaaaatgctaccatttgaacatgtaatcaatattagaaatggttaatgatttattttacagacatcttttcatactgtctttgaaacccaatgtgtattttatagttacagcacagctcatttcagactagctacatttcaagtgctcagtagtcacacgtggctatcattttagagagtgcagcactagtatgcaatagctgttaaactcgttcaggaatatatatattttttatgagaacttaggtgtgggaaggagcaccagttctctaatgaaggcctgccaggcagctgggtaaaggaaatattttgggatgagtatcttccttgcatccctgaactcttcacttgcttctttttttttttgagatagagtcttggtttgtcacccaggctcgagtacagtggcacaaacttggctcactgcaagctccacctcccgggttcaagtgcttctcctgcgtcagcctcccaagtagctgggactacaggcccgcatcaccacgcctagctaatttttatatttttaatggaaatggggttttactatcttggccaggctggtctcgaactcctgacctcaagtgatctgcctgcctcagcctcccaaagtgctgagattgcaggcgtgagccaccatgcccagcctcctcggtcactttgaaaagtagcattttcaaactacaaataaagtagccttagcagaactcatttttctcatccataaggaaagatactaactagctatgtggccctaggcaaggttcttattatctctggaccctaccatctcagttctctaaccttcttggccattctccataggagttcaactagatgttttaggtttcctaagctttaacatatttttttagcttagaagtttcactttgggtagtaattccaacccattggtagtggctgcttgagatgtgtacaacaggattccgaagccaaatctaagccaattgtgataagggtgcagttatcaaattgggatgtctgctaaagaaacgataatgatgatacaacatatatttgccactcctgctttagagagagaatcccaagggaaggaactagattaaggatcagcagtgctgcatctggagcagcccaggaagggctttgttcccagatggctcaatgctcctggcttagcaggagccctaacaaggttagtaccaaagatagggactcaactgggggcttaggcacaagctggataggaatttccttttgatgggtggccatagtcagtgggcttttagaaactgcatggtttagaaaatctaaatctcaggtatcttcttgtgtcagataaatgtatgaactcctccacaaagcagaagtgttggaaagagcaatggactgggagtcagaagacctcggttcagattctgcctctgatagttactaagcagtgggacctcagacatgttacttctactctctgaacctgggttccttctgaaaaacaggagtactagaaatgcctacattgcttaccgcccagcattatttggcagcctaagtgagataagataggggaaagtactttggaaaccatacggtattctctaagctgcaggactgttacaaggggttttggagcagaaatctctgcagcgtgctgtctcaactcaagcgagtgggtcttctcatgttttgtatgtgtgtgttttttcataggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 38286 - DNA, 20454 bp, Homo sapiens
gctgtaccggaacgtggggcgaggcggtgagtgtggcctcctggcctctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgacttccagtaaggtctttccccgaactgaggctttgtttctcgtttacaaaatggatatcatacttgtattaaataaatgtttactaagcgttgaatctgtgctagggatacagcaggactcaagtctcgtggcgatgacagccttcaatcaaacatccaaaactgcagttgtgatcattgagacggaaaggtacaaggcaccccagattatatcacaggagacctgacctagccccagggcaaggaacctttactgaggaggtgaatattgagctgagatcagaaaaaaggatttgacaaagtggggagggaagagttttctatatggagacagcctccaatttcaggttctgaaagaggccgttgtggctggaacagagagcttgtgggggaccattgtgtgacacaagctaaaggggttgccaggagtcagaccgtgcaggctttgtaggtaataggaagaattctggtttttcaagaaccatatgggaaaccactcagaagctgacatgggtggtgttgtgattagattggcattttgaaaaggttactgctgttgaatggagaatgggttgaggagcaagcactctgagtgagggacgatggtagcttggattagggaggtggtggagagaagtggatggatgtgactttaggtgttccaggactgtgaggaactcacagagctgtcagtgacaggggctggtagactgcagagttctatgcatatttaataaacgttttcctagcatctcctctgtgctaggccctgtgccagctgctggagatatagtgaatagaattacagactggtggaattagcatgaaagaaacgtcattatcaaggaggagcacacagatgtcacaagggaaaatggctaattgatgagctgttattgtaaatggaatatctgttcattcagcaaatattaaatactttctgaattcaggattacaaataggaagatgatacgtattattattattattattattattattattattattattattattattttgagacggaattcgctcagacccccaggctggagtgcagtggtgtgatctcagctcactgcaacctctgcctcccaggttcaagcaattcttctgcctcagcttctcaagtagctgggactactggcgcacaccaccatgcgcggctaattttttttgtatttttagtagagatggggtttcacagtattggccaggctggtctcaaactcctgacctcattatccatccgcctcggcctcccaaagtgctgtgattacaggcgtgagccaccacgcccggcctgttgatacgaattatttagagcagagtctttcaaacttttatgactgtgacctacagtaacgaatacattttatggcacaaccaagtatacacacaaacacacaaagctccagaaaacagtacttagctttactactcatgatgtattgtgatatttcaaaaattctgttattttcgtttaaaaaataatgctggttgagaccttcacattgatttcctaatccactaatggattgtgacttgcagtttggtgaaacacaaagtgctgattcagggtaagagtcatttgtggtggttttgaggtaacaatgataaaatgtgctcttatttttggaaaaggattggtcttcctttctgcactgctttatttaaagtaaaaagggtaaacagggccaggcatggtggctcacacctgttatctcagcactttgggaggccgaggcgggcagatcactgaggtcaggagttccagactagcctaggccacatggtgagaccctctctgtactaaaaatacaaaacttagccaggtgtggtggcacacaccggtagtctcagctgcttgggaggctgaggcacaagaattgcttgaacccgggaggtggacgatgtagtgagccgagatcacgccactgcactccagctggggtgacagagcgagaccctgtctcaaaaaaaaaaaaaaaaaaagtaaacaattaaacaggcagctcgtttttctgtgtgtgaaattttgacgtcttggctagattggaattgcctagagggcagtgactgtcttaatctgtgatgttttttgggggcctggcaaagatcctggcacaatgcaggcactcagtgagtatttgttaaattagtcaggtaggtatcttaggactagaaggttgcataatggtttgtttacatttgttcatgttggtaccattcttgccgatatcccagaggcaatgtctgggatattcagaagtaggtaaaataagtgtactaagctctttctcttctggccagctttctcttcctaggctagctttaccacctgaattcattctggatgaatggtccagagccaccactgattgtgggctctttgggaagttgtttcactccctggagtttaggttttttatgagtgaaagaagaggggagatttgtggtaggaaagctctctagaccctgaacaaactttagatgctgagcctccacttgctaccgtctgtccatttctgggccttccctgaggcttatgggaaactggatatgtacttgatttaatctttccaaatcttttgggatagttttttggcagaattgtagttttaaatgatgtaggcatatagtttagagtgacctgtccaggcattttccaccctcaccctctgttgtgagaaagagatctgagaagatattaagaatggacggtggacagaacactggcctgcaggcagggtatccagattctaatttgggtcctggtatgaccatgagcatgtcacttttctttcactggtatcttatagctgtgaagtgagtgtccttgcatgttaagccaaaacacaaaaatcctttcctttaatcctcgtttttctcatctgtaaactcaatgcagggttgtcatgaggattaagggaaataattatgtcaggggtctaactcaatatctggcacatacagaatgcttagcaaatgaagcatctttcccccacgttctgattaactctggtttctttctttctcagctgttcatcaaagaaaaagggttcttttggtcacccaccactggccccatggctgccgtgcagatggatcctgagctagccaagcgcctcttctttgaaggggccactgtggtcatcctgaacatgcccaagggaacagagtttgggattgactataactcctgggaggtcgggcccaagttccggggcgtgaagatgatccctccaggcatccacttcctccactacagctctgtggacaaggctaatccgaaggaagtaggccctcgtatgggtttcttccttagcctgcaccagcgggggctgacagtgctgcgctggagcacactcagggaagaggtagacctgtccccagccccagagtctgaggtggaggccatgagggccaacctccaggagctggaccagttcctggggccttacccatatgccaccctgaagaagtggatctcactcaccaacttcatcagcgaagccacagtggagaagctacagcccgagaatcgacagatctgtgccttttccgatgtgctacctgtgctctccatgaagcacaccaaggaccgcgtggggcagaatctaccccgctgtggcattgagtgcaaaagctaccaagagggcctggcccggctaccagagatgaagcccagagccgggacagagatccgcttctcagagctgcccacgcagatgttcccagagggtgccacgccagctgagataaccaagcacagcatggacctgagctatgccctggagactgtgctcaacaagcagttccccagcagcccccaggatgtgcttggtgagaaggaacaaggctctttgggagtgggccaaggggaggatattagcagaggtgttttggaatagggagtacatcttgtgttagtccagcagcaactaaacctggctaggaggctgaagatacaggtgtgtctttacccttagccctggagatttcgatttgagagatctggagtggggcttccgcagtttctatctgtctaataaacaaacatcctaggtgaacctggtgcagataatcttctgtttgggaaccactgatagagcccagtcctacagaaggaaaagatttggcccactgagtggctgaactgagacgagaacccaggactcttggtttctgggccagacctgtgttcgttgtagcctctcacctgcctgctcagtttgctcctgaccctcaagatgttggtctctcaactggcttagaacaggacagtgattttttttttaatcattacagtttttattgttaccttcccttttattacaaaaatgatagataataatcataaaagaaaaacaaaatttacttcaaatctcactacttagaaataaccatttaaacagtttggtatatttacgttcctttttttctgtgtatttctatgtatttcatttcaatgtcttctctgtttatttctatgtacttcctctcagtcttaaaaattcagtatatgtgtctgtatatatatgagtttttataaaaacaggattgaagtatattattactttgtaatctgccttaatataaatgttttttcatgtcactaacagtcacttttttagtggctgtttcatgttccatagttattggaccagttctctgttatggaccattgagatgctccctgttttctctattgtatcatcaagtggccgggtgtggtgactcacacctgtaatcccagcactttgggaggctgaggccggtggggatcacctgaggttaggagttcgagaccagcctggccaacatggtgaaaccccatctgtactaaaaatacaaaattagctgggtggtgtgcacctgtagtcccagctactctggaggctgaggcaggagaatcacttgaacccaggaggcagaggtcgcagtgaaccaagacctcgccattgcactccagcctgggcaacaagagccgtctcaaaaatatatatacatatatcatctagtgaacattctcgtgtgtacttacacatacatttagggatagaattgctgggtcagactgtgcatgttgccaggagaaggtttttgcatccttgctggctggtaggaacctgttgcccatcacctttgacagcattgggcatgacagtttaacaaaggcctcttccaattggatagctgaaaaatggcaccttgtttatatttctttatttcttaaatactagtgacagcaaatatgtgtcacattttgaacagctatttttatatatatttataaattttccaggtaatttgcatattttcttgttggaagttcagtgagaaatttgaatgtaggacttcttttttttttttttttttttttgagacagggtttcgctgtgtcgcccagggtggagtacagtcagtcacacaatcatgtcttactgccacctcaacctctcgggcccaagtgatccttctgcctcggcttcccaaagtgctgggattactgtgcctagacaggactttttatatcattggctcagctaatgatataacctatattttaacaggtacatcttttgttgttgttgttgttgttgttgttgttgttgttgttgttgttgagacggagtcttgctctgtcgcccaggctggagtgcagtggtgtgagttcggctcactgcaagctccgcctcccgggttcacgccattctcctgcctcagcctcctgagtagctgggactacaggcgcccgccaccacgcccggctaattttgttttgtatttttagtagagacagggtttcaccatgttggccaggatggtctcgatctcctgacctcatgatccacctgcctcagcctcccaaagtgctggaattacaggcgtgagccaccgcacccagcctttaacaggtacatcttaatgcattagtattttcgtataataagtaacttttaaaagtctggcttaaaaatgaatagaaatcctgtctttctacctcttaaacatttcaattcttcaaaatatatcttgcgaaaaggtctgttacaggaataactttgttggtttttttttttttttttttttgagacaaggtctcactctgtgacatgggctggagtacagtggcatgatcacaactcactgcagcctcaacctcctgggctcaactgagcctcccacctcagcctcccaagtaggtgggacttcaggtgtgtgccaccacgcccagctaattatttttggttgagatagggtctccctgtgttgcccaagcttgtctcaaactcctgaactcaagcaatcctcctccactgacctctcaaagggctaggactatccctgccaccgcacctgtccagggataattttgaatctacatcacacctctttgaaaaatataatttaattttagataaagtcagaaatgcacaaatttaataaatgtcctaaacgcaaataataggctaatatttagtttcacaaaccaagtaaagccagctgaagaagcaaatcattaacctatattatacaaagaaaatttgactatatttgaaaatattggtcagaaatccaaaatttctaaaccaggtagctattcacacaaatcaaacttagttccgtatgcttaggaacagggagctagtttttccaggtctctggaggtggcacagatcaaacgccatgcatttaaagaggtatttggtgttgagtacatctcttctttttatggcccacatgtatgtatacctcattaaatttccagccacctttgaagtagagagaatgcctgtgatgaggagcagtattctgtggtaaccagagacccagttacttgcccagggacagtggtgtctggatcatcaggtctctgtttgagatgggcatctgatagaaattgggaacataatattttttgagtgctactttgtgccaggtcttattctaaatgctatacatgtactatatccattcatgtaatctttgctacaaccctcaaataaggaaattgaggccttaatagattgagtaacttgcccaaggtcacacagctgctaagtggcagagctaagatttgaagctaggcagtttggctccagagcccatgctcttagccaccaagctgctcatagagattaaatcacagagccctgtggttaagcaaacaaaaataatctgcctggcaggctgaccctggaataagtactcatgaatttttcttttgtgggaggttccagaactgttcccacccaatggagaatctgttttatctttccgttgcccacattgtgaagcattagatgtgtggccttgggcaagcccttgaccttatctatgaaatgaggcaaataccatcttcctgatcgccttgtggagttgggctgagggttacatggtatagtgcagtatttcctgaccctggagcagaccatccacattagaatcacctggggagcttgttagagctacagatacgaaggccccatcatctctcctccaccagaacctctgagggtgaagcttgggtagctttacttttaacagactctcagtgattctgatgggcagccaggtttgaaatccacttggcataatatccatgaacacattttgtaaacttaaaatgccaggcaaatactgggaatacctcttctctagcagtctgattttatagaaatccaaagccacaggttggtttcccatggcttgaattcatagcggttcagcagacatctattgagtacctgttaggtgcaaaatctcctgccaggctctgcaggagtgacaaggataaaagctcatctgttgctgaggtccagtggaattcatggccttgtgaatagtgatggagagtgtcagctggtcctcctctccctcagaatcacttctcctctctgcacctttcaggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggtgagcagtctttctgactgagctgatgcacatgtgggtcagaattgaggcaacagtatgtgttttgtttctcgctattcttccatgaccccaaaatttttaaatttcagtttcctagtcttgggatatttcctgcttttctctctcttactcaattgtaagtgcctctatgccagaaattttctctctgtaccaccctctccctacacctcgtccccagagtgcctaacactggggtacttggatttgaattcctcccactgctttggtttactcagcttaaaacagcgtttctttctccctgtagccatgaattgctacaacccagtaaagcagaattttgaagtttgttattcccagtgaaacatctgcagctccttagatctcatttaagcattaaaataactttgatttcctgttcaaacaaaatgtgccagtttctgcagagattctatgacagaaaaagtgaaatttgcttttaacttggcaattaaattttcattatgagtggtaattaggaaagaagcttcaaacaacttacaatcttcatcctatgctatttcctccctttgcaaacagattagtcctttatgtacttgggacagcctctgtcactcacattgtgtaactttctcaagaatagaagaggcagaagctgccactgtcagtttccatactttccctcccatgagcttctttcttctccctgtgtgtaatacccccatgaggcctgctccatataaggcagcctttcaccaaccttccaatcccactcggggtaacagaagggacgagcattcgttaaatattggggctgggcgtggtggttcatgactgtaatcccaacactttgggaggtgaaggcaggaggatcacttgagcccaggaattaaagaccagcttgggcaatatagtgagaccccgtctctccaaaaattaaaaaattggccaggtatggtcatgtgcacctgtagtcctagccacttgggaggctgagacaggaggatcacttagcccaggagtttgaggctatagtgagcaatgattatgatcgtgccactgcactccagcctgggcaacagagtgagaccctgttcactcattgaatccctttggagccttgtaagatgggggtattattcccattttacaaatgggaacacttgagaatggttaaatcacttacttgaagtcatacagctggcaggtggaggtcaggatttgtacccaggcctgagtcttggtttcctgcctgtgcttatgcccttgtgtagtgaacacagtgtgaatcccccagaaaggattcttgattgacatcagtgaagacttcatcgaggtcctgtttctcagaggtacagaacgcttttctaaagccaacctactgttggatgagtccctgtgagcaggcatctgacttaaagctggcagttgaaggacctgtgtaaaccatggcaatgagtcagtcaagcgcatgatttgagcctggtctgttccactcagaagagctataaaactgtccttttactggttcttcatataacagagaaattaaacccctttgtccttcctctgtggggaaaattttccccaaaggtactggttatgggttgtgaggcagtgtgaggaggcattagcctgctaacttgcctctggcagtggctgcttccctcctgatgcacgttgatgcgtcgcacagacacaggagggccacggtgttgctggctgtccagaccattgttagcacaaccagcagctgagctctataattgccaggctttgttgccagcaatgatttacaaagcagaaagtgcccagctggattgctagatgcccaggtgggttgtgcaaagctgatggttggaaacattcagtctttgaacttttcaccaagaaaattcgatgtcattatttggaaaaatccagggcatgtgccaaaacaaaacaaaacaaaacaaaaaacacatgtctttgagcattcttcatatataacattctactgaaagtgttgaggaatatatatacatgtgagttagccagggttcctgccctcaagggatttgttcattgatttagcaggtaattgctgagcatctgctgtatagaagactctgttctagaactgggaatatagctgtgagcaagacagagtcattgtcttgactcttgtaatttgagaaagttaacagaaagttaactagccaagtaactccagatagcagactcttgtattttgagaaagttaacagaaagttaactaaccaaatagcagtaagcaggtagcagtaagtgttttagaaggcagtcctgccctagtaccatttccctagccccggccttttggtctcacctagactgcatcggagtttaccagcctccgtgcttaccagttaccccatctctctcccacactgccacctgaggtgctgctccataatgcagctgtgatcctgcttctctgtggctcctcattgcgtggaaaattaaaagcctaaacattggtcgcaaaggccattctgatctggcttcttatcctgttctccagcttctctttcctctccgttttcccccatcaactccagcaacagtggtctctttgcaggttcctggacaggttatgctgtttcatgctttttaaaaaaaaaaattgttgtaaaaaacagctggtccatggtggctcacgcctgtgatctcagcactttgggaggccgaggctggaggatcacttgaggtcaggagttagagaccagcctggccaacatggtgaaacccccatgtctactaaaaatacaaaaattagccaggcatggtggtgggcgcctctagtcccagctactcaggaggctgaggcaggagaatctcttgaactggggaagcagaggttgcagtgattcgagattgcaccactacactccagcctgggcaaaaacagtgagactttgtctcaaaaaaaaataataaaaataaaattgtggtaaaaaaaaacacaatttaacatatatgccctcttaacagattttcagtgttcagtacagtattaaccataagcatcatgccatccagcagatctctagaacttcttcatcctgcataattgaaactttatacccatgtttcataccttcttgccggaacctgattttccctctccctggtacatatttgctcattctacaacatgccctcaaggcatccctctctgtcaagccatccctcctctctctgtctcaatctctgtctctctttcactctcccctttccctactcttagcttactttgaacttgtcgctattatattgcatgagatgtgcttgctgaaactaatatattgtctgcctgactcccgcactgagtcatgggctccttttacacgaggcctattttttgttcatctggttatcttcttcttcttcttttttttttttttttgagacatagtcttggtctgtaacccaggctggagtacaatggcgcgatctcggctcactgcaacctctgcctcccgggttcaagtgattctctggcctcagcctcccaagtagctgggattacaggtgtgcaccaccacgccaacctaatttttttgtatttttagtagagatgaggtttcgccatgttggccaggctggtctcgaactcctgacttcaggtgatccacccaactcacatctggttatcatcaatatgttgtcaaggcctaacatttatgtcatttggtgttattgggtgtttttagatggatagagttcataattcttgtgacaatgtaaatatcataggtataaacagtggagtctgatcaaagggcgttaggagcaccaaagagggagtggttaattctgactggggttgagatttgaggctttatgcaagggtggaaggtgggggcatttgaccatgcacttgagggatgactgagatttcaaaaggcacaatgtggagaaggatattgtaaaactttttttttttttttaatggagagtcacgttgatgccatgttggcagtgagagtccagttctccacacagaggcattcactcagggcatttgtgactgaatgaatcagcccataaaagccttcctcagccagccgcctgccctcccaggtagtcaagtaagtggaactggctgtcttacttaggagcttaaatggctactacccatggagagggactggtgtttgtgtgtgtgagcacttaaagacagccacattagcatggataaaatcagccgcgtaatggaattctcttagccattaattttttttcaactttcccatgtgaggcccttttgaatagaagccactggtttttacaaatcccttggatttcacttgaataaaagggatttgttttacaaaaatagatgcagttttttcttttatttaaagcaacgtaagtcaccataattcatttaaaaccaatgaaaggataatctgaatttaatgatatgttagaaagtgagttatgtacaaaataaggatttttattgttgattacgtagtacttaggcatatagtcatctaacctgtttttaaaaatacttctagttacaataggccgtatatgctttccaacttcctttgttgctagtattctaaatgtgtgttcatctttaactcttgagggaaaacaccaactctgacgatgaggtctatggtatttttatcacgatgcccactatgataaatttgcctgcctactcctacacctcttgccattagctatctcttttgcatgcttagtctcattgagccctcacaacagtgctagaagctaggtctctaatcccattatatagatgaggaagcaggctcaggaaggtcacataatttgctcaaaatcaacagagctagtgaaaggcaaggctgagctttacattctaaagcctatggtgggctcctgtatatgattagagccccagatgaaacatcccagatttttcaaactgacctcaggtgatctcatttatgctgctttttaccttcctggtcatcattgtgaaacaatagtcttgcttttaacaccactttcttctgctgcaagtggaaacaaaatcttctacctattgctagtttcattctaagttgaataattatttgggaattgaaaaaattaggaaatgtcatctttttggtctagctaaaaaaataggataagatagtgacatagctacctaccttgatattttgaatttctcgaggtgacctaactgaactcaatttatttaacttaggtttaagaaaagctttcacatgtgtgactaaagtaatttagaatttcataatacacagattaaatgattaaagtgttcatgctttattttgtgtttgaagaaaaacacccagtaggtgtgctttttgttttagataaatgcatttgtttgcaaaatattatcctatttcaaaagtattttttaaatattcagtattgatatgctgagattaaggtgatttatgtcccagtgacgttaaaaagtgttgacttgattttgttttagtgaataaaataactagaccactgttaagtttcctgaagaaggcgtaaaattaatctgaaaataaaagaatcagaataagttattgcttggaaactaagtactatttagacatcttcatttctgaattgtgaggagtttttacaaataccaagtttgtgaaactgtggtcaaaaatagaccaggaaatgccagggggtaggggtgaaggaagggtttgactgctaaggggccgcacaagggagctgtttggtgtgatgggatggctccatgtcctgattggggtgacggttacacaaatttatacgcaccttcaaactcagaactggataccaaaagcaaagcaaacactgtgaacatgtatcatatggtggttgcatgggggtatatatatatttgtccagattaactaagcatttaaaattgatgaatttactaatctgggcaacatagtgagaacctgactctacaaaaaattaagaagaaaaaaaaaataccaggcgtggtggctcatgcctctaatcccagcactttgggaagacaaggtgcgtggatcacttgagcccaggtgttccagaccagcctgggcaacatggcgaaaccctgtctctacaaaaaatacaaaatttagctaggcatggtggcatgtacctatagtctcaactactgaggaggcctagatgtgtggatcacttgagcacagaggttaaggctgcagtaagctgtgatcacatcactgtgctccagcctaggtgacagagtgagaccctatctcaaaaaaaaaaaaaaattatctaggtattcgtggcatgtacctgtagtcctagctacttgggatgccgaggcaagagaatcccttgagcccaggagttcaaggctgcagtgagatatgatcatgccactgcacttcagcatgggcaacagtgagatcccgtctctaaaaaataaataaaataaaatgaataaaattaattgtgtgtaagttataccacaataaggttgatttttttttttaagtcaacccagactatgccctgtgtcctggaggctgcagaagggacagtttcagaagcaccttggttccctacaaggcagtgctaaaaataaatatcagggatggattaagcctctgtcaagacaaaaggtctgggcaggcaaaggatgaagccgagatgcctctgctttgacaggactctgctcagcatttgtcactgcgtgttgccgcatgcctagtgtcttacctctgcagtgggaatagtaagttcctgtcctgcctcccaggctgtggtaaagatcaagttggtgagttctttaaaaaggacgaagcactttttaaattagaaaacgtatttgttagactgaaggtgtctgttttacctgcctctagtggaatttattcccaggcaatgtttgagaggtgctttgggaggatgggtgatgagcgtgagcccagtttgttccagcctgtcactcctggccattgccaagtgcagggcagtccctgggtctcaataggtcattcggtgagcaccctttgggccctaactctatacctggccctgggtgatatgctttgtggcacacattgataattgggacacaatccccacttttagagggtgcaaatcactgtgatacaagcacagtgtgaggaatgccatgagggaggctcgggcacagtgctggggaacaggggtctgagcagttcatgtcacaaggaggtttcttgagagccatggcattcaggggcctggtaaagaagctgccttctccttaggatgagcctttctttctccccagcatcaccatatcactattgaacagctatttggtgctaggcactgtacaaaagtgaaccccaaattgagtctgtggttgtcttcattcttctgttcattaaacatctaatgggtcctttttgtgtgtcgggcgctgtgccgagagtggagcacggtgtgaaagagccgctgctgtgaggttgctccgtgtctggtggacaagatcaacagcaaatggcctgttagcttactgagactgatcaaggtagccctggggctgagggaacgcagaggagcacctactccatccttggtctggaagagatcctcaaggaggtgatgtttgagctgagcctgagtctttaggagaaattcataggtgaaggaggagaaagcaggagatggaaaggtgttaagagcagagggaaaagcgtgtgtgcagagaggcgcagaggaagcagtggcacatgtttgggcagctgctcagtggctggagagcagggactgtggagagtcatccaattcccatgtaaggaagggaaacaggaagagacttgttaattcagcccagcagtctccccacaacctctggggatggcctcatgggtgtgcagggcctccagagctaaaactgtttgagagaaggcttctgtgctgtccataccaggcccctccccagaattcagccttgctccaggcgggctccactggctgcctacagacaggccaacccttggcttccccatggccctcgccaccaagatcacacagccctgctaattagttattgatctggtattttgttgtggctgcgcttcccactcctgtgtttagtcgattcccaagttaatgaagctggattctgtaccgccccccttcccccccatcacctctctgtgttcccactgctgctactccaacggaatggctccagacaaagaccactgaaaacgagccgcactcctgctaacaggaagacagcggagaagcaggtgggaggaatattccccctggaatcagctgcagaggacgcctgttgcctttgttgggtcaggtctcctgcggcccagcattttccatggtggcctgaaagccaactgtggcatgagggcgatgtggatcaaagagcttcttccaccgtcacaaccctgtgtctctgggtgggcctgtagggtagcagatggtagtctgggaaaaaccacttcttcctttctgggtaatttttattcagtcatttaactcctctcagcttccatttccttaaaataggcattctgttgtatctttccagggtattgggaggatccagttggatgctctgtgaaacttctttgaaaacagtaaaatagtataagaaggaatcatgggtttgctattactcttagggagggactgggatccaggacaatctggaatggggtttcagatgtggaaaaaattaccattctgctcccctgcccatgtttgtattaaatgaaactgttcatgagagcatcagaataaggggttgatatccagaatatataaagaactcctacaactcaacaatgcaaaaacaacccaatttacaaatgggcaaggaagttgaatggacatttcaccaaagaagatatacaaatggccaatgtgcacatgaaaacatactcaatatccactgatcattagggaaatgcaaatccaaactgcagtaagatactacctcctacctattagaatggcatgatttaaacacacagagaaaataacaggcgttggccaggatgtggagaaatgagaacctttgtgcattgctggtgggaatataaaatggtacggcccctgtgaaaaactgtggcagttcatcagaatttaaacagggagttcccgtatgatccaacagctccactcctgggtttctgtgcaaaagaactgaaagcagagaccctaagagatatgtgtacacccatgttcatagcagcattattcacgatagccagaaggtaaaaacaacacaaataggcattgacagatgactagacaaacaaaatgtggtatctgcatacaacagaatattattcagccttcaaaagaaaggaaattctgacacatgctgcatcattaatgaaccttgaaggatattatgctaagtgaaataagccagttgcaaaaggacaaatgctgtatgattccacttagatgaggtgcctagagtagtcagattcatagagacagaaagtagaatgtgggttgccagggcctggtgggaggagggaagggggatagggtagtcgaattcacagagttggaaagtagaatgtgggttgccagggcctggagggaagagggaagggggagttgctgtttaatggctgcagagttttggccggggatgatggggtcattctgaagatggatggtggtgatggttgtacaacagtgtcagtgtacttaatgctactcaactgtacacttaaaatggctaaaataatatgtatattttgccacagtttaaaaaataaaaatatttttaaatggttgaaatggtagatcttatgtacagatgctcctcagcttcacatggggttatgtcttaataaactgtaaatcagatataccgtaagtaaaaaatgcattgattacacctaacgtccctaacattgtagctcagcctcacccacctcaaacgtgctcagaacactaacactagcctacagttgtgcaaaatcatttaacacaaagcctattttataaggaagtgttgaatatctcatgtaatttcttgaatactgtactgaaagaaacaattcaaagtgcagcttcttctgaatgtgtatcactttgcatcatcataaagtcgaagtgtcataaattgaatgtaagtcagggtccatctgtatattttaccacaattaaaaaaaaaatcaaagacagcttttaagggggatagaagcctcaaactggcagcctgtggcccatttagaagattagagcagcaattcagtcgtgttggcttggggcctgggactttatgggatccaggggcttataagcacccccaagcctttcttaggaccttagtaccgactggtgtagctactacctgttcctctgggttactgcccgggtgtccagtagaaccccccagggggtggagccagggtaatggcccccagcctctgcccagatagtaattttccattctagtcctgccctagcatctcagctgggtttggaccttctttcttggtttggggggagcatagcaggtgtcctgggcctatgccagcagcagctgatctacccgccccagaagagccgaacaccatgaggaaatttccacagctttctcgccccctgccctccgtcttctcaggagtgacttatcctctgttctctgtaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtggagctgtcagtcaccggagtaatgagctcctggttcctcgggagtccttcgtgctgtgtggcagggttcctctctagacaagtacacaggccctgccaccctgacatcaaactgttgtactatgatcacagtccctgtgccatccttttccaagactggggctcacaccatgtttttgaatgagaatccctgctggttgagacttttgcttccacttgtttccttggagatgtttttccaagagcataatgtacattaaagtcttcgagttgagac

SEQ ID NO: 38287 - DNA, 47548 bp, Homo sapiens
cttgtacctggttcaggaggttcaggcagaggttgcacccactacgcctgcgcaacctcagccccgcccctccgctgctttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactggtgagtagaccccagaggagctcgtgtacgggcgggggccgcgcaggcggaatgggctggatttcccctcactctgagaatgggtctgtctgccccgccttccccctgactcttggaatgggctcaccccttggttccagtccctcctcccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgaggtagggtccccggactggggcgggtggggtctcggcctccccgagtaggctttgtggtccatcactactgtgctgtagacgtggctgggtcaccttctttctttgtagccctgggaaagggatttcacctttctgagcctcagctgcctcatccataaaatggaatgacagcagaggctgattagtacaaagaaaagggcctggatgttaatacaataaacacgtctgtgttccaggcaactctgatacatttcctttctgatactctgggaaagtgacttgatttctctgagctaggttctcaggtgccacatcggagagaggggtggataaaagagcattcgtgcgggtacagtggaaactgcctggactttggggtcagacaggcgtccgtttaagatccacttactagctgtgtgacctggggcaaatgtcacctctgtgaacttgttttcctgtcttcaaaaccatgagactagttgcagagaggtcgtggactgcaatataaagagcatgtgctttgggttcagaaaagcaagggttcagtctaggcctaaacatataaaactagctgtgggaccttgggcaagttgcttcccctttctgagccttttctgaaaagtgggccggatgctcctaccatgttgccctcaacaaaatgttacaaggcccagaggggtttaggaataagaaggtactttgtaaagtgtaaaggaggcctataagttgttacatctaagaggcagctgtggcgtggtgatgagcacagttcttttttttttttttttttttttttgagacggagtctccctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcctgcctcggcctcccaaagtgctgggattacaggcgtgagccaccgcgcccggccgagcacagttcttaaagccaggagacctgggatggagtccttgctcctgctgcttgttctctgtgttagcccttgggcaagttattatccaaaaagtgataagaattaaaagaagaagaatggctttgtgaggtttttttagggataatatgagattatgtatgtcaaagacctttctttgtcagctgaaagtgtggtgcagatgtttggcatttgatagtattgtgttggatagtggaggttgcacacccaccatatgcctagttgtagtctcgtaggagactctatgctcctgggaagagctgtgggaatgccaggctttgttgaagagccatatgatgcacacaacctgagttctagcctagggatcagcaaacctttcctttaagggtgaagtagtaaggattttaggtcacaattattcagctctgccattgtagcacagaaggctgctatagacaaatatataagtgaataggtgtggctgtgtttcaataaaaccttatgtacaggagcagatgccaggcctatggagccatagtcagctgaacgctgttctagactttactcttgttgtttattactttgggcaacttaacttgtctgagtttttacgtcctcctttgtaaaatgagaataatccctttccacctgctgtgagaaacaaatgaaatcccataatggatgtctatgaaagcacctattggaaataggctgccgtacagatgtagggaggtattatcttctgtgctctgggaagaatgcttgttccttaggaggcttgctgagatcctggggctctgccaagtcacttctccagtatatttccatttgtgattccccctcagatcctgggcttttccacccctccaggccggctctccatgatgtccttcatcctcaacgccctcacctggtgagtatcaccagttttgctatccagcttttgggctcttagtgctgggactaacttcctaagtttgaacatgagacaggctggcacttgtttctggggagtggtggagtaaagtgggtgacagaggccagttctgggaccagctgtataatgggcctccttccattgctgttttgacttacctggaaagctcttatgtcactatgtttgtgctgcctgcaagacaacttccatctcagataacttccctgatgtggagtgagctgagaaaggattcgaccgagaggcaggagaactgggttctgttcttggtttgtgtgccattggccaagttacttgccatgggcctcaggctcctcttttgtccatgagggtttggactcagtgatgtctaaggtcacacgtaatcattgcctgtctcttaagaggcagtttagcatagtggtcaaggtgtcaggctctggaggcagactcatttggcattgaacctcagctttactactagtctagtgactttggacaagttaatctaccacagttgcctcatcagtaaaatggggctagtaatattacctacctcatagttgtaaggattaaataagttaattcacaagaaggacttagaacagtgccttgcatgttattattattcttgtccttacaccggaggttgaaaactggtgggctgactttgacctaaatttgtcttccagataggttctatttggcttacatagatgtcagcccacacatggtgtttaaaacatttttttcacttagttgaaaatcaggctattttatataaaaatccagatttctggcttctcttgaataatggaatgactgactgattccaggccaaccttctagcatgataagatttgcctagatgcaagtagctactgcccccctttagctagaacatgtatgcttcagggtgtcatgatccccaccaattcctaggatcccctagtgacaattgccatcgatcatcaagctcatactcagtcagcttcactcttgacattacccgccaggttcttctaggcgtctggtatcataacccttgcttcacacttatctcgtcacttctgaccactatgctgccgtcctaattgtccctaccctcccaaataacctaaggccaggacaacccagtgacaactcactgctgtcctctccccacagtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaagatttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtcacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtgggctgagtgctttatgtctcttttcaaaatcttcacaagaaccctctgaagtaagaagtaacgtcatctgtatcttacagatgagggagctgtaaggaacttacccaaggtgactttttaggagctggcagagccaggatttgggctctaatagtgatattaataagctcattttgaagaggtcagtagttagggatgtataagttctgactggctaaacagtctggttaaatagtttatcaccttataatcatatcttcttgtcctgtcaatttttttaaataccgaggatgaatagtactttataaacattactagctttctaagaaaagctgatatgcagtacattaaatatagccagagatttccttttttttttttttttttttttttgaggcagggtcttactctgtcacccaggctggagtgcactggtgtgatcttggctcatcatagcctcaacctcccaggctcaatgatcctcctgccgcagccccccaagtagctgggactataggcacatgccaccacgcccagctaatttttgtatttttatttttatttttatttttttagagacagggctttgccactttgcccaggctggtctcgaactcctgggctcaagagatccacctgcctcggcctcccaaagtgctgggattttacaggtgtgagccaccaagcccaactggccttttttttttttgaaacagagtttcactccgacttcattacccaggctggaatgcagtggcccaatctcagcttactgcaacctctgcttcctgggttcaagcaatgctcatacttcagcctcccaagtagctggaattacaggttggcaccatcatgcttggctaatttttgtatttttcatagagacggggtttcatcatgttggccaggctggtctcgaactcttggcctctcaagtgatccacccgcctcagcctcccaaagtgctgggattacaggcatgagccactgtgcccagcattggccagagattttcagatgatcttaggaatgtgggaaatctatttccaaaggataaaggaaggtacctagataagagagtactagcccactactgagttggcatatctcttaactctccaggtgtctgaagttgacctccctttttcccacccaccacctgaactctggccattcagagagaaaagtggagactcctacatagctgatggtcagaatagtttataacccttaaaggaggacaggaaaggaaaaagggatgtctggctcagagggtacttctaacccctcgctctaggcagccctgtccatatcagtgccaaatgagagccacgatggcagccagcagacatcagggggtacaatgggaagctccaggactcccagcatcctggagggtacacagctcaaacagtctcccctggacaggaatccccttggactccttcctcagcaactcccaggtcagagtagcttccttctgccagccccagaaggcagtcagtgcacaggtatgcaacacctccttgtaccggcagcccagggaccacggagtctcagaggtagggccctggggacctagggcagaggagtagggatggaatcaaggtacaagagaactcctctgtggagagattaaaaaccactgtcttaaggttttctgttgtaaagtaataaagggtggtagaaatagcattgaggcaggagggagtagagggagctgagggttttaatccctgccctgccgctacctgggcaagtcacagtcataggtccaattctggaaggctttagagagctgcagtggagtgcaaagtcctggagtcccattactagctgtgagatcttgggtaagctatgttacctcccttacctagatttcctcatatgtaaaatgagggtaataatggtacttatttccctgggttttgttttgtcttgttttgttttgttttctggtaggtcaacacttacttctttaaaatggaaaaagtgttccctccctggttttattgtgaagatgcaataagatgtcacgtgtaaagcgcctagcccagcccctggcacgtaggaagtgatccataattctagacaattattaggctaccgtcccccctatccattttacagaacagggacatttttcttctgagcctgtgttttcaaatgttgggggataggcttgccagtcctctaggtaccactaccaagtattgagctcctatctggcatgtactgcaaagtgatttatgtgtattcttactcagtccaataaggtaagcactactatttcccccattttgcagacaaagaaacagaggattgggagtaaacaactttttccccattacaaagttggtaagaagctaggcctgtctgcctcatctgcttttcacgttccagttatgtttatgtgtgatccagacaattgtgagacggacagtcttagggatctaaatgccatattagcaaaaggttgtgaatgtaaacgtacgtttggcttgttaacaagcagctagttccataaaggtgagtagttaggtagctgctgataagtgagaaatggagccgggactgactggccacagggctttattatgatggccgtggtgtggcgtgggaaaaggccaaacatttgttcaatgccccacaaactggcttctcctacatcaagcttgatttgcttaaacccccctgaaacagacattagtatcactattttataaacatgaaataggctcagagaggtcatgtgacttctaaaaagtcactcaatataaaatcagattcaaacacttcaattttttcccagttaactgttaagcagccatttctagggtggcctcctccccaaatctgtgttactgggcccagaggaggagctttaggttgaaatggttaaacaaagagagggtggtagtggggagaccctggttgtggaattgtgggaggcaggtggccagaggcctaagtgccggggcaggtgggatgaggtggaaggatgtactgctgggattccctcactcccagacctgccccttgctgccctggccatgctgggtccccgccttcgtatacagccctcccatatattcagtggcgttcccagtgggcaactggggcccaactccggctctctggagcaaagtggaagttgccagtctcactcaggcccaacccaatccagcctccacttggggctccctgggcaggcccccacgaaggctagtgcaagggagctccccagaaagggtcagattttttagctgggagggcgctgtcttgactgcccgctgacagcgcactcaggacagaagttcacgcaaaggttgatggaatggaagagtgagtagagattattttcgaaagttgatgggattgaaaatacccagcaagggaactgcaagggagactgttcaggaaatgggctggagtgcaagctgggtgggaagaccgctgaaagtggttactggggtggaatttgcacgggaattagcggggtggtgggggcggaggtaggcaccgaccgtaggggagctccaggaagattgcgctgggagcaggagctcgggagcacgcagcagccactatgaggtgctaagcagtccccgcgctgtggctccgcccaggctggtccgcgcggcagctgatgcccagtcttggtgcccagtaatggtggggaggagtgtgtgagtgggcggggtgggagggggggagagtccatccaatcgttctccctctgtcccaaactggagatctatctgcatcgctgccctgacccccaatcccggagagctctgtgcccctcgatggctccactgctctcccgagggcgcccactccatgcagcctgcctctggggaatatggaggtcttcgtccggagaaaactcgggctcccttggctttcctctccccaacggcatggttaggaccctgtgactcctaccgacagagggtgaccccggccagatggggtcgaccagggcttggggttgaggtcttcagattgagggtggacctgccatgtcaccctggagcagtagagatgcagtaccagctccccctcctgatccggtgccttctgtgatctgtgaccaaggcaggacacatttggaggcccagctgacatccactttttgacaccagccacagtgcaatcagtttttgacaatcaatttttgacaatcaggtcgcaatgcacgcgcatgacctacagggtgctggggctattccgcctgcctcgtgacttctgagcaggctctcatttcgccttttccctttcttgggaaaatggaatggggagcaaccaggagcccttgctcctgccactttctagctgagtgagcctgggcaagttacttgctgcctccgcgccgcggtttcctcttgcgagctcgcggggcgattgtgaggcactttgcacccaggaagcacacgagcgccctgacttcacagagcgcgccactcaggagactagctcgcggaggtgggggaggggtgctgctcgctggcttctttggttctagactgaccttaggggcctcggggtgggggtgggggaagcctgaagtcgcgacacaggctccctctaccgaaggcctctttccttcatccttcccagccccagacaaacaggcagagtaagcagtattcgtcttaggtgccatatggaagatcttatttgtagactcgtgaatttcgccacccattcctccccttcagctgatggcgcgatctccaccctctgctcgcacctctggctctcgtccaggtcacatcaacctgccagcagaaacctcggtgttaggcgctaagactgtccccagggggcgctggtcgtttggggagcgggcgcagggacaagggtgctgtggtgtctggtaggttggaaatgcctttgctaaaaaggaaaagcctccctttaagctagacccggtgggcactcacccccttcctttcgtgggactttcattctcccacgaaagggctgcggtattttcttctttttttgctaaggaactttctgctcagagtaaatctttttttcctttctttttttttaagacagggtcttgctctcttgcccaggctggagtgcagtggcgaagtcacagctcactgcagcctcgactcctgggcttaagcgatcctccgacctcagcctcctgagtagctgatactacaagcgcaaggcaccacatctggctaatttttaaattttttgtagagacagtgtctcattatgttgcccaggatggtcttgaactcctggcctcaagcagtcttcctgcctcgacctcccaaggtgctgggattacaggcgtgagccaccatgcctagcctgttcagagtaaatcttatttgaggcatgaatcaatcaaacataaatagagagttgaattgatcttagagggaatgggatgcagcaaagccctacttgaccatctcccccctcccacatttggaaatccttaaacccacttatgtaggcctctgactgtgagattcagagccacagcagtttccacctctgctaaggccttcaggcagtgagatggctcacttcagtgcccctccttccacacatctcctagctgtatcctgagacgcctcaacctagtcactacccttctgtatgatgttggtctaaggcttccccctctctggacatgaaggcggagcctcccagcactaccagccacacaccactcaagactccagatcctgaaccctgactctggggcccagctctgggcctggcttggggcttgcatctcacctagcctggcagtgttgttgtcacacccaccttgtatggatgccacataggcatttcaagtgatgcggagcagaagcgggtgcagcggcgcttgacccaacgcagggtggaggatctgcacatcaccctgggcgccgggaggtggattcgtgtgggcagcccctcaaaccagatccactggtcggctacatccagctgcttcatgtgccccatgggagttctattgcggtagggcttaatgaagatgactcgggggccctcggtgagtggttgcctcccctggactccagggttcaagctatcatccctcgatgtccttggaacctcaggctctatatgcttttctttccgtggcattgccgccaatgacgttttctccttgttcctcatccctgactgcacctgggacttccactccttgtactcttttttcttagggtcccctgtggactctaatttcttggacttgagttccttctcggagcacccgatctcctggaactcttcattattttgttttgttttattgcaggcactgttttccctggcagggagaggaaaggcagtcagcacagcaggaccgaggccctggttcccgagacagttgctatgtagccagctcaggggagcctgttaagaaaggctagaggggcctgcaaagaaacttctctactgcccagaggccttgtgctggtgtgaggaggtgtgatgagcactagcagagggatgtgagagattgggaaggtgaaagccatgactagtagttaaggcccctaagaatgaatattgtctacatcatctgccactagattagggttctgtctctctggacttcagctgggagggtgaacagtccagtagtttttctaaattgtgctccaagaaccttagggttctgaggaggtgtctcaatgtcacctcccctgacccactggggcaggatacctctccccagctcataacaacacaattggggcttggaaatagatatttgaacagaggtttcactgctttaataaagttggaaaactgttcaagaccagcctgggcaacatggtgagactctgtctccatacaaaaaaaaaatttttaagttggaaaatgatggggctagatgatcctgatccttctagctctatgtttcctgattgcctgcgactagaggccaaatcagaaagaggagcccagaaaggtggccttgacagaaatattaaatgctgagactttcccaaagggtgtctgtaacagactgggccccctgcaaacccccagtggcaacaccatcctagccaagggcgtggagagagatgaggccttgggctgcagataatggcaatactgtgatgataataatggctcccgctgattgagtcctcgctctatgccagactcgggacccttacaacttgggatccttactatttctgtgaagtagaaggcagtgaaacagagtggcttacagagcacaggtgttggattcagacaaacgggctcagattctgcttctgcctcttaccacctgtgtgatttgggcaagatatttaacctctcagagccttagcttccttatctgtaaaactaggataattctgtctacctaacaggattgttgtgaagaataaactaaatgggaaaattcttaagtgcttaacactgtaggatggtacttagcaggcaccaatcaatgttagctttcttaatactgtcatgtgacttatgaggaaacggtttgaacttgtctcggaggcatggtaaaaaaaaataaaaataaaaataaattaataaagaaaccaagcctcagcaagattaatcttcagatttcaggggtcagtctgcaggtgactctctgggttatattgacttgcaggggaggaggaggaggagtaacctgtctgtctcagtgccccagggtgaagtgagcaccacaactggatgattacaaccattgttatggccacagctctaatatcagacaggaatggcttcacatcctagctctgccacttatcagttgagttaactgaatgagacaagtcacttcacctcttcagcctcagctctccagcagtaaaatagagttaataaatacctctctcacagaggctttgtgaaaattagacttgttctctaaatgccttagcacaatgcctgttcccagaaagacggcatttgggtccattatgggggccaggccccagcttacccagaggagatgcggagaatctttggaacactgagcagtgaatgccaacaccttttggccagcttatgcagttcttggatccggcggtttgagctcttgagtagcttcaagagcgacaagttttttaacacctgccagggtcaagaaaccaggtaaatagaagcttcagctttcctggacagcctccctctcccctgcctgcctctggctccgctcagccaagggccggcctgctggctcccctgggccactcagcctggcaaccaggggcagtactgcatgagtatatgagcttccccaagctggggccaaaacagggcgtctcaccgttctcagacggttccgctcaattactttgctcacaggctgctctgtctcgtcccgcagtttctcatcttgcatctgagggacagaggataagagagacataaacccagaggaatcagccaggtgtggtgcctcatgtctgtaatcccagcactttgggaggccgaggtgggtggctcatttgaggtcaggagtttgagatgcctggccaacatggtgaaaccctgactctaccaaaaaaaaaaatacaaaaattagcgaggtgtggtggcatgcgcctgtagtcccagctactcaagagggtgaggcaggagaatcacttgaacccaggaggtgaaggctgcagtcagctgagatctcgccactgcactccagcctgggcgacagagtgaggcactggaggaatcctcctgaactcctccatgtgcctcttcatttggctgagcatggtttgaccaatcctaggctgggagttttgtcatcttggtctggggacagaactgggagaccattttaactctcctgacctcccttcacccttcaccttttccttttctcccatgctggaaagcccctttccttggcatggtggattctttgttaaggtcccctctagggactcacccccagggtctagtcccaagtctgaccttggaaaccctgctgttcttgggcctcttctttgctgatggactcatgctggggctgtgagacctcagagatgaatggagcaacaccagtgccaggcaccaaccctgttcctctcagttcagccagcactcaggctgggcatcagatggtggtgctggctctgtaccacctgcagctgtgacatcactgaaatgtgacagtagcagggctgggtctccaaggagtgtatgtggcagaggtgaggggtagagggtgagaaagaaatatagacaataggcgacagacagctgtgtgcattgtcacaacctccctgtggggtaagaggattatcccctctttttaaatgaggaagccagggttcaaagaggttgaataatctactcaaggccacactagatctagcccagctagatcatagtgggctggaaacctaaccaaggtctgatagtcaacccatgaaaccagggattcccaaaccatgctcatccattcagtcatgtcgcctgttttgactgggcgcctgctacatgccaggtgctttttcttttctttctctttttttgttttttgttttttgagacagagtctcactctgtcgccaggctggagtgcagtggtgagatcttggctccctgcaacctccgcctcctgggttcaagcgattttcctgcctcagcctcccaagtagctgagactacaggcacccgccaccacgtccggctaatttttgtatttttagtagagatggggtttcaccatgttagcaaggatggtctcgatctcttgactttgtgatccgcccacctccacctcccacagtgctgggattacaggcatgagtcagcgcgcctggccttgccaggtgctttttctaagtgctagaataacagaaaattcttgccctcaagcttacattctagtggaggggaaacagtgtgtgtacttgtaaatgtttaataattggctctctgaagcaaaatgtatatgtgtttgtattataaattttactgatagaaatcaacaaataatagaatcctataatactctttattgtaacttctattagtgagttgcttcttatagtatgcttttcttggattttgcctaacccctccatttatagccaacctatggttgtaatggataaacaagtataataccaacattaatgtttgtattttcatttacactaaacagtaagaagaaggtgaaaaagtgaaacaacagagatattgaaatttaactcatttatcaatgatttcattgacctatttgctgaattagaccatagtttttgaatactggagatatatttctcagattctttttgttatttacaatcgaatagctatgggcaggacacttgcttatgttttctctttttttgttgtttttggggggtcttttttcagatctacatatgattcatatatgatatatttctactctacagatatacagatataaagaatcctaagaacatagataatagtaaaaggtagtaaaaaatagaaagtgacaagtttaagcatttttcaccctatgtttttaatatcacttatttaattggaagttgctatcaattacattttaatgatggccgtgcctaacaaccagcctgcagaattcctagaagtgtaacagtagacttgtgagcccttatgagttagccccagcacgccaatgctacatcagatggaaataagtgcctggagaacagcaaccagggtaaagggaacagggagggcagaggtagagggtttggtatattaaaaaggtggtctaggaaagattcaccaataagatgagatttgagcagacacctgagagagagagggaagaggagaatgaatggtggtgggagaagatgaggcagagagggagtcgtggtgggttaggcagatcacaacaggctgtaaagggcgctggctgccctgaatccctggtgcccagctggctgcatcagaatagtatgaagagcttgtgaaaaacatttttgtgggcaccaccccattcagcaggccagtcagataaccaatcaaatgtgggacccactccacaccattccacttctagtggggagagatgtacatgcacggggggtgggtgcttagctctgaacggaggggtgaggggccaaccctacctaggctgtgggacagcttctcacatataaatatcctttcttattcaagtgaaggttaggtagtgggttaaactgctgctgtggcctaggaaagaaagcaatgtggtaatttggcaaggaagacacagagggtgcaccctctctctctcctgtctacccccatactccttggctgctctgcctgctcagacatacccctccttgcacacaatttcagctctgatcaactggacttcactgaacaatgctgctctgaggccctggtgcctggtgggctgtatcagaatcacctatactcactactcaactcctgagcttccagggctggggaatcactgtgtgctaggcactaagggacagcaacattataggcagagcatgcctctgagttcacaggccaaggggataggtaccccagaaggtagactcctcaagggcagggatttgtgtccgttttattcattgataagccaccagatcctagaacagtgcctggtggacaatgggtgcccaaaaagtattttttgaaaaatgaaataaatagcatgatacgggtaatactgagggttgtaggagcacagaggtggagcctcccaacccagcctgaggatgtcaggggatcttcctagagatggtgaggaggaatgaaggatgagtagatgttggccaagcatagcggtatggggcaggtcgagggaggtgggcagagcattctcaaaagagggaacttaaagaatatgagtgtggaatggaattatgttgtacattggatgttgctagattagaaagcagtagccaagagtggcaggggtgaaaactggagaagtgggtaaagagacctacccaatgacacacagctggtaagccttgtggactaaatccaagactcttgaatgaaaacctccactctttttttaaaaaaaaaatatggcataataagatatggataacacaaaatttaccttctaaccatttttgtttttgtttttgagatatagtttcactctgtcgcccaggctggagtgcagtggcgcaatcttggctcaccacaaccttcacctcctgcattcaagtgattctcgtgcctcagcctcaccagtagctgggactacaggcacacatcaccacgcccagctaatttttgtattattagtagagacagggtttcaccacgttggccaggctggtttcaaactcctgacctcaagtgatctgcccacctcggcctcccaaagtgctgggattatgggcatgagccatcgcactcagccctaaccatttaaaaaagtagttgggtgacattaagtaccttctctttgtacaaccatcatggatatccatctttaaactttttttatcctatggaattggatctctgtattccattaaataataactgcccatttttacctcccccagcccgtggcagccattgttctacttcctgtccctataaatttgactactctaggaacctcatataagtggactaatacaatatttgtcttttttttgtgactgccttatttcacttaacatgtcttccatgttgtagcatgtgtcagaatttccttctcttgtccgggcacggtggctcatgcctgtaatcctagcactttgggagaccgaggcaggtggatcacctgaggtcaggagttcgagaccagcctggccaacacggtgaagccccatctctactaaaagtaccaaaaatagccaggcatggtgacgggcacctataatcccagctacttgggaggctgaggcaggagaatcacttgaacttggagggtggaggttgcagtgagccaagattgtgctacttcaccccagcctgggcaaaagaacagcactctgtctcagaaaaaaaaaaaaagaatttctttttaaggctgaataatattccattgtatgtataggccacattttatttctctgttcattcatcgatggacatttgagtttcttctgcctgttagctattgtgaataatgctgctgtgaacaaagatatacaaacatctcttcaaggccttgctttcagcttttgtgtatatacctagaagtggaattgtggaactgccgaatcatatggtaattccctttttaatgttttgaggaaccaccatattgtttttcgcagtggctataccattttacatccccaccaaccatgtacaaggattccagtttccctatatccttgccaacacttggtattttctgtttctttgatagtagccatcttaatgggtgggagttccactcttttgttttatttcctctcatactttgttctttaatttctttagttaggtttactgggatatattttatatacagtaaaatttaccttttttagtatacagttctttaagttttgacaaatgcatactagtgtagaataccacagtcaatatatggaatggcttcataacccccctaagttccctcaagccacctctttgtagttaactcctcttcccactcccagccctggcaacaaactgatgtgtgttttcagtctttatagctttgccttttccaaaacaccatataggtggaatcatacggtatgcagccctttgaatctgtatttctttcacttaagatttgcacatgttgggtatgtcaataatttgggtttttttcattgttaggtagtatttcattctataaatatgccacagtttgtatgtgtaatcattaaaggacatctgggctagtttctggttttcagtgattatgaataaagttactaaatacatttgtgtacaggtttttgtgggaatacaagtttttatttcacttggatacatacttaggagtgggattactggatcatatggtaattatatgtttaactttaaaagatactgccagaattttccaaagtggctgtaccattttatatttccaccagcaatatattcaaggtctagctgactcacattcttggcagtatttggtactgttagatttttatttgtttgttttgtttttagccactctagtaggtatgtcatcatatcttatagtagtgttagtttgcatttccctaatgacgaataatgttgaacatattttcatgtatttatttgccatctgtcttttttgatgaagtttttgttcaagtcttttgcccatttttaggttgtttcttttaaatataattgtgttgagtgttcttcactaattcaggatctctttatcagatatatgacttgccagtattttccactagcctgtggtttatcttttcgttttcttaactatctatttaagaacagattcttaattttgatgaagtccaatcactttaatcacttttttttttttttttttgagatggagtcttgctctgtcacccaggctggagtgcagtggcgctctcttggctcactgccagctccatctcctgggttcatgccattctcctgcctcagcctcctgagtagctgggattacaggcgcccaccaccacacccagctaattttttgtatttttagtagagacggggtttcaccatgttagccaggatggtctcgatttcctgacctcgtgatccacctgccttggcctcccaaagtgctgggattacaggcatgagccaccacacctggccactatcactttttttaaatgggctatgcttttggtgtcatatctaagaaatatttgcctaacctgaagtcacagaggcttatgcctatattttcttttaaacattttatagttttagttttttaaatttagatatttgatctattttttagttaacttgtatatagtctaaggtgtggattaaggttcttcttttgcttatagatatccaattattccaacaggattttgttttgttttgttcagagacagagtctctctctgttgcccagggtagagtgcagtgttgcactcttagctcactgcatcctccgcctcctgggttcaagtaattctcctgcctcagcctcccaagtagctgggattacagatgtgtgccaacacagctggctaatttttatatttttagtagagacagagcttcaccatgttacccggctggtctcgaactcctgacctcaagtgatctgcctgcctcagcctcccatcgtgtgagccaccatgcccagccccaacatgatttttttgaaaagactacctctctcctttgaattttaaaatcaacttactgatttctacataaaatcctactaggattttgattcacctttggattcattgttctgagtcattccttcctttttctgtgcatttgcagttgagtttttttctcaatctgcttcctgcctgtagaattttgggatgcaaaggcctctttttactttttaagattttttaaaaatttgaaatgattatagagtcaaagatgttgcaaaaatagaaaggtcctgtgtacctttctcccagtttcctccagaggtaacactggacaaagctagtacaatatcaaaagcataaaatgggcagtagtacaatatacaaaccgtgttcagattgtaccagttttacatgcactcatttgtgtgtttcatcaccataaggatctctcttgtgccatctatacctccctcctccattcagtacctaatccctggaaaccactaatttgttttttgtttttttgtttttgtttttgtttttgagatggagtctctctctgttgcccaggctggagtgcagtggcacaatctcggttcactgcaacctccgcctcccaggttcaagtgattctcctgcctcagccccctgagtagtggggactacaggcgtgtgccaccatgcctggctaatcttttgtatttttagtggaggtggggtttcaccatgttagccaggatggtcttgatctcccaacctcaggtgatccacccgcctcagcctcccaaagtgctgggattacaggtgtgagccaccgtgcccagcctgaaaccactaatttattatctactctataattgttgtcatttcaagaatagtatatgaataaaagcaagtgaaggtattaaaaatgttgtatgagtggaatcatacagtgtgtgaccttttgaagttggcttttttcactcagcataatgctcttgagatccaagttattgcatgtatcaatagtactttaaaaatcacagaaagtttcaaaaaatatacatagaggttttgtgtaccctttgctcattttcctccaatgggtgggaaaatcttacatacctttggtataatatcagaaccatgtataaattcaggtaaccaccatcacaatcaagtatagaactgttctgttatcccaaggcttcctcatgctattcatagctacagtcacccctccttcctctcaccccaatccctaaaagtcccacttcatctctataattttgtcattttgaaaatattatatacatggaatgatatagtatgtaacctttcaagattggcttttgtactggcttttccatataatgccctttatatccacttaagttgtatcagtagtttttccctttttttgctgagtgctattacatataacacagtttggccattcacccattgaagaatgtttgtttccaatttagggctattatgcaggtttttgtctccacacataattttcatttctctggaataaccttcaaggagtatgaatgctgccaaacaattttccagaacatcagcaatgttcatacattgatagaccttctctgcattttgacttgcttttagaatggtcactattttattttagctgttttaataggtgtgtaatgatatcttaccatagttttaatttacatttccctaatggctattgaagtttaatacattttaggccgggtgcagtggttcatgcctataatcccagcactttgggaggctgaggcgggtggatcacttgaagtcaggagttcgagaccagcctggccaacatggtgaaaccccctctctactaaaaatacaaaaattagccgggtgtggtggcatgcacctgtaatcccagctacttgggaggctgagggaggagaattgcttgaacccaggaggtggaggttgcagggagccaagatcatgcctctgcactctagcctgggcaacagagcaagactctgtctcaaaaacaaacaaacaaatgaacaaacattttaatatgcttatctgccatctctgtatcctctttggtgaaatatctgttcacttcctttgcccattttctaattagactgtttggatgtttgttctagaaaaagagtcttgctctgtcacccaggttagagtgcagtggcatgatcatagctcactgcagccttgaaatcctggacccaagtgatcctaccaagtagctaggactaccggcgcttgccaccatgcccagctaattttttttctttcaagacagggtcttgctgtgttgcccaggctgcttttgaattctcctggcctcaagccatcttcccacctcggcttccaaagcactgggcacaggtgtgagccactgtgcccaacctgtttgtctgtatttttacttttgagttttgaaagttctttatatattctagatatgagtcctgtgtaagatgtgtgatttgcaagtattttctttctaaatttgtatgtcttttatttccttttcttcccttattgtactagctaagacttccagcactacattgaatgaaagtggtgggaacagacattcttgccttatttttgatcttgagtggatatatgacacatatagtatatgtcactaacaatggaataccaaaatatatgaggcaaaaactggtagaactccaaggagaaatagacaaatcccattatagttgaagacttcaacgaccctctttcaataattgataaatcaagtaggcagaaaatcagtaagtacatattttatctgaataccaccatcaatcaacttgatctactggcatttatagagcactccatccaacaataatagaatatacattctaatacaataataatagaatacacattcatatctagctcacatggagtattcaagagatagtacattctgggccacgaaacacactggaacaaatgtaaaatgatagactcataaaaagtatgttctcaaaccacaatggaattaaactagaaacccataacagagagagctggaaagtccccaaggtatttctagaataaacaacacactagactagtaggtagcacatggatcaaaaaaaagtctcaagagaaacttaaaaatatttttaactaaattaaaatgaaaaatatagtttaccaaatttgtgggatgcagcaaaagccatgcttagaggaaaatttatagcattaaatgcatatattagagaagaagaaagatctaaagtcaatctaagcttcagaaagaagaaactagagaaataagagcaatttaagcttaaagtaagtagaaggaaataataaaaatcaaagcagaaatcaatgaaattgaaaaccagaagatgatagagaaaatcagtgaaaccaaaagctgtctctttgaattatcaataaaattaacagatctctagccaggttaaccaattttttttagaaaaagaaagatacaaattaccaatattagaaatttgtttgtttgtttgtttgtttttgagatggagtctcattctgttgcccaggctggagtgcagtggcgtgatcttggatcactgcaacctccgcctcctgagttcaagtgattctcctgcctcagcctcccgagtagctaggattacaggcacatgctaccacacccgtctaattttgtacttttagtagaggcggggtttcaccattttggccacgctggtctcgaacacctgacctcaggtgatccacccaccttggcctcctaaagtattgagattacaggtgtgagccactgcgtccagcccacatgtattatttagaaatgtggtgggatttttggattaatagaagtgtatttaagcaggaatacataaaatcgtcattgctagacttaatatgagatgttaaatgtttgatccaatttttcttcctggataagcttttctttcctatccctaccggatccgattccacatagagctactggatgagtatttgataatgggtctgaaattgggatagacatgtgctgatcttacacaagtccaacaaattaagccaagatgtttgatgagccctcgatgaatcatcattggttagggtcattgtgctgattaagtacccctgtttaaacccagatttatggccaaatgctcaggttgcagtttgtggaggtatgtcatattcagctggattgagggtcatgggcagaggggccaggtgtgatggagtatagtttgggagagtcatcttggtgacccagtgcacaactgcgcctcttgactcatgtattattcagaaatgaggtgtttaatttccatatgtttggagatttacctattatctttttgttattgatttctagtttgatttcattgtgatctcagaacacatgctgtgcgattttgattttcaaaaattccttgaggccgggagcagtggttcatgcctgtaatcccaagtctcttggatgccacggtaggaggatcacttgaggataggagttgaaggctgcagtaagccatgatcggcaccactgcactccggcctgggcaatagagcaagatgctgtctctttaaaaaaattttttttagttgacttttattctgtgacttaagatatagtcttggtgagtgttccataagcatttcaaaagaatgtgaatcttgttattgttatgtgaagtattgtctaaatattaattagattcttttgattgatggctttttaaagttcttatacatccttgctgctttcctgtctagtgtttctttttttttttttttgagacagagtcttgctctgtcgtccagggtggagtgcagtggcacaatctcggctcactgcagcctccgcctcccgggttcaagcaattctcctgccttagcctcccgagtagctgggattacaggcgcccgccaccacacccggctaatttttatatttagtagagacagggtttcaccatgttggccaggctggtcttgaactcctgaccttaggtgatccacccgccttggcctcccaaaatgttgggattacaggtgtgagccaccatgcccacccttctgtctagtatttctatcaagtgttgagagagatgtgttgaagtctccaactttaatagtagatgtctattttttttttcagttctaccaatttttgtttcatagatttttaagatctgttgtttggtatgtacacatgtatgattgctatgtcttctttgtgatttgacccatttaatatctttttttggccctggtgattttctttgctcagcagtctatttcatctgatattgaaattgctaactctgctttcttttaattaatctttgtatggtgtatcttttttcatccttttatgttcagtctacctatgtcatatttgaagtgagtttcttgtagagagcttattttgggtcatttttttcactccgttttgccagtctcagagttataaagtatatttatagactaccggcagttaatgcaattatttgttagggtttaagcctgccatttgattgttttcttttcattccctctgcttttcattcttctcttttatttctctactcttcctatgggttaaacagtttttagaattccattttttttatctatggtgaagtgttttttttaagtgtatctctttgtgtaggttttttagtggctgctttctatattacatcatacataacataatctatgaccatctactggtatcgacacttttgccactttgagtgagggatagaagcctgacctctatttaggtccctttacccttctcctttcataatgtaattgtcttaaatatcttcattacataaattgaatccacatcagaccatgttatataatttctgttttagccatcaaacataatttagaaaatgcaagtgaagaaggatagcccatcatatttacccatatttttattatttccattgttctttcttcactcctgatgtttcgggttttcttctttcatcatttcctttatgtttggagaacttcctttagccattctttcacggtacagcaggtcctcaaataatgttattttgtttaacgtcatttctttataatgttgatgagaaaaaaaaacaacaactgattcccagccatggccactgtctgtgtagagtttgcacattctcgtcatgtctgtgtgggttttctctgggcactccaatttcctcccacatcccagagatgtgcacattaggttaattggtgtatctaaattatctaaattatccaagtatgagtgaggggtgtgtgtgtgtgtgcgtgcacgcattctgtgatggaatggcatcctttccagggtgccttgcaccctgagctgccagaataagattcagccacccaggaccctgaaatggaataagcaggttggaaatgaagaataagtgaatacaaattattgtaaaataaaaatttgtaaagtatataataatcatacaaatgcataacagtaaataatttggtataagagcactcagccagcctgccatatttattattgtttttgaactgcatggtggtaggagatactccttacaatttttgctctgcaaagatttattccttggtttaactcaccaccatgatgactgctgtcactcactgcttatactaatccagcatgacctcactttaattacatcaccaataggtgagtaaataatgaacttccctgttttattaatctttcttaaatgtatgtatagctcacatttattttaatgtttaatactagatgtgtctgggcatttatttagaagcgtggtattgtttttgtgaccagaagtatgctgtatggacttaccttgttaatatcaattagtctacgataaacttgctttcattatacatcattttggttaaagttgcagtttccaagaaactattgatgacattaaggacttactatagttcttcagttaacaaattatgttagtttttccttcatttgagaatgtcttgactttcatacctgaaggattttttcactttgcttagcattctgggttgacggttttttctttcagtacttaaacatattgtgccacttctttctggctttcacagtttctgatgagaaatctgctgcaatttaaattgttgctgtattattggtaaggttaatttctctgcaactgctttcaagactttagttttcagaaatttgtttatggtgtgtcttgtatggatttctttggtttatcatgcttggggtttagtcagcttcttgaatccgtgtgtgtatgtctttcatcaaatttgggacactttcagctttatttctttgaacacatttttagctccaccttttttttttctcttcacctaggactcccatgacacaaatgttaaatcttttgttataatcttccatgttcctgaagctttgttctctctctctctctctcatctctagatcacctgatccagcaggtgatctgcccacgttggcctcccaaagtgctgggattataggcatgagccatcctgcctggctgaaatcctctttttatttgtactctttttatccctgcaaatctaaggtgatgtttttggatatataatcctttttaaaacttgtgggtcactttgaatcttattcaatattactctgttagacaaaagacatgcccacagatttctttgcaataagcccttctctactctaggcttcggctgagatggctaagagacaacaatcagccgtaagatttccagaatcactattgttttgatttggaggatctgtgagacatatccataatttgtttagactctttaaatatgactgaatagtattctgaggcactgccttaagtctttctgagatgttaacaaaatattttacattaatattcttttttttttttttttttttttttttttttgagacagggtcttgctctgtcgcccaggctggagtgcagtggtgcgatctcggctcactgcaacctccgcctcccagtttcaagtgattatcctgcctccgcagtagctggaattataggcatgtgccaccacgcccagctaattttttgtatttttagtagagatgggcttttaccatgttggccaggctgtacattaatattctcagtttcatatttggaccaggctttcctggcagtgccctgtatttgagttttgctaggaagccatttttaaattttactatcatctgctatttggagaggataagcattttctaaatcatgaagtcttagctctttcatgtttaacattctttccttttaaaaagttcagcgtttttcaactcgagccctattgatatttcagctaggataattatttgatgtgtgtgtgtttggtggggggattggggtggtttgaggggggctgccttatacattgtaggatgtttaacagcatccttggcctctgccaactagatggcagtagcaacctccccagctttgacatctaaaaatgcctccagacattgccaaatatcccttgggaggcagtgtcactctcactggagagctcttgctttagtttatccctttgctcctccctttcactataggcagcaagaagaaagcaggtggcgcctttaacattttgcttggaaattgctttacttagatcatcaaattcattaggcacattttctgttttccactttattgaaggcaacagggttgctaatttttgtgtcacagtatagtttccaataatatttacttcacttgtctgggtatggtggctcatgcctgtaatcccagcactttgggaggccgaggcaggtggatcacctgaggtcaggagttctggaccagtctaaacaacatggtgaaaccccacctctactaaaaaaaagccgggtgtgatggcatgcacctgtaatcccagctacttgggaggctgaggcaggagaatcacctgaacctgggaggcagaagttgcagtgagctgagatcaacaagagcaacactctgtcaaaaacaaaacaaaaaaacaacaaaaaaaaccccaaaaaacaaaaaaacagaaaaacagtatttacttcactttcctgcataccctcactgcaccttatctaagggccgaggcttctttaacagcttcttcaaggtgctttaggtttttactatactcttctcaaagtccaattctaatgccactcctgcatattagagtactgttacagcagtactttacccagtaccaaaatctttcttttcccctttaaaaatttttttctttatatgttccaatgaacagaattttaatatgttacctattgctgcataataaactatcccagaatttagcatcttaaaacaagaagtatttactatctcaaagtgcttgagtatcaggaatccaggagtggtttaactgagtggttctgcctaagtttcccatgaggtttcagtcaaactgctggccagggctgtaattatcccaagattttactagggcaattttatcaatttccatactcaatcatgtggttgctggcaggcctcagccttcatgggctcttggccggaagcttcctttccttgccatgcgggcctctctatagtggctgttgacaaaatggcagcttgcttctcccagagtgagtgaccccaaaaatagagtacacactaaagacagaagctgtagtctttttttttttaatttgaattttagaagtgacataccatcatttctggcatatcctgcgggtcacataggtaaactaatggtggcaggaggcagacaggttcctaggtgggaaggggtgggtccttggtgaaaccccaccttcaagccagggatgacctgaagcctgacagccaggcctccagttctgtgtggagtccactacctaaagtgagaacttccttgatgccttttggccaatcagatggtgctttttcctgacccggccagattcatggactcgttgggactacctgcctgcagataggagctacccactttgggtctcctctcctctgagagctgtttggtcagccgataaagctgttctctgccttgctcaccttccagttgtctgtgtaacctcattcttcacggatgctggtcaagaactcaggacctgccaaatgcgggagtaaaaggagctgtaacactttcctggccggctcgctgaggtgcaggtgggagctaaaggggctgtaacacgttcctggctagctcgctgaggtgcaggtggtgacacgttcctgaactgctggagtgaagagtggagacccttctggaggcccagacctcgggattctccgagccagagcggtaacacactagttctcctgccctctgccagcgccaggctgccaccccatgcaacaggaagcagtggcggggccaggccagcccaggagccacaggccggagcagggtggcaggactgaaagagcagtaacacaaatgggctgaaactccaccccctgaaatacagcacccccacctcgctgagcggctgccggtgatgagaaagagagaagagctgcagcccttctgggggcccagatctcggggctccctgaggcagggctgtgacatgctgtaacaccctctttggggctctgcagttcctggtgtctcagagctttcaggtgccactgcgttcccctggtccagacgctggtgcctatagcagaggtcgcttggggtaggtctggtccagccagagccttgcatggagctggtgcctgtgccagtgcctggagctgctcacgtggctgcggcagcttgtgtgcctggctctgtgtggtgactggacctcacgcttgctcacacacccccccaccactccatgcctggcttacccttggtaggcatgggatccgggctgcactagccaagcacagcctgccaggtgagtgggcagaacgagtgggcacaagcaaaactccagcagaggcaccaccagccacagaggttttgcactgaccaagtgacacccaaaggatcccgtgacataaccttggtacagtgtaggagaggactgcccggatgtacatgataggtggtaaggaacattgggaggtgttttgtggctgactgtggccacaaaaatttccattttattccatccaatatgtttttctttttttctttttccttttttttgttttagagtctcgctccgttgcccaggctggagtacaatggcgtgatctcggctcactgcaaactccgcctcccaagttcaagtgattctcctgcatcagcctcccaagtagctgggattacagatgcatgctaccatgtctggctgattttggtatttttagtagagacggggtttcaccatgttggccaggctggtctcgaacttctgacctcaagtgatccacccatctcagcctcccaaagtgttggaattacaggcatgagccactgcacctggctgtttcttcttctttcttttttcttcttctctcttcttttttcttcgtcttcctcctcctcttcttctttcttcttcttcttcttcgactgagtctcgctctatcacccaggctggaatgcagtggcatgatctaggctcactgcaacctccgcctcctggattcaagtgattcttgtgcctcagcctcccaagtagctgggattagaggcacccaccaccacgcccagctaatttttgtatttttagtagagacggggtttcaccatgttggccaggctggtcttgaactcctgacctcaagtgatccgcccgcctcggcctcccaaagtgctgagattacaggcgtgagccaccacacccggcctattttattatttttttgagatggggtttcactctgttacctgggctacagtgccgtggtgtgatctcggttcactgcagccttgacctcccaggctcaagcgattttcttgcctcagcctcatgagtagctgggactacaggcatgcaccaccatgcctggctaatttttgtatattttgtagagatgaagtttctgccaatgttgcccaggctggtctcaaacttgtgggctcaagcgatcctcccagctagtctcccaaaatgctgagactacaggcataagctcctgtgcctggttcaacactttttttttttttttttttttttttgagacagggtcttgctcagttgcccaggctggagtgcggtggtggcatctcagctcactgcaacctccacttcccaggatcaagttatcctcctacctcaggcctccaaatagctgggaatacaggcatgagccaccatgcccagctaatttttatattttttgtagagacgaggttttgtcatgttgcccaggctggtctcaaattcaaggtcaagcgatccacctgcctcagcctcccaaagtgctaggattacaggcctgagccagtgtacccagccatgtattttctaatatcccttggacttcatctttgactcatgttttattttgaagtattgggattgtttttcagttatctttctgttattatttctatttaattctgttatggtcatacaacataatttaaattcttctaaatttgttgaggattgtttttgttgcccagaatatgatgaatctctcattgaatgttgtatgtgcagttgaaaagaatgtttattctgctgttggtgggtaaagtgtcatgaatataattaggagaaattaatgatagtgttaaggttttctatatccttgcttttttggtgtacttattttattgattattgagagagaagggttgaattatctaggtgcaatatagattttttctgtttcttatttcaggtctactggtttttacttcatatatttttgaagctctgttgttagtatatacactcttatgactgttaagtcttcttggtgaattgaaccttttattattaaataataccacttttcctccctggtaatagtccttcttaaatctactttgtctgatattaatactgtcactccaacttgcttggtttcatgtttgtatggtgtgtcttactccattcattttttttttagggatccaattcctctacacatccttttacttttaacccatatatttctttatatttaaagtgggtcttgtggacaacatattattgcctcttactttgctcccaatctgctaatttgtcttttaattgattgtctttttactgatacactggattaaaatctatcaccttgttatttgttttctaatctttcatctgtgctttttttcttttttcttccttgatttggattatgtttcgaaaaggaaaactcccaatctcatgggtgctgcaagtagacaagatgtattgcatctgattgaaatagtttattattcatagcacaacaaacagtgtgaacatcagcatagttgtattggttcccctggtcctacattcaacagatgatgcagtgagcccagatgcatggtattcacacagtgggtttgcattgtagctgagggacctaggcccagcactttttattttattttattttattaattaattaatttatttgagacagggtctcactgtgttgcttaggctgctctcgaattcctggactcaagtgatcctcctgcctcagcctctcaaagtgctgggattacaagcatgagccaccacgcctggtcccaggacatttttatagcaagcagtaagcaagcctgccttggtctgagaaatgatctcacctctcaaaactctagctgtactaacaatcctgaacaaggacccaggtgaaagagaggtctgggccttgtgatcttgacatactcagcaagacacgttggacacaagtggcctagggaggaagcctcccaacattagaaaaaattattatatgtacttgttttcatgttcaacagtcattttaaaaaataaattttattgtatatgtttaaggtatacaacatgatgttatggaatacatagatatagtaaagtgattactatagtgaagcaaacgaacatatccatcatctcacatagttacctattccagcatttttatgattccattttctattattggcttgttacttacacctctctaaaaaaatttttttagtggttgctattgaatttactatatctttaatcagtctatcttcaaataatgttataccacttcttatatatcataaggaccctttaacagcatatttcccattcctccatctcctcatttttactgttgttattgtcatacatttcacttttatatatgctatgaggccacaatgcattgctttagtaaagcagttaccttttaaagtgagtaaaaatgagaaacaatgtctcttatatttacctttattctatctgtttccagagatcatcatttctttatgtagatccaagtttctctcaggtatcatatttcttctgcttacagaacgtccactggtaatgaattttctctctctctttttttttttttgatctgaaaaagtgtatttccttcatgtttgaaagatgtatttgctaggtatagaattctggattggcagttttttgtctttcagcattttaaagatatgactctattatcttctggttatataatttctgatgagaagtcttctgtaattctttgttcctctgtagggagtgtgcctttttcctctagatgccttcaatattttctctttatctttggttttcagcaatttgaatatgatatattaggttgtgtttgcatgtgcttctttgttgtgtttgtatattggcatttaatcttttctggattctgtgagtttcttggctctgtggtttgatatctttcattatttttggaaaattattagctattatatctacaaataaatattgtatctacatatatatatttttttttctctgtttcttctccttctgggatatgaatcacttatatgttagcgcttggatatttgttctggtttttgtttgtttgtttcactcttttctttttctgtttcaatttgagtattctctattgacctatcttcaagttcactggttatttcctcagctatgtcgagtttactgattgatatagtttggttgtgtcaccacccaaatctcatcttgaattgtggttcccataatccccacgtgtcatgggagagaccaggtggagataattgaatcatgagggtggttcccccatcctgttctcatgatagtgagttagttctcacaagatctgatggttttataaggggcttcctccttccccaggcacttctccttgctgctgccacatgaagaaggacgtgtttgcttccccttccaccatgattgtaagtttcctgaggcctcctcagccctttggaacagtgagtcaattaaacctcttttctttgtaaactacccagtctcaggtatgtgcttatagcagtgtgagaacagactaatacagtaaactggtattggtagaatgaggtgcagctataaagatacctgataatgtggaagcagctttggaactgggtagcagatagaggttagaacagtttggagggctcagaagaagaaggaaaatgtgggaaaatgtggaacttcctaaagtcttagagggctcagaagacaggaaaatgtgagaaggtttggaacttcctagagactgttgaatggctttgaccaaaatgctaatagtgatatgaacaatgaaatctaggatgaggtggtctcagatggaaatgaggaactagctgggaactggagtaaacttcacttttgcaatgcaaagagactggtggcattttacccctgccctagagatctgtagaactttgaacttgagagagatgatttagggtatctggcaggagaaatttctaagtggcatagcattcaagaggaagcagagaataaacttttggaaaatttgcagcctgatgatgtgatagaaaagaaaaacccatttttttctgggagaaattcaagccccttacagaaatttgcataagtaacaaggagacaaatattaatcaccaagacaatggggaaaatgtctccagggcatatcagagacctacacagcagcccctcccatcataggcccagaggcctaggagggaaaaatgatttcctgggccaggtccagtgctcccttgctgtatgctgcctcaggacttggtgccctgcatcccagccactcaagccatggcaaaaaggggccaaggacagctcgggctattgcttcagagggtgcaagccccaagccttggcagcttccatgaggtattgggccagcaggtgtgcagaatgcaagaattgaggtttgggaacctccgcctagatttcagaggttgtatggaaatgcgtggatgtccaggcagaagtctgctgcaggggcggagccctcatggagaacctctgctagggcagtgcggaagggaaatgtggggtcagatcctacacacagagtccccactggggcattgcttatggagctgtgagaagagggccactgtcctccagacccccgaatggtagatccaccaacaacttgcactgagtgtctggaaaagttgcagacactcaatggcagccatgaaagcagcagggagggggtctctaccctgcaaagccacaggggtggagctgcccagggctgtgggagcccacctcttgcatcagtgtgacctggatatgagacctggaatcaaaggatattattttggagctttcaggtttaatgactgtcctattggatttcagacttgcatggggcctgtagcccctttgtttgggccaatttaccccttcaatttctcctatttagaatgagggtatttacccaatgcctataaccccattatatctaggaagtaattaacttgcttttgattttacaggctcttaggtggaagggacttgccttgtctcagaagagtctttggacttggacttttgggttaatactggaatgagttaagactttggaggactgttggaagcacataattgtgttttgaattgtgaggacatgagatttgggaggggctggggcaaaattatatggtttgactgtgtccccacccaaatctcatcttgaattgtggttcccataatccccacatgtcatggaaaggaccaggtgaagacagttgaatcatgggggtggtttcccccatccttttcttgtgatagtgagttacttctcatgagatctgatggttttataaggggcttcccccttcgctgggcacttcttgctgctgccatgcgaagaaggacgtgtttgcttccccttctgccatgattgtaagtttcctaaggcctccccagccctgtggaactgtgagttaattaaacatctctcatttataaattacccagtctcaggtgtgtctttgtagtagcgtgagaaaggactagtatactgataagcctgtcaacagcattcttcaaatctgttatatgtatgtgttttttcttatttctagcatttctctatgtctctttttttgtagtcttcatatttctgcaaaaattccccttttgttctttcatattgtctacattttccacaagagcctttcatattcacgtattacttatagttgtcttaagttctgtgtcagataattacagcatctgcatcttgcacctggtcttgctttctctctctctctctttctctttctctctttctctctttaatatagaaacagggccttacgatattgcccagactggtcttcagactcctggcctcaagcattccatctgccttggcattccaaagtgctggattataggtataagccaccacacctggactgctttgtctcttgacagtaggtttttttggtattttaaaagttgtgtgtgtgtgtgtgcgttgtaatttttgtttgtttgtttttgagatagagtttcacttttgccaaccagactggagtgcaatggtgcgatcttggctcactgcaacctctgcttcccaggttcaagcgattctcctgcctgagcctcccaaatagctgggattgcaggcacccaccaccatgcccagctaatttttgtattttcagtaaagatgggatttcactgtgttggccaggctggtcttgaactcctgacatcaggtgatccatccaccttggcctcccaaagtgttgagattagaggcgtgagccactgcacccagcctgtgttgtaattttttattgaattttggacacagtgcttataatagtaaggactgagttcattattatttatgcctggaaattgtcgtatctcttcttctcttaggccattagtgtgggggattcagtcagttttttcaggagttgaattaggtttgagttttgttgtttctatgattacttcagtgtctatatctcctacaaattttatgtagtcatgctagctatattgggtctttagtaattccataaaaattttggcctggcatgttggcttacacccataatcccagcactttgagaggctggagcaggaggatcacttgaggccaggagtttgagaccagcttagacaacatagcaagaccctatctctaacaaaaaataataataataataaaataaaattagccatgtgtggtgatgtgcatttgtagtcctagatacttgggagactgaagtgggaggataccttgagcttagtgagtcatgactgcactactgtgcttcagcctctggacagtgtgagaccttgtctctgaaaaataaaaacataaacattagctgaactcttctaacctacttgtaaggagagcttgtctttctcttgctacacaactgagtgagtgcctgcatcccgtcacttcctggaggctcctgtccttctttggaatgctggttaattggttgctctgcaaccttaggtctctgataagtttgacaaaagttgtgattttgtaaattacccaacaatttttaaaaactgttattagtttgataatgatgctcttcccaggtttctgcatcctagatggaagccggagtctcaagccgtctaccttttcacggtgctattcaacgttttggccacctactcctggcctgctgcttgggtctttcttttgggtgacacccttccagtttagccccctgaaatattttcaggttagatgtttccccctctccattccttctttatggcaaatatctgacaaagagaagggacagaggttcctgatctttcttcatcttgggctcaaaataatccatggagtcgtgttctgaaggatacatctgggccaggcgcagtggctcacgcctataatcccagcactttgggaggctgaggtgggcagatcacttgaggccaggagttcaagaccagcctggccaacagggcaaaaacccccctctaccaaaaatagaaaaattagccaggcatagtggagtgcacctgtaattccagctactcaggaggctgaggtgggagaattgcttgaatccaggaggtggaggttgcagtgagctgagatggtgccactgcactccagcctgggcaacagagcaagactctgtcaaaaaaaaaaagggatacatctctgaaaatggggacatgactgggagtgagctaagctcttatccactgtactcctgacttggccctcattttctgtgctagaaaattagatgaagtatctactctatccattaatgagaaataagaatcaaaccaacccaatgaaatagttcttagaagatgaaaactacaacaggataaaaggggaacaggcacaggataaaagggttgtaagcacagtctctagaggcagtctacctgggcttaaattccaggtccatcacttactagctgtagggcctgggacaagttccttcacctctctgtatctcaacttctgtatctgtaaagtggaaacagcaagaggattaaaagggttaatttttgtaaagcacttataatagtgactggcacataataagctctgtggaagtgttaacaattagggcttacttcctataatttcagaaatttgtggaagacagcagttccctccctttctcagaacccattaccatcaaaacagctaacgattactgagcatttccaaagtgcccaagtcctgtaactaaccattttatataaattatcttataagagggagggattaattattcctctttagtaggtaagagatcaaggatcagagaagtgtttacccagctggctagaggaatcaataggtttacaacccaagagggtctgactgtattgcctgtgctcttaaccattgcatttgttgcctcccacaaactagtttccatgcttgtaaactagtgggaaaattgcatgctgtatttatctcacagggttgttttgagatcccaataatgttaagaggcagtgctttagtgtacagagtgctggtcccctgacagggaaacctgaatgtgtcaatgatttgttcacacttccctccctctgcacatgcccttctccctcttttctgcttgttgaactcatgtcttcaagacttagctcagatatcagcgtccagattttattctaacagtggaggaatttaggcaacgccgcgtggcgggggggtcgaggggggcacaccagacttgtgttctgaaatgacagctgacttgtaatgcagggaatggagtgtagccgggccagaatgagtacaagaaaaccagatagggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaagaaaagaaaaccagatagaaggttactgcattaggagcccaggcgggaggtggtggggcaaacggaaggaatggtggactggaaagatatttaggaaagagaatcgacaggaaatggaggtgtattttaatataggcagcgagggagagggaggtggcaaggatgactcctagttcctgacttgctcgcggatgtttgtcgaatgaatgatccagtgaccccaaggcagaagtatctcagagagatccccccactcccctccccgcacccgtcaccacgctgccttcggagctctgaccgtaagggggtggatggaaggcaggaggaagggaatggccacggagtcttggtccaggagctgctagactggacacttctagcactggtctgagccaggagacgctgcgaaaagagggcaaacgtttctcctctcgcagttgccgcctcgcccctccacccccgcctggccagcagcgcagcgcccctcttagcaccgtggaggtgctggctccttgccggcgtcggggggcgcggcgtagcggcccacccttccagctctgacccgcccggccggcccggcgcccaccccgcccagtgtgcttggtaggttgggcggcggctctgtctagtcccagagccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgtaagtgtggcgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgcctcttcctcgttcccggctcccagggcccgtcggtcccccgggagccctggaggcgcagccccaccccggccggcgcggctcgctcccacgcccccgccgcggcctcgctggagcggacggactgagtcagagggggcgccagcgctgcaggtaggggctccggcggcggtgggcgcaggtgccgcggtggaccgcggaggggaccggagcacgaggggaacggccttgggggagcgccctccccccgtcctccgccgacgcctcgtgtccctttttagggaattttttccctcttgctggctccagtgcgggtggggctgagaccgagagggagttctccatttcgctggctcctgcccggcccctggcagcctcctgcccccaaatctcttcaccccctttccagtacctataggtcgcgtaaacaactccctttctccagctctgggctccgcggccccccgggggacagctccttcagtctcgtgagatcggtggggttagggggaggggaaaagagagggggtgtcccagagcccctggcccccgtcagctcccccaccttggcctctccctccccctcctcgctgctggagcacaggctccaggggccctgggtatttttagcgttgtgacctgggcggcagctctaagagcctttcccgggaatcggcgtcagcgcctcgctcctccgccgccagcccgcggccgcacggtctccccagacttccgtggccctgccttggccagtcggggttgggtccctctccacctctgtggcgcccgtggagctggccagggtctgggatacgctgggtgcagatgaggtggggaaggcagtctgcggaggatgacgtctgatcctcaagctagaaactcccttgcctctggtgatgggctcagagcagaacgccgggaaggagatgagcgaatgggaatgaatgcaccgacctgggctggcccatagcctcagtgctctggcagggtctcagcttctcagccctaggggtcaggaggcctgctctgaactggacccagaacccgcctttccaattgctcctcactgactaatggggagataagtcagtgagatgtgtcccaggagggggacgcataaagagctgttggagttcaaaggaaagatggtagtctcctaaatagctcaccttcacaagcagggtcttgtatttgaggcaggtaggttggttatgccattttcagatggggagactaagaccagaaaggtgatttccttaggggcagagcctagtctggaagtcaggcctgtgacttcagagcaagggtttggggtagatggcacatgcgtgtgtacgtgtttgtgtgggtggagagaaaaggaggggcgcgggaggagttgctttagcctttgtctgggttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagacgtaagtcccaagtcctgagaagagggactggggtagggtagggaggatgtcctgtgggtcctgaatcttgtggcactctctcccctctggttttcttggccctctatgcttctaacttgggacctgacatgtaactctcactgtcctggtgtgcagcttgggtcctcctgacttgcccacttcttgatccgcagcccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaagtaagggctggaagtgggtgtttctaccaatgaaacagctgcctgttctgattttagggaagttgaccctgagggagaactgggttacacatctctaatccaaaattctgggaacggtcaatctcttctttaattttacatttgttatattaatataattagtcactataattaaaataatgtaaaattgtaatttttatatttggcaacttaagtagttttagtcattataatgatattaatatgtattgagtactttagtaggttccaatactgtactaaagtactttacatatattatctcaatccttacaacgtcctgtcagggtaggtgatataatctctattttataagcaggaaattaggctcagagaagttaagtcacattgtagccagaaggtagataaactggaattcatgtctgtctgactccaaagcccatatgcttaacttgtaagatagatattcttttaattaaaactgctactatttattgatggcttactatgccagacattttataagcattcttaggttttattcccaaaaccctttggggatgtaggtatcccttttattttgcagaggaggaacagagtccttgaaagggaaagtgacttgctcaaagccactcagcagcaataagtgatgtaggtggaacttgaactcttgccattcattgacctgactgtagatcccagacatggtgtaatgacgtggaaggagctggcagtcaggagatggtgatcttaatcctggctctttgctggattggcaaagtcactttggacaagtctctgccccactgtggactttagttactcctggccagataatctttaagagttctctgaagccctgtttgtggcctgaccagcttttctctctgggcagggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaac

SEQ ID NO: 38288 - DNA, 29986 bp, Homo sapiens
atggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgaggtgagcgggccgggatggggcgagcgaggctgcagggccggctgcgccgagtaccaggctccaggcctttgaaagcgccgcactccgccggcctcggctgggggaggggagcccggcccctgctcccggggtggagggcggtcggctgcgctgttttccggtgaggcctggtcttgcccgctcctttagggaaagggagagggagagtccaagaggagcccgctataaacgttgatctccggagggccaagatgctgctccgggatgggcgttttattgatcagatgtgtcttagagtagctagaaagactcatccctaccaaaaagtttttaacagaaggctgctaggaggctttttgtattccctgaggatcatcacatcggccatttcattgttgaaatagcttatgccaaactgcttacccaaattcaacttggcactgcctgtgctttttgccaaatatggattatgaaccatgactctcactttttaaaaatgtgctttggctagcaggaagtagcctttaggaacgcagaggaattagtctccggcagtacagcgtgctgcagcgatgtgggatgccaaaactacatttataagtaaaacagaatcctgtattttgtccttccctgaatagatactagaaatcaactttttaatctgttaatagaattagtccttagtcacttggcagcgttttaacatttctcccttctcccagtcgtgggctttgtcgtcatttccagtatctgctccctgaatcccggccagtgtggcactcaaacccccactcccacccaggccacatccagcccatctccacgtaactaatcttcccgaacattgaattctgccatcttgtcagaagtcgtcggtgagttgcctccactaatttcagtccagcctttttaggagagtgatgttcaggtttcttctgatctggctccagctcacctccaggctttttagccaccgctttcttgctcatatgctaaagggatatgctcatctgcaaaaaagaatgtgcttcaagagccctttgggacaggctttgtgctctcttgccagttcctccctaacacaagaccttttcaaagaaaaaaaaaaaaagacctggagtttgaagccacggatcaactcttcccaccttggagaaccagcagatacctactctctgtgaagacttccctaaaatttcttggttaagggtgatttatctgaccctttcctttcctttcctttcctctcctttctcctttttcctttcctctcctttctcctttttcctttccattcctttcatttctcctttcctttcctttttcctttcctttctcccttcctttcctttttcctttttctttgttgagacagggtctcgctctgtcgcccaggctggagtgcagtggccccgtcttggctcactgcaacctctaattgatcctcccacctcagcctcctgagtggctgggactgcatgcgtgtgctgacacgcccggctaatttttgtttattttttttttttttgagagaggaggtctcactatgttgccgagtctagtctcaaactcctgggctcaagcgcttctccggccttggcctcccaagtgctggtgagctctcacaccggtgcattgttttcgtgtttcatgttttcgttacatgttactttcttaggcttttccaattttctgttgtttttctgtgtaagaccgtaggatagaactttctgagagactgatcttggtttcactaagcaagaacatttgtaagaatcagtgctgtcccagatgtagtaatcgctattgagaaataatgaagttccccttactggaagtactcaggaagaagttgaataactaactgcctatgaggagattctgatatgggagggaatctgggagataaagttactgggaagtgaagattctgggagccgatttaatcctcacaacagcacgttaaacaggtagaggaggtttgtaaggaatagtggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttgtgtgcgtgttttatctgcccctactagcttttaggtgtcttgagagcatgactctggcttactcatctgtctattccagaagaccttgtctgttcttggcatttattaactaattttctaagactgggttgaagtagttgcatgtcaagtttatatcagctgttaaatacctttctggaaaaactggctgtaaaataaactcaaccaggaaaaaaaaaaaaaaacaacaacccgatttttaatagtgtctatccaaccttttttttttaagttgcaagggatccaccagatggaattaagagaactaagcttttatcatctgctggatataatgtgattttgtaaccattattggattggtgttggtttagacagtttattttcagctgactatatagttaattccgggactcttataaagttttttttaaaaagagaaaaagagaagatcaaaagcactggaactcaacgagtaaataacccatggtaacagagagatataatgcagtgatgtcagaggtgtacaagaagtgtgaatcatttaacatgtgaagccagggtctttagtccacttggggagagcaaagaggtgagtgggcttctccatctttttccttctgcctgccctgctacccccagccatatgcttaggagtggggttcccatttacactgccctgcttgtcgctcctggctcagctgaccctgcttgacatgtccacttcagtaattgaactgaaacgctgattgatgaacttaattcttagtgttcatcttttagccctgtcatttaccccagtatcacatttattttaaaacaataactattttggattaagttaattgtgtgagtgagagattatgaatatgtaactttgcaggtattttgttgaagttttagtcatattggaatttttaagatagaaatgatggtaggtgtagagctactaatatcctttttaagaagctaggaaaaatctagccatgcagaatgccacagtggtagaaacagtgtccagtaaacatattaaatggtcttaaggattcttgtcttttaaagttttatttaattttttttatagagacaaggtcttcttatagctcataactcattgcagcctccagctcctggactcaggccatcctcctgcctcagccttctgagtagctgggaagggatccttgtctttaaaactaggggtatggagggaagggtgggtataatataatatgatttttccgtttaatattttcatatattcttggtgattcattttagttaggcatttatttattattgtttattctaattttgtattataatagaatataattgtcttcttttcttccttttttttttttttagagacagggtctcactatgttgctcagcctgccctcaaactcctgggctcaagggatcttcccctcttggcctgccaaagtggtgggattacaggcatgagccatcatgcctggccttgtcttgtttttattttatatatataatatatataaaaaataatatataaatatataatttatatttatattatatattaatatattaatgtaattaatattatattatattaatatataatatataatataatattatatattatatataatattatatataatattaatactgtattatatataatataatattaattatattatattaatataattaattatattaatataataataataaataatattaatataattaatatatttatattaaaatataaaaatataatatatataatatatatatatttttttgtctcactctgtcgcccaggctggagtgcagtggcgtgatcttggctcactgcaaggtctgccttccaggctcacgccattctcctgcctcagcctccagcatagctgggactacaggcgcccgccaccatgcccgcctaattttttgtatttttagtagagacgaggttttaccgtgttagccaggaggtctccatctcctgacctggtgatccgcctgcctcggcctcccaaagtgctgggattacaggagtgagccaccacgcctggccttaattatatttttatgtaactttttgatactactcaagtattttttcctctacggtactcactatgctgaaagatttttctttcacatgttttctaaactatgtaatataagtgtcattggctatttttgtccacctgatggaggtaagaaatgatcaaagtacagtttaacagcagtattagcaagagttgagccttgctgaatatgtaagtttcaacggatttgctttgcaactacatgcagtagatgttttaagagggtaggtaggatatttaaatttaacctttttgtgccactgtgtgagagtgggcttctgaaaatggaggggggaagcatctctccttggttagtaggcattcaagtggaagatatgttataaaaacctagttgtatcttataggatgctaaaagcaaggtgactgaacttctaacagggcattctacattgagtatgtgcttttctctataattaggctaaaaaaaggttggtaagtaatatgaacttaaaatcaagattaacccccaatttacaaacccatgataaaaagtgttgttgattacttggatcctatcttttctgcagtttatgtttctagtgacttactcaatagttttttcttactctttccctggacagaatatgtaatataagaaacataagtcctttgagttgagggagatcagatagatttaataaaagtcatttagactttattgcatattctggaagtccaaagaagaatgactctggttgcatagcacttctaataaagccacaaaatcattacctgactcagtgcctgttcttgttatcatatttttactttatgttttggtatttcatttatttattacgtttcagctgtgagagtaccttctacaaaacattttaaacttttttctattttcattaagttgcagtcccactccacccagtccagcctcctaattctagcctttatacagctaagattgaggcaatcagttataaggacgcctgctcataattaccttctcagaaggtaattatattaatactgaatttatttagtggtatgctgtcatcaaaaaaattcattaaaaataaaatcaatgaaggccgggcgcagtggctcacgcttgtaatccctccactttgggaggccgaggtgggtggatcacctgaggtcaagagttctagaccagcctggccaacatgatgaaaccccatctctactgaaaatacaaaaaattagctgggcgtggtggcacacacctgtaatcccagctactcaggaggctgaggcaggagaatcgcttgagcccgggaggtggaggttgcagtgaaccaagatcgtgccactgccctccagcctgggcaacaagagcaaaactctgtctccaaaaaaaaaaaagaaactaaacacatttaataaatttcaagtgcataaatacattacaaaacaacattcataaaaataaacattcattaaaacaaaaaataattttattacaaaatattacatataaattctaatataaattaacaagtaacaataaagtatttaaaaatagtgaaaccattcacaaaaatacgtaatgaaaattaaaatactttaatgttatctttcgaaatcaggtttatctgtggtgtcattgtttaagtgcgtgcgtgtgtgtgtgtgtgtatatatatatatatatatatatatatatattttttttttttttttttttttttttttttttttgagacagagtctcactgtcacccaggctggagtgcagtggtgagatcttggttcacttcaacctctgtctccggggttcatgcaattctcatgcctcagcctccagagtggctgagactacaggtgcatgccaccacgcccagctgatttttgtatttttagtagagatggggttttgccacgttggccaggctggtctcaagctcccaacctcgagtgatccacctaccacgcctcccaagttgctaggattacaggcatgagccaccatgcccggcctaagtgcatatatatttttgggcacatttttacaacttttaaaaaaagcttttttttttttttgagacggagtcttgctctgtcgcccaggctggagtgcagtggcgtgatctcggctcactgcaagctctgcctcccgggttcacgccattctcctgcgtcagcctcccaagtagctgggactacaggtgcccgccacacgcccagctaattttttgtatttttagtagagatggggtttcaccatgttagccaggatggtctcaatctcctgacctcgtgatccgcccgcctgggcctcccaaagtgctgggattacaggcatgagccaccacacccggcccctaaaaaaagcttttttgacttagtagtgcccaggagacagttctaagcaaattgtaagcattttcttctgactcctttgtcttcagataatctcacctcttgtttgataacttattgagcaactttgtttctgtttttttgcagggacatcagtttttttcttggtagcaagctgtagattttgtttcaaggaaagcatcttcatcttctctagtttcatcatgtatagatggagattccgatgcaggtatctgtatcaatttcaatacagtcacatttgtgtttatttgaactctagaactagaaaaggaattacttttttctttgattttctttttcttccttctcttgaggatcatgaaagtataaaagaatactttctaaatgagggtgcctttttctttttcttttttttttttttacaatttttacatttggaattaaaattttaactagaaaagagtttttattaagcaagtttttttaaaaaaatcttaagttgttaatcctgctctcaagatgtaagtaaggtgtgtttcagacattattaaaatactgaaatagtggtatttgtaccaaaacactagtatctcattacttaccatgatatataacactgtataactgaatagtggaataccaaaattgaaattgcacactgcatctaatcctgtatgcatccaagtatattcttctgtgcctgtactgtctgcctttttcatgttttggacaaaactgtcatcctttgtgtacctcctctctgtgtccacgttcctattctcctccctcagtgcctttattctctcccttcccattgcttcctttgtatctgcttacacatgttcatatgtttctcttattttggaaaagaaagaaaaaggtcattcatttaatcttaacttgactattagtttcgttttctttccttccttccttccttccttctttctttcctttttttttttttttttgacagtgtcttgctctgttgcccagcctggagtgcagtgggcacaatcttggcacactgcaacctcagccttccgagtggctaggactacaggtgtgcgccaccacgcctggctattttttttttttgtacttttagtagagatggggtttcatcatgtttgccaggcagctcttgaattcctgacctcagatctgtccacctcggcctcccaaagtgctgggatgacaggcgtgagccaccatgcccagccatattagtttcttcagttttataaaccaaacttctaactaggggatttgctgctttttcactttactttagtatgttgttatctggcttcagtccttgccttttccttgaaattctttttttaattttaaagatagggtcttgctctgtcgccctggctggagttcagtggcacaatcatagcttactgcagcctggaactagtgggctcaagtgatcctcccacctcagcctcccaagtagctgggactacaggtgcatgccaccacacctggctaattttatttattttattttttttttttgtggagatgaggtctcactatgttgcccaggctggcctcgaactcttggcctcaagcagtcctcctgcatcggcctcccaaagtgctgggattataggcatgagccaccacaaattccattttttgaaagaatcttgtaagttagcaaattgctaaatccagggatctttttcagttctcatttgacactgttaattctctactgtttaagaatccatctcaggtgtatgaacttggcagaataatgaagcccgtttgacctcagttttcctgtattaaaacttaaaacagctcctaagtttttttgagtatcaaatgcaacaatgtgtctgaaaatatctcgcatctagttagtagcgcaccccaacctgacggtctgtgatgctttagttgctgcctggctcgaaatatctaagatagttttttttcctattttttttcctccctccaccttctttgaataaagacattctctaaggcgcattctttgaactttatctctttgccttatctgttggaaatctcatctacttgcagagctttagctgataaatttgggctgccagcaaccagatagagtacgtcctcacttaatgttattaatagattcttggaaatggtcactttaagtgaaatgacatcaatgatgtcattttaattcagtgttgtttcattataacattgatgagaaaagaaagttggttttcttttacatcatttcacttaaagttgcagtttccaagagcctattgaggacacgaaggctgtcaaccttgaggctacataccttgaggctgtcctaggctaaactctggtgatccatttctgataacctctttcaaaccttcatttgaaatgctttttatcaccccaagtggaatgtatatgaaaccaaaccccttgtttttattcccctttccgacataccttttaagagtactaaatacataatagcgttttaagagtactaatatttctgccaaccagaaaacctcaccaccatctttgattccccccatcccgcctacctttttttaaaggtctagtgatttttctttccattgtgtgcagaattttttccttctcttatttgtcttaacacgggtttcatgcagctgacctcctgattgatccagtggctgatactccccactctgccctgataattggtcacagtgccttgatggtgtttatgtgttacacaaaaatatgtaatgacttccctcttgcctctgagcttgtccacaaacataaagaatttcaggcccagtttatctttctcatcttgccccaaccattcttctgatggtttacttcttgttctcagaacatgcctatattctttcacattgtcagtacagaaaagaggtatatgcagaaaaggagtgatgtattttcaagttagccactccatgagtgactagtactgaatcccactgaaatcccactgaaacttcccaggaggcttatgaaatgaatcttagaaccagcttccatattggtagccctacagctattaacttcccatacttccaggtagtgaatgagtaaatacagagcagtgctttttggttggacctgcctgaagtcagtcacagcttacaagaaattgatcctccatagctggcataagatgttgggtcaggaagtttttgaaatggtacatagcatgtgtctataatggtgtgaaagttaaaaattccagaagatacagaagaatgtagaatgagaagttacgtctcttttccttttttgtattctagaaaaagtttgccaacccctgttctagtcattctggttcctttcctggaaacattcatcattaacctgtttcttgagacgtggtgtgtatttatgatacttacaccatccacatgtacacatacttagtatatactttttctcaacttcaaaatatcttaatgattttctatattagtgtatagaacattcttattattcttttagctctataatattccgttatgtggatctaccatttatttaactagttttctatcaatggacatttagttgtttttttctttctctttgttttgagacagggtctcactctgttgcccaggctggagtgcagtgatgtcatctctgctcactgcaacttgtacctcctgggctcaagcgatcctctcacctcacagcctcccaaatagctggaaactacaggtgtgtgccaccacacccagctacttttgtattttttgtagagacagggtctcactttgttgcccaggctggtcttgaactcctgggctcaagggctccacccatctcccaaagtgctgggattacaggcatgagccactgagcccagccgacatttagttattttgtctctttattacaaatgatagcattacatttatacatatttgtaatccgaaaaggtcaattccttgagtgtttctgtcttgaacttttttctgtaataggcctcccatactcattgcccacagtttgcattcagttttattgtagtgggtcaggatcattaagagctggagttgctgggataggcctttctcaagaggttctacttgagttggaccttgaggaatctggatgaagagggggataacgaaaaggaggtgggaagggaaaaaggactgtgtggctgaaggcttgtggttagcaaaagcctgtcatgctttcgagctgcactgcccagcactgtaaccatgagccatgagtatgtgtggctgtgagcacttgatatgtggctaatccagagttgaggtgtgcggtgagtaaatacctaccagggtctgaagatttaatatgaaaaaaagaatgttaaaatatctcagtagttttaaaaatattgcttataatttaaatagtagcattttggatatattgggttaagtaaaatgttattaaaatttttacctggttttacttttaaatatatggctaccagaaaatgtaaaattgtattatgtggcctacctttgtggctgcatgattttttgttagactctgctctggctcatccttcaggatggagaagcaggttcatttggggaacctggtatgtgcttcagtgagaactgttggatagttaccagaatcaagtatttggtatgaaaagaccattacgtttcttaaaacagtgaagtaacatgaaattagtttcaggaagattcaactgttcatattttgtggcactacaaaaactaattgagcacttactgtgtactgagcactgtcctaaagggctttattcatttaatcctcacagcaaccctttgagacataggtagcccttatgttacagatgaacttgagtcacaggggggtgtacctattggcccaaggtcacgccgtaactgataatgccttggctatgaactggcagtctgattccagagcctatacacttaaccactacactgtgtccctgtgaaggtgaattagacaaagaagatgatccttgcacatagcagtgaaggaatggtaatggatcactttttaatcctgttaatattttaattaaaaaagatcttctatcttcacggtaccccgatacttttcgttttaagttcttgtcaccatgattggttgtatgattttggccacccaggaccagcttagtatgtaacaagctttatgtttatttttcttgtgttttgtgtgtaggaaggttttaagaatatgtagcatcgcttaatgatggggatgtgttctgagaaactcattatcaggcaatttcattgtgcagacgtcctagagtgtactcaacacaaacctagatgtataacctgctatacacctaggctaaatggtatagcctatggcttttaggctacaaatctgtacagcgtgttactatattaaatactgtaggcagttgtaacattttatatatataaaaaaacatagaaaaggtaaagtaaaaaatttggtactgtaatcttatgggactactgctgcatattcggcccatcattgatcaaattgtcatcatgtggtgcatgtctgtactcttaaagcaaattttattttatccctacattttacagaggaacagagattaaataatgtggctgaagtttcatggctgggaattataaaaccatgagactgtgtagctttgatcactattgtgtttgatttaaaaagtaaacattttgtgtttgagcttagagctaagtgatcataaatggtgtatatttattcctaaaatttttctgggatttcagatcctgaaattttatacaaacctttaaaaagcattttcaggaggaaaatgtgtcagagccaagttgaaatttgaaatgcccttttttttttttttaatataaggattcttaatattggaagagaaaggaagttgttgttttgagaagggggcttgctccatcacccaggctggagtgcaatggtgccattacagctcactgcaggaagctcgtttttaaaggaccgtcaacgtaggtggaaccaaaataatggagagaaagcaagaagcccttaaaatgatacttgcttaattaattaaactcaattcattgagagccagctgtcaaggcaacaaatactttccattttgttaaatttctccagtatttagctcagaggtctagtcttaatggtaatgcctaaatttttctgatctttactgtggaattttataatctttatgttatgtgttaaggaatgacatgcacactaagaatttatgattttattcttacctgtgactagggcctttgtaataaatctgtttttacgctgtccaaaattactatgttcttgggtttctttttctttatctcttgggtttctagagattcataagcttaaaaaattaaaaataagttattaggattggaagagacctttggaagtggtttatctagcccagggcgtctcagtctgggaactgttgacattttggatatataattcttggttgtggaagggctgtcctgtgcattgtaggatgtttagcagcgtttctggcctctacccactagatgccagtagttcccctttgattgtaactaaaaatgtccgcaagcattgtcagatgtcccctgggagacaaaatcgccctggttgagaaccgcttgtctagcccatttcctgggagtggtggttcccttctctggaactcagacgttgagaagagaagggtatttaccacctcctctagcagtctgttccaactttgggtgcgtctttggagacagaaatctctcctctctgttaagctaaaacctgccatctctaactttttagttctgcctcttaggaccgtatggattggatagattcacttaaaaactttcccaattattggaacatgataccccgtccttcctggtccctcacgggattgttttagagccaagtcagcaaacttcttgtagttgccatgtatttgcaggctaccaatctctgatgcataatcttcctttccttccctccctcctccttgcctcccaccagccttccctccttttctctttcttcttatttcttgtaacttcttaaaaatgtaaaaaacctttttttgctcttataggctgggttttggttcagtaacttgccatccctggttttagagtctgacatctgctaatcttcagagggcagtgcagtgctttagaactgtatatagaactttggggaaggtctgagcagcatagaataacgttggacttgtcattaactccttcatgcgaagagcttactgcttttttgaagctttgtcacatttacagcgtaatgacagccaagacactggtttgtctttttcattaggccactttaccttctttttttttgagacagagtttcactcattgcccattgtgcaatgggcgcagtctcagctcactgcaacctccgcctcccaggttgaagcaattctcccgtctcagcctcccaagtaactgggattataggcttccgccaccatgccactttaccttctaagatatttttagacttcagcgtaggacgatctgtgttaacagctgtattaaacttgtcttagctggaaccaactctctataccctgctgaggtttgtgggtcttactctgtccttcagagtgttaatgaaatttttcttagcttcccgtcgttcaaatgttttttaaacatacctgggtctttcatgcaagttactaatacaaatttgaatgagatgtagctaagaactaaatctgaaatcacaaatgcctaacaaataaggtaattttggccaagcgtggtggctcacgcctgtaatctcagcactttgggaggctgaggtgggtggatcacttgaggtcaggagtttgagaccagcctggccaacatgatgagaaaccctgtcttgactaaaaatacaaaaattagctgggcttggtggtgcatacctataatcccagctacttgtgaggctgaggcaggagaatcgcttgaacctgggaggtggaggttgcagtgagccaagatcacaccactgcactccagcctgagtgacagagtgagattttgtctcaaaaaaaaaaaaaaaaagggaattttaatgcatggatatagcaggtctgtactctgttcttaaaattgttttggagaattatatgtaaatctgcattatacatgtttagtatcctcaatctaaaatccacagtgctccaaaatctgaaacttgagcactgacatacatgaaatgctcaatggaacattttggatttctggattaggggtactcagctatgatataaatattccaaaatctaaaaaaatccaaaattccaactacttctggtcccatacatttcaggtaagggatactcaaattgtagcaaccatcgtcagaggttaccgtcgttactgatggctttcagagtgattagacagtaaataagtgtaatgaccatgacaagaaaattttcaaaaaaactaaatcttatttacgtgcaaaataaaataattttgaataatgattttaagaagtaactgattttttttttccagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcaggtgagtgtgcttttccctctcatgagttcgctgaattaaagggaaagcgtgttgtgtgacatggagtcactgagtcattaacctagtcttatgggaatttggcttacaccttatttgtggtcttccaaccttttccttgtgtatcctttccttgtgtatcctctaaaataattttgtaccccctctcgcatagttgtctgaaatttttcatcttcaatttaaggaattgcaaagatctaatttctgttatattgtgtaaagtaagacagttagggctgggcacagtcactcacgcctgtaatcccagcactttgggaggccgaagtggacagatcacgaggtcaggagttccgagatcagcctgaccaatgtggtgaaaccgcatctctactgaaaatacaaaaattagctgggcatggtaatgtgcacctgtaatcccagcaactcaggaggctgaggcaggagaatcgcttgaacccaggaggcagaggttgcagtgagctgagatcgcgccactacactccagcctgggtgatagagtgagactccatctcaaaaaaaaaaaaaaaaaaaaaaaagggagactgttagggtgtttttaaaatctacccagtgactctaaataccattagtaatttgatacccactatcaccatcattcctttaaaacaaatgtgaatatacttttttaacagttggaaatttacatttttttcttcctataatttatattttcatttacttcccttaattttactctaatgattataaatttttgcttcaaaatttattacaaagctggtccaagtgcaatggtgtatacaactaatcgatgacaaaccagttacagatttctttcttccttgtccacccccactgcttcactttatgagcctaaagaaatatatatatggatcaccccatcatatctacctgcaataaaaatatgcatttaatatcattgaattttcaaagatattgtaaatttctcctagtaaatctcttaagtgttaactctatgaattgagttgttatagttattagtactcaaagaaaatatattataaatttaaataatcattttaaaaaattggaaatacatctcttaatgagatgatagggctattttttatttatttatttatttatttttttttagagactgagtcttgctctatcactcaggctggagtgcagtggcatgatcatagctcactgagacctggaactcctgggctcaagtgatccttccacctcagcctcctgagtagctgggaccataggctcatgccaccatgcccagctaaattttttgttttttgtagagacagggtctggttgtgttgcccaggctgatcttgaactcctgggctcaagctatctttccaccttagcctcccagtgtactgatattataggtatgtgtgcctgcccatccttttaccttgtatttattttttaaatttttatttatttatctttttatttattttgagacagactcttgctctgtcacccaggccggagtgcagtggcatgatcccgactcacttaaacctccatctcccaggctcaggcgattttcctgcctcagcctcccaagtagctgagactacaggcacatgccatcacgcctggatacttattgtatgttttggtagagatagagttttaccatgttggccaggctggtctcaaactcctgacctcaaatgatcgcccgccttggcctcccaaagtgctgcgattacaggcgtgagctaccacgcctggcccctggcccatcattttacaatttttaaacattttatagaaataattttaagtttacaaagcagcaaaaataaaatagtatgaagaacacttatataacttttgcctagattcacctgttgttaacattttatcccatttgttttagcatttgtactcttatctaaataaaattgtaaatgtgtatatatacacgttgtttacatacctgtctatagtgtgtacatatacatacattatttataagctatataatgcacacatataatcacaacatttaatatatattatgtattgatacagtacttgaatctgtcatccatattttaattttggatgacctaatgtcctttcttgttttttgaaaggacataggctgggcgcggtggctcacgcctgtgatcccagcactttgggaggctgaggcaggcggatcacgaggtcaggagatcgaggccatcctggctaacacggtgaaaccccgtctctactaaaaaaatccaaaaaactagccaggcttggtggcgggcatctgtagtcctagctacttgggagactgaggcaggagaatggcgtcaacccgggaggcagagcttgtagtgagccgagattgtgccactgcactccagcctgggcgacagagtgagactccgtctcaaaaaaaaaaaaaaggacatgaaatttttaaatatttcacttgtgttatcagttttatgtaatttaagtgggtttaacagtctttatattattttgcctcaactgttaaatcatatgtgtttatttctacatcttctcttttatagctttatttagttttatagatttaaccactttttttttatactttatgttctgggatacatgtgcagaacgtgcaggtttgttacacaggtatacatgtgccatggtgatttgttgcactcatcaacccgtcatctaggttttaagccctgcatgcactaggtattggtcctaatgctctccctccccttgcccctgacccctcaataatgtcctttatatcagtgtttttcccttcggtctaggtcagatattgcatttagttatttattatctttttagtcttttaatctgaaatatatccatagcctttttttaaaatgttttctgacatcaacctttttgggagaattacagtgtatccctcctccctccaccccaggaatgggctgttccccattttttgtttgtctgatgtttcctgatggttagattgaggtaggcattcctgactagaaaactgcataggtgatactttgtctctccaagaatgtctcatctggaagcacatggtgtccatttattcctcattggtgacattaattttggtgacccagtcaatatttcttttctgtgttgtcttcccttgcaactactatctaatctgtagggatatacttaaagacagtacaaataccctcttcctcatcaaaatttctccaaagattttgcatcaattgatgattcttgcataattagatctttcattgatgcttgcaaaatgatgcttttaattctaatacttcttgcatattcaccagtgagccttggtattctactgccagcaagagctctccttcctttcccatttgtttgtctttttactagcagtacaaacttatggattccttttttcaatggtttataattaattatttaactattttgctgcttaaattatccgatgttaggccagtgagagcctctccaaactgtgtcctgtgtctttgtggcatgctcccatttgattttgctcctcactttctagtacaacaagatattacaggttcatcatgcacctgctctgcccagtcctggaactggccatttctcggcggagctttgaggagctttttaggggagaatggtattagaacccaagatctaggtgcaaggttactgagctccttgttactgagatgtctttgcctcttgtctttttcagtggacagagctagaaaatatatgcttgtatcctgtgtgtacacatacatatatacaaatatacatccatacatatatacacacacaataatttaaatacagatgtgcacacaaacataggtttgctgcatttctaaccatgattttaagatcttttcagttttgtaatgtagggaattatttacatacaggttatacatttacaggcagatttgtaagtgttgcacccgttttataaaaagagctggtgaattaaagagtaattgtatttttctttctttctttttttttttctgagatgggatctcactctgttgcccaagctgggatgcagtggcatgatcgcagctcactgcagctttgacctcctgggctcaagtgatcctcctatctcagcccctcaagtaggctgggaccaaggcgtgtgtcaccccgtcaggctaatttttgtattttttttgtagagacaggatttcgccatgttgaccagtggtctcaagctcctgggctcaagtaatccgcccgactcggtctcccaaagtgctgggattacaggcatgagccaccgtgcctggccagagtaattgtatttattatatgtatggtcgtgtcctctgttccttacatagttgtttttgtttgtttatgagacagggtgtcactatgtttcccaggctggttttgaacttctaggctcaagcaatccttccaccgtggcctcccagagtgctgggattatgccactttgcccagccaaatttttaagttttaattactgaatgagtattactgatatacttgtgtttcaccattaggatttgagttcttgatatagttccaagcatcattttttatataacttacacagatgtctttccttatcagtgggaaagagtggaactgaatgtttgagcctgttgtaacattattttaatataataagaaatttttagatttttttcataaaacgtacttattttaaatagttacaagggagcagagtttaaatcttgctatgtgagacttttgtcatgattcttcactagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaattattatttccgaagttaactgttcccttggtcgtgatacacactcgattaacaaacatactgttgtattttttccagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaagtaagccatggcactgttgatctggaccaaaaaggcactcaactaggaataaacactctacagaggtttctcagtggccccatctgtgtgatatgcggggctacacaaaaatagcttcttttgctttgttctgttcttatacctgtctgtgatctgacttggggttggtgtgaatgtagtagagaaaggaagctgacagatgaatactgaacacaggtaatcagtttccttaattaggttgattataagctcctgaaaagcaggaactgtattttataattttacctgtttctcccgtggtgtctaggatagtaagtgagcagagcagtaaatactgtttggtttgttcagctgaggagaaacggaagaattgagactatagcatttgttgctgtgtgagaccagtggttcagaggggaggtttgggggtcacataaatgtagtttttttggagcatatttcatagaatttaaacacttagaaaagtcaagtgatttgtgtgctattttgatttgcttcctgtgcttactttcatttgtttattatttattttagtttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggtgaaattcttgtaaccaagctcagttgggctctttttactcatccttttccctttggttttgccaaaatgatgccgtggtacttgtcatcttagcttggttttcttatcatagaactttcttttttatagttgttgagaatataaatcagtataatattattgaaggccattttggtgtttaatacctaaagccttaaaaatgtgtagctagccgggcttggtggtatgcacctgtagtcccagctactcaggagggttgaggtgggaggattgcttgagcctgggaggttgaggctccagtgagctgtgttcgcgccactgcactccagccttggtgacagggagacccagtctgaaaaaaaaaaaaaagtgtatagcttttcgttcatgtgttacactaaagaaattgactgttgcacagactacttataattattgtaacttagtaaaaatttagaaacagcctaataatccagcagaaaattggttcagctgtttacaaatctctgtgtagctcttagaatattcactcttcaacatcatttcagtgacatggaaaaattttaaaaggaggtttacttttaaaatataaaaagaaggccgggtgccgtccctcacgcctgtaatcccagcactttaggaggccaaggtgggcggatcacctgaggtcaggagtttgagaccagcctgaccagcatggagaaacccctactactaaaaatacaaaaattagccgggcaaggtggctcatgcctgtaatcttagctactcaggagactgaggcaggagaattgattgaaccggggaggcagaggttgcagtgagcctagattgcaccactgcactccagcctgggcagcagagtgagatgctatctcaaaaaattaaataaataatatataaaaagaacaaaaaagacttaaggaaataaaaacattatttttatttcagtgcttatctatcgttgcgtactgctattatgggtaatttatttatttactttttggtaggggtggggtctcaccatgttgtccagccagttttgaacccctggcctgaaacttcctgcctcagcctcgcaaataatccttctgggattataggcgagagtcactgctctggcctaggtgacttgtttgtttctgtgtaggaactttttgttcaaaaagtcttagcccaagaatcctaagttctggagtgggaagctagagacctcagctcatcttgtagcttttactcttcagatgaagaacctgacccccagagagatcgggtgacttgtgtgagggagtaagctggctggctgtggccttcttcacagttgttcaatgccacttatttaaaacatgcccattggttttttattttttaatttttcttttgatgggaatagcaaggttttatatgaggcgcctgtcattgttcacacagatttattaagatttcatgtggagacggttgtggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaatatatatatatatacatatatatttatttatttatttattttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtaaaatcacattactgcacttccctgcattttctcatccaaaaatggggattacctgctttgtggatcggtttgcagatgaaataacacacgcagggtatctagcatggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccaggtgtggtggctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctcttgaacccgggtgagccgagatcgcgccactgcactccactctggtcgacagagctagattccatctcaaaaaaaaaaaaaaaaaaaaaagacgactcagtatacaaataaagactggaaagtcctatattaaaggaactagttaaatactagtttattttacttaatctagtgaatttttaaatattttctttctttctttttttttttttttttttttgagacagggtctggctctgtcaaccaggctggagtgcagtggcacaatctcagctcacctcaacctccacctcctgggctcaagccatcctcccacctcagccttctgagtctgggactacaggttcccaccaccatgcctggctaattttgtattttttgtagagacagggttttgccatgttgcagaggctggtctcgaactcctgagttcatgcaatctgaccaccttggcctcccaaagtgctgagattacgcccggcctaaatattactttcaaatagaaccatcttcatgggtagcagtttataatacacaagtagaatttgggaaatgtagtcccagtcttccattcttcacagtggatgcttcagccagtttcctgtctctgcacacacactgcccgacagcgggctttcccttctccttcagagcagtagcagttccctttcttcattcccacccatcacagtggcagccccctctgccctcctgtattctgaatcccacccttataatatgcttagattttgcctttctcccagccgttttgtgagcattgttcgtgtgtaccaattttttctcatcctttaaaaagaaaaaaaaaaagccccttttctcaattgtacatcgcaaatccaactcttgccctcctgcagtgtcagaggacttggctgtgatgggaataagccttggctctgttctccttgcatacttagcccatgggaacccagtttctggcctcaccaggaatgttgttgtgctttgagctccctgtggccttgcatgatgcctccgttggtccttacaggaggtgattggctggccacctcacttgctttctcctgtggacccttctttctctgtccttccttgaatgctgcctttgtccctcatgattatgctatcaacattcttctctttctgctttctctgtaacaggtttattgactcttttttttgagagtcttgctctgtcacccaggctggagtacagtggcacaatcttggcttgctgcaacctctgcttcctgggtccaagcgattcttctgcctcagcctcccgagtagctaggattagagacatgtgccaccaagtctggctagtttttgtatttttagtaaagatggggtttcaccatgttgtccaggttggtctcaaactcccaacctcaggtgatctgcctgcctcggcctcccaaagtggtgagattacatgtgtgaaccatccacccaccctgattcaactgactcttaactttaaaaatcacattggtcttaccatacatagttcatcaattgtgggagagaaacttgggtgtcatgctttatttatttattttttttttgagatggagtctcactctgtcacccagggtggagtgcagtggcacgatctcagctcactgcaacctcagcctcctggattcaagccaattctcctgcctcagcctgcccagtagttgggactacaggtgcctgccaccacacccggctaattttttgtatttttagtagagacagcatttcaccatgtttcagtctcctgacctcgtgatccaccctcctcggcctcccaaagtgctggcattacaggcgtgagccactgcacccagcctatttttctttttttaataagagatggagtcttgctttgtcacccaggatggaatttgtagcatagtagtgtgatcataactcactgtagcttcaaactcaggctcaagtgatcctctcacctcagcctcctgaatagctggaactacatgcatgaaccactgcaccattattttatttttaagagacgggatctcgctgtactgctcaggctagccttgaactcctggcctcaagtgatccttctgccttagcctcctgagtggctggctccactctgcttggctctgatatttttccataaagcctatcattcatttatcatggaggtatgttaattttgccttcttaatttctctcaaattcacctgctctttgcctacagtcatctgccccgatctggggcaacgcagtttcttcccagggctgttgccatagcatcgcagtggatcacccttccttcagtcttgttcccctctggttctttctctccactagactttaaaaaatttttgagatagggtcttgctctgttgcccaggatggagaacaatcatagctcactgcagccacgacctcctgggctcaaatgatcctcccacctcagcctcccgagtagctgggaccacttgtgcttgctaggatgcctggctaatttttaatttttttgtagagacaaggtctcactgtgttgcctaggctagtctcaaactgccaggctcaagcaatcctcttgcttcagcctcccaaagtgttgggattacaggcatgagccactgcacctggcctagcggatttctgaagcattaatctgttctgttactttccagctaaaaaccaacaagtgtctgaggacacagtttaaactccaagatgatagggtcctccctcacctggactcccacctaccctcatgacctccttttgtgaaatgctgaagggctctgcagctggttgtctggtactgctggcctttgctttctatttagcatgttccttctcccacaaaacaaaatcacattctcactatgccctgttcattcttcaggactatcttctgggaaacttttactacatacccctctccccctaatctgagtgtctgctttgctcaggtaacatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggttcgattagctttatttcatcaggatttgtttgactttacaaattgatttgggttatttcaacttttaggtctagtcttaagtataactggtacatattccttcaagcagccattacacctctcataaatttattatacacctgcatttttataactattatgctttttaattgttggccaccatttttagtgcttctgaattgttatggttctcaagcagcagttgtcaccttggttttgaattaatgctgtgacgcttgcttccaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttatagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 38289 - DNA, 9346 bp, Homo sapiens
ctcgttggtggggctgggggatgagagctgcaccgcgcgggacaagtcgccggcggcgcccgacggagcaggtgatttcccctcctgcccccggcccagggctaggagagtcgcggagagcgctgacccagggtacccgtccgatgtgttcccccacggtaccccccccggggcccgtcggacccccatctctgattctcgccgtggcctgtatcaaggcacatccagtttgctcaggcctgcctcgtcatgtgtcctccaaggccacagccgcatccctgtgccttcgggcccactattctggacgcttacgggtgtcccgctagcgggtttagggagctgctgcttcaggggtcgtccatcatcgcggtcccacttcctgtgctcgccctccctgtttgtgctcccgcctgactttggatgcagggatcccttgttcccctcaatgcccttggtgcctctaaggtctgacttgggtatcagaggacaatgatatcctctggggcctgcgttatgggtccagggcctcaggaaccgggcttcacaggggctgggagaagcagtgaagaccttccatgctagaccccttgctgcctccctgagaagttcgctaggactcctttcacactagctcccaggattcctcctcccacatggcctgctctccctccactttaagcacctccccaccccaagggagcagcatagtacttcttaccccactctcacttaaatttgtccacagtgtctctatctagcatctggagggtccaggcctgtgctgcccttgggaagctcccaggctagctgggagcagtgaaggtggggcagttagggttggctgcagaaagggagtcctgcagaatgagatttggagaggcagagggacagatgctctgggctgggagagtggtgtgagcaaagattctgaaatagacaatatagccagccaggcaggagaggagattcagaatataggatggggccacacaatttgcatcgtgagaggtgatgtagtgtggtggttaacagtgagggttctggatccagacagcctgggtgtaaatctgccattaacttgccttgtgaccttgggcaagttacttaacctcatagtgccttcatttcctttcaggtaaaatgtggataatacggccgggcgcggtggttcatgcctgtaatcccagcactttgggagaccgaggcgggtggattgcctgaggtcaggagttcgagaccagtctggccaacatggtgaaaccccgtctctactaaaaaatacaaaataaatttgccaggcatggtggcatgcgactgtaatcccagctactcaggaggctgaggcaggggaattgcttgaaccagggaggtggaggttgcagtgagctgagatcgcaccactgcactccagcctggatggcagagcgagactccgtctcaaaaatacataaataaataaaataaataaaataaaatggggagaataacagtatctacattttagagttattgtaaggattaggtaagttaatacatgtaaaagtgcttaggacaatgcctcgtaagcagaggcaataaatgctaatattaccatcatcggaggcatttaggcaggactcatgacaggatgacagtcacatttggtagacaccatcaaccaatgatctctaatttgcggcccccaagaagcaatggggttctgtgggctacatctggaatttgaaatgtctcatggaaatcatgttcttaccctggagaagggtggctgcttaggtgctacttaggaaaccagtctggcagaccagatcttccccaactcaggggctatgcggggagaagtattaggagcccctgagcaggaaggatgtacttaggaaggctaccggggatggggaagggtaaaagagcttagaagcctgggtgaagtttgggtagaccaaaaacaggaggagggagggaggatgttcccttggaatacaaactagagaaaagcttaggggagcaagtctttttatttggggacagtgaagagtttcctaaaaattccctggcccccaggccttggctaaaaacccagaagcatgagacacatccctgagaagcttcttccctagaaactgggctctcaggccgggcacggtggctcacgcctataatcccagcactttgggaggcctaggcgggcagatcacctgaggtcgggagttcgagaccagcctgaccaacatggagaaaccctgtctctactaaaaatacaaaattagccgagcatggtggcacatgcttgtaatcccagctactcaggagggctgaggcaggagaatcgcttgaacccaggaggtggaggttgcggtgagccaagatcgcgccattgcactctagcctgggcaacaagagtgaaactctgtctcaaaagtaaaataaataaataaataaataaataaataaaattaaaaaaaaaaaaagaaaacctgggctttcagccaagtttcagtcaccaccacacaggtggctcatgcctgtaatcccagcactttgggaggccaaggtgggcagatcacctgaggtcaggagttcgagaccagcctggccaacatggtgaaaccccgtctctaccaaaaatacaaaaaattagctgggcgttgtggcaggcgcctgtaatcccagctactcaggaggctgaggcaggagaattgcttgaccctgtcaggttcacaccattgcactccagcctgggcaacaagagcgaaactccgtctcaaaaaaaaaaaaaaagaaagaaactgggctttcatgcagcagccatgggcctttgtcccggcagaggctaccatgcaactgacagcccaggattcgagggtgatgtaacccagggtcgaggtaggtccctggaggcggttctaccctgagggagctgcatgatgggatctagtatgcctgggctgagccattctgctcttcctcagggcccatgagggctctggcgcaggtggtatgaattcccctggtaggctggggcttctcagtcctgctttccaaagtgacccctgtgctatgagcaactctgttaccactcgggaccaggcaactgtaagcatagaaggtagccctgtcccaacccacttgaaagtcttgatatcctcccttccccagagtagcccctagaatagatgctgaactaggtgacctggatttaaatctgactaccgcagtcaagccaggtgactctgggcaagtcattaaacacactgaacttcatttcttcataggtaaattggggttcaactgtttattgagtgcccacttcatgagagatgctgagtatacactggtgaatgtcagcccggtgtttagtccctgcttcatgagacaactggaagaaacattaaacattgtccaaataataattatggctgtgaaaggtgctgctagtcagaaaacttgcagcctgcatagagagtgtaatatggcagggcccaaatgagttctaggtcaggggtgatgtcccttgaggaagaagggaattattttatttttatttgaaaatatttttcttttcttttttttttttttttgagacaaagtctcactctgtcgtccaggctggagtgcagtggtgcaatctcggctcactgcaacctccgcctcccaggttcatgtcattctcctgcctcagcctcctgagtagctgggactacaggcgcgtgccaccacacccagctaatttttgtatttttagtagagacggggtttcactgtgttagccaagatggtcttgatctcctgacctcgtgatccaaccccctgggtctcccaaagtgctgggattacaggcatgagcctccgtgcctggcctaaaaatatttttctacaaaaagagagatggggtcttgatatgttgccgaggctggtcttaaactcctgagctcaaacgatcctcttgcctcagcctcccaaagtgctggaattacaggcatgaggcaccgtgcccagccaaggaagggaattttaaaatgagacccaaaagatcagagtgacagtaagtgaaggggtggaggcagaagggtgcccaggcagaggaaatagtttgtgtaccctagcacctagaaaaatgcccgtgctggctaggtgctcaatacatacttgttgacatgttccattcccatctacatgcttttaactcccaaaagtctgtttgggagtcaggagcatgtgggtggtaatgaatggctccagacccataggtccaaatggcagctcattgtcccactcagatgatgaggcagaaggctcagagggtatactaccttgccatgaaagagtttgagtgttagcaaactgaaagaaagccagggtggggccgggtgctttgtcatgcctgtaatcccagcactttgggaggccaaggcaggtggatcacctgaggtcaggagttcaagacctgcctggccaacatggtgaaaccctgtctctactagaaatacaaaaattagccaggtgtggtgcacatgtctgtaatcccagttactcgggaggctgaggcaggagaatcgcttgaacccaggaggcagaggttgcagtgagccaagatggcaccactgcactctagcctgggcaacagagtgaggctgtctcaaaaacaaaacaaaacaaacaaacaaacaaaaaacaaagccagggtggagggagggaaatgatccaggaaggtatggtgcatggtgaagctggagagagatatagacagggtaaggacggcaatggaaagccatgaaaagattctggacttccctgaagggtagcaggaaggcattgatagattttaagcaggaaaagatgtgatttttttgtaaagatcacacagctgtggtgtggagaataggttgttggggggaagatggagtggggagaagggttaggaagttcttgcaggcaagagatggagaaaagtgggagtagagatggagagaaatagatgtggcaagagataatgattagggcttggcgactgattggatgagggagagcaaggggtaggatggtgtcaaggatatttcccagatttgtggcaggaacagccgggtgcctggacatgcatttactgagaatggccttggaggagtaaagcacttgagagaacattagtttgggacacgctaactgtgagatgcctgtaaaacatacacgtggcagtgttagagaggtagatgtccaagcctgtagctcagaggagactggactagaggactggacatttgggaattgatgacatggcattggtacataaagatgtgggcccagatgagatcttccagagagagagagagcgctgcagtgagaaggagaggcagccttgcatgtgaggaactcccacatttagaggggagcagagaaggggacagagaaagggccttcgaagaaatggccagagaggtagaaggaaaccaggaaagaatggcatctcagaaaccaaagttggagctgctgaaagggcaaatagaaggtgaaatcatgagaaattcccccctttttttttgtagatcaaaaccagacaaaattggcaagctcatatggttcaacctaattagactaaaacctggaaaaagtaactgatgacctcagtctaagaaattttgaggccgggcacggtgactcatggctgtaatcccagcactttgggaggctgaggtgggcgaactgctttgagcccaggagttcgagaccagcctgggtctcgaaccctggactcaaaacatggcaaaactgcatctctactaaaacaaacaaacaaacaacaacaacaaaaaactagtaggtggtgtgtgcctgtagtccagctactccggaggctaaggcaggaggatggcttgagctggggagatggaggttgcagtgagccgagatcataccactgcactccagcctgggtgacagagccagaccctgcctaaaaaaaagaaaaagaagaaattttggtggagattttggagcagaagccagactcaggatagggagaagtggatacaatgcagataagaaggaaagaaggaaatagaattgacagacttggtgattgactggtaggggtgaaagagggcaaaatcaagggtaatccccaggtttcagctttggcagctgagtgagtggtgtcagctgatgaagcagatgtgtgtttggagggggatgtgcgcagatcagtagtctatgatgagtgtgaggtgcgtggaactggtggtgcctcggagccttctgagtgggatgatgagctggcatttggacctatgggtctggagccattcattaccacccatatgctcctgactcccaaacagacttttgggagtcaaaagcatgtagatgggaatggagcatgtcaacaggtatgtattcagcacctagccagtatgggcatttttctaggtgctagggttacactcatgaataagacagagtgtccccctcatccccaccttgctttggagcttccattttatgggggcagacagacaataggcaaataagcacaaaataatgttaatggtagtaagtgctatgtagggttaaggggcatggagaagacttacttgccataggttagtcagggaagggctctctgaggaggtaacatttgagcggagccctgaggagtgactggacgagccatggatgtcccgcaggacacagacaggaggaagctcagcaagtctgagggacagaaggtggggtgggagcaagctagggaggagggactggggaggctggagagctgggagagggccagatctgtgggctcctcaggccttggggaggaggatggaaagtgctgtgcagatagtcctaagctgcaggaagggcagggactgggcgagaagagagaatccatgaaaggcttccccttctatctgggccccagagccagaaaagcccctttgtgcagagggtgggtggcctgttctgggtgggggaagggctgtgcttggtcctgaggctgagccttgaggggctggacaatggggccccttgtgattggacttgggggccaaggggctccctcagtgatgggattcctgagccaggaggcatgtgaccccaagaccttgtcagaaggtctgggactgctgctggggaatggggtaggggggtggggagaggtaggggggtggggagaggtgggggggcgcctcctctagaggctgtctccagacacagtgccctgtcctgtctcaggctgaaggaggtgagatgggcggaggagggggcatggttctacttgggggaacagagagggcagcatcaacagatggttccatagcaggccaggagggaggagccactgcccccaggcccagtgggtgggggcaggcagaagaaggcctggccatcctgtctgtgtcccttcagaagagagagcatggagctggagaggatcgtcagtgcagccctccttgcctttgtccagacacacctcccggaggccgacctcaggtagagacgggtcccccggaaggctcatgtcagtgctggagctggagctgccgggcagtactatgggtactggctgatggaaagacagcaggagggctgactaggatttgctgagaggccttacctctcatcctgtccctgtcacctttgttgggcagatgggaaaccatagctctgagggagggggttatactctctggccttaaagataaaggtctagctcatagaccccatgaagctgagggctggagtctcaggataggtgggggtgctggaggcatccagtgtcctacccagggcttgtcctgttcccttcctgcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggtaggttctggctagggccaggaggaggaaggggctggctgattatggggtgggcagagtcatcctctcactgccctcatcttttcaggggcacaataggggacatgatgcagaagctctcagggcagctgagcgatgccaggaacaaaggtgagtctggggctctgggcacctgagtgattcataatcccgctcccccaactgcctgctccccagagccttggcaaacctgatgctctctttgcctctttaagagaacctgcaaccgcagagctctggtgtccaaggtcaggtgcccatctccccagagcccctgcagcggcccgaaatgctcaaagaagagactaggtcttcggctgctgctgctgcagacacccaagatgaggtactggtagaggagggtaccgatgagggacccagggggctggaaaggggggagtattgcctcttgttaacgtttgtacccttaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggtatcttttcccagcaccctctaccatgtagcctcagctacattccaccttggtgttaagccccaacccctacctatccccatctgtttcccctgctggtgcccttgggcctagaccaggcctcccctctctgcaggacctgcccagacgcctcagaggcccccaaaaggatgagctgaagtccttcatcctgcagaagtgagtctgggctgggctgggctgggccctagagggtcttcccagggtgacaggagcttcacccagccagtttttgacaggtacatgatggtggatagcgcagaggatcagaagattcaccggcccatggctcccaaggaggtgagagagttaagggttgctggggatgcggaatgggtgggactggctcctggcttctgccactcactgctgattgcctgacaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaagg

SEQ ID NO: 38290 - DNA, 11535 bp, Homo sapiens
gcaccgcgctgcgccgtgcccgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtgagtgctgcgcggccgggatcggctgggaggagaaggggtcgtagggctgcagactggcccggccgtaggcccccctgaggtgctctgcttttccgtgcctttttgcctagctggccccatctcgcctttccggggagtccgcgccccattagctctttagaatcaagcagagccagagtgtcatttggcacttgaagaaactgaggtgcagtgaagcaggaactgagtctgtgaaggacccgaaactactctcctcagttcgtgttgtgctgtgtgcgcaaatgagccatgactccatgccatgcactactcacactgtgggcattattgatagcatttcggccttaaaacacttttagggatgtattattcacaacgaggaaaccgagcctaacagattaacagcagcttgcccaaggtcatatggctattaagtagcagagcttggttttttttttttttgacctctgaatggatatgggacaccagtgcttctcaaacttaatgtgcatacgaatagcataggtgtcttgttaaaattcggattctgggctgcgcgaggtggctcacacctgtaatcccagcgccttgggaggccgtggcgggcggatcgcctgagctcaggaattcgataccagtatgggcaatagggcgaaaacccgtccctacaaaaaaatacaaaagttagccgggcgtggtggtgcacgcctgtggtcccaggctgagggaggctgaggcaggagggtcgtttgagcctggaaggcagaggttgcagtaagccgagattgcaccattgcactccaacctgtgcaacaaagtgagaccctgtctcaaaaaaaaaaaaaaagcggatcctgattcatgaggtctggggaggaacttgatgttaacaacaagcgctcaaacactgctgctgctggtctgaggaccacggtttgaataggaggctctaaaccagtgtgctgtacttcccagtagtatgtcactggcttcctatcagagacactgactattctgataataaccaccacagtagctttgctaagctctatggatttccagagggaaaagaggagaggaactttggaagaggggtctttgaagttaactttgattatcaggcaggactgagagacagacagctttctaggcccgtggggctagtgggagctaatgggggcaaggacctctgaatggagggtgtttgatgattgagtgagtgttcaggtttagataaaactgcaagggagattttagcagagcatggcaatttattttctaggcagtcaggaactttgtaagcttttgagagctgcaagggtgcagtgatgagctctgtattttaaaaagtcatctttgtcagcaatgtgaggcgttgattggagccaagaagcacaatcaggaaaaaagctcaggcaatggttcaggcaattaggagtcaccacacttgtacctcttttgccttcttacagctgtatgtcatgcctgaaggtcagctcccaacccatcaaatcccacatttccagtgctcaaatagtattgaagtcctatctcccttggacataactcctcacttcagaaaggagtcatctttgtccgtttatgcctctgaggactcgaggttttcccttttcatcaccacttcatatttgcccaagactgtcacttggtgtaatgaaaagagctccactttggaactaaacaaacttgctcactaggcacaggcactgtggttcacacctgtaatcccagcactttgggagaccaaggcaggaacatctcttgaggccaggagttcaagaccagcctgggcaacatagtgagaccctgtctctacaaaaaaatttaaaaaattagccaggcatggtgatgtgcacttgtagtcccaggtactcaggaagctaagggaggagaatcacttgagcccaggaggttgaggctgcagcgagccacgattgcaccactgcactccagcctgggcaacaaagttgagaccttgtctccaataaataaataaataaacagacttgctctgctgctttccagctgtgtcactttgggcaagttacatggtcaggtcgatcagagccaaagtttcctcatctataaaataagaataattaatttttgcatatttgttgtgagaattgagtgagattctgtaggtaaaatgtctgacatgcaaaaggtgctggacagagttccccttccttagctcttgttatgcaaacagtttaccatatatttgtaaattgttcatttacagaaccctttttttttttttgagacagggtctcactctgtcacccaggctagagggcagtggtgcactcatggctcactgcagcctcgacctcctgggctcaggcgatcctcctatcctagccttccaagtagctgggactacaggtacataccaccaggcctggccaattttaaaattttttgtagagatggggtcttgccatcttggccaggctggtctcaaacttctggcctcaagtgatcctgccacctcggcctcccagagtgctggggttataggtgtgagccactgtgcctggccttacttaactgtttctctgttatgtgccctatggagctcctagtgaaatcagggagacaaacaggtaaacagcctgttgctgatcttggtatgatagatacatgttttgatagaggtgggtgagcagaaagcactttaggagcacaaaggagatacagttgggagggagaatgctctagaggaagtaaaggttggctgaaatgtgacgtatgtaccacttaatctcgttgttagtttagccgtttgtgcctttctgggagacagaagagtatagcagttaagagcatatgctttggggtttgacatcacctccaccctactagtaatttgattctgaggaagttacctatctctgaggactggatgagataatgaatataaactgcttagcccaggagtagggatcagacttcctgagttcccagagcttccctaaattgctttggaagatttaggtcctaggactttgttgaaatggttgtcctcaacagcatttactgaatgcatattgtgtttatctagctcagtgtctaatatctatagtaggtgttcagtaagtattgagtgaggtcacgtgtggtggctcatgcctgtaatcccaacattttgggaggctgaggcgggtggatcacctgaagtcaagagttcaagaccagcctgaccaacatggtgaaaccctgtctttactaaaaatacaaaaattagccaggcgtgatggcacatgcctgtaatcccagctactcgggaggcagaggctggagaattgcttgaacctgggaggtggagatttcagtgagccgagattgtgccattgcactccagcctgggcgacagactgagactctgtctttaaaaaaaaaaaaaagtagtattgagtgaataagtatatgtagattacaaggaatataaaacatggtcccaatcctccaaaggtttacagaccagatggccatatccattaaaaagacaaattgtggtacaagattgtgcatatagagtgaaggtgtgtgtcacataaatgatgtttctaagacagttggaggagtggtggaagagatatggtagattttcaaactacagccctggcgagtacctggcattctgtgagtaatgggatattctggccggacaccgtggctcacacctgtaatcccaacactttggaaggctgaggtgggaggattgcttgagcccaggtttcaagaccagcctgggaaacacagggaaactttgtctctacaaaagaaatttttttaagctatctggacgtggtggcatgcacctgtgatcccagctacttgggagactgaagtaagaggatcacttgagcctgggtggttgaggctgcagtgagtgtgatcatgcctctgtattctagcctaagtgacagagcaagattctgtctcataataatgaatatgtctcataataatgaatttctatcaatgaaataaaattgtgtagctctttttcaaattagcaggaaatgttaaaataattccttaagaataagactttaaaaataagttgtacgtattttgggggtacatgtggtattttgatacatgcatacaatgtgtaatgttgaaactggggcaaatgggacatccatcaccccaaacattcaccccttctttatgttgggaacattcaaattcctctccttcagcaattttgaactatacaacaaattattattaactgtagtcaccctactgtactatcaataaatagaatttttttataagtttttctctcatcatctgttttttaaaacttaaccttcttgctggttaccacttaatgtgcccgaaatttagagttagttggtatgctaagtatagcccacaaaattaaatatttattgatctctagtttatcagtaatttatgatgttcttcaaagagcacaatagctgccggggttagactcactgagtaaacaatgggaaaatgattgtagatggggtgtgcaggtagtgagaggtcgaccactaagagagaatgaggagagaggttaggaaaatggggccttggcaagaggccaagccatgcctttagggctaggatgctgacatcatcatctcgaacgcttatggagtctttctgtgaggaacatgggtcagcgtagagagagtctggttctgtgtgtctctgcagtccagtggcacatgggagaacatgcactctttggtttgctatatggcgggtagcccattatggaaagcagtggctgtttggggtaagagagagtgctctgtccagttctagaacataggaatatttttcatttttattgttttatacattttcggaaatacttttatatgcatatgtcttgttttatatgctactactgtgagaaagataggataggtctttttttgtttttttttttgagacagagtctcattctgtcgcccaggctagagttcagtggtgtgatcttggctcactgcaatctccacctcctggcttcaagcgattctccagcctcagcctcctgagtagctgggactacaggtgcgtgctaccacgcccggctaatttttgtatttttagtagagacggagtttcaccatgttggccaggctggtcttgaactcctgacctcaggtgatccacccacctcggcctcccaaagtgctgggattacagttgtgagccaccacgcccagccaggataggtcttgtctatgttttagaggtagtaaattgaattgcccaaggctgttcattcatttattaaataaatattaagtgctatatgctaaaatatacattgcatgtaatattttagatttgttaacctttaaagaagtgataatgtgggccgagtgtggtggctcattcctgtaatcctaacactttgggaggctgaggcagggggatcgcttgagcccaggagttcaagaccagtctgggaaacatagcaagacccctcttaaaaaaaaaagaaagaaagaaagaaagaaaaaaggcatggtggtgcacgcttttggtcccagctacttgggaagctgaggtgagaggattgcttgagcctaggaggttgaggctgcagtgagctgtgattgtgccactgcacgccagcctgggcgacagagctagaccctgtctcaaaaaaaaaaaagaatatgtagggtgtctcaaagtcagggatcaaggcggtttgttcagaatagctttttttttttttttttttttttgagacagagcctcactccgtcccccaggctggagtgcaacggcgcgatctcggctcactgcaacctctgcctcccgggttctaacaattctcctgcctcagccacccaagtagttgggattacaggtgcccaccaccacatctggctgatttttgtatttttagtagagacagggtttcaccatgtgaactggtcttgtactcctgacctcaggtgatccacctgcctcagcctcccaaagtgctggtattacaggcgtgagccactgagcccagtgctttttttatttttatttttttaagaaatgccataacaggccaggcgctttgtcacccaggctggagtgcaatggcgcaatatcagcttactgcaacctctgcctcccaggttccaatgattcgcctgcctcagcctcccaagtagctgagactacaggcacccgccaccacccccagccaaattttgtatttttagtagagacagggtttcaccatgttggccaggctggtctcgaactcctgacctcaggtgatccacctgtcttggcctcccaaagtgctgggattacaggtgtgagccactgcgtccagccaaaaatgtaactcttaatacacatggactaatttttgctttctttgggatttgtcatttgaatttcaggtttgcatcgccagcttctatatattacggcctttttttttgctggatattatcttgtaaaacgtgaagactacctgtatgctgtgagggaccgtgaaatgtttggatatatgaaattacatccagaggattttcctgaagaaggtatttcaagttaattttagataatctgtgtttactgtattattattttccctggttaatcttatccatgtgtatggctttagataccttctaaattctgttgactcccacatcttagtctatagaccaaaattctcttgaattaatatatccagtttctgactacctccgtgtcctttggacagcaaacaaaactcatatcccctctgccttcccaaacctcctgctcctctgtgtcctgcttcagagaatggcactactgtccacctggacactcaagccagaagcctgagaatcatcaagtctttctctttcacttcccattagtcatcaggtcttatcagttctacttcctaaatatttcttaactttgaactctcctctcccactaccactaccctggttcaggccttgttaatctcttgcttggactgttgcacttgcctcttaactcaccacttgctttggtcttatttccaatgacagcaaatctgatcacatctgtttaaaatagtcatccggctggtcgcagtggctcacgcctgtaatcccagcactttggggggccgagcggggcagatcacctgaggtcaggagtttgagaccagcctggccaacatggcgaaaccctgtctctattagaaatacaaaaattagccgggcatgatggcgggtgcctgtaagcccagctacttgggaggctgaggcaggagaatcgcttgaacctgggaggcggaggttgcagtgagctgagatcgcgccattgcactccagcctgggtgtcacagcaagactgtgtctcaaaaaataaaataaaattaaaataaaataaataagtcatccattgcctagtggataaaatccagactccttaggatggctcatttactccaggttagctaattgcctgtcctctggtagaaacactttacccacattcttatctaccatatgatatacacatgtgtgtgttcttcatggattgtagcttcgtctttgtttccccagcctcttgtatagagcctacacatagcaggcacttacttatgcataatagtggatatgaaccgtatggaatacttcctcattcctcatcactcatcatttgcctggtgaaatgctttgtcccgaacctgccctatattactttatacatgttgtaccttcttcctgctatgttattcttcctcttgcccctgtttccaccccatccacctagcaaatttctgcttttattatctcagtgaagctttcacccagctacagtcaggcattccctcagggtgctctatctctagtctgctatgaatctattaatagttgtaatataacttttctcacctgtgttttacacacatatacacaacacagatgtgcacatatatgagtatctgtaggctgggagtttaactactacgacagttttttttggtttccccaggggtttggcacacatagccttattaaatgtgtaaatgaatgagtatagaaaaaatttgaacttgtaaacataaatagattttccccagtctcggcaacatagtgagacctcatctctacagaaaattaaaaaattagctgggtgaggtggcacatgcctatagacccattgacttgggaggctgaggcaggaggattacttgagcctgggaggacaaggtgccgtgagccgtgatcacaccactgcattccagcctaggtgacagagcgagaccctgtctcaaaaaaaaaaaaaaaaaaaaattcttctgttaatgtaaatgcgtgatataaaacatttaaatttcattacactgaatgatctctaaggtcttatttagctctaaaattttattactctttaatattcccacagccttcagtcacatatatgatatttatggtggatcagaaagatacagtttctttttttgccaaagaagagcttaaagactagcacaaagccatgaatagtggatgtatcgggaatgcataatacccagaaccgttaaatgttagagctggaagtcatcttggatatattgattactaggagtgaggcccagtggcttgaggagtcttcagtctcagacctctggctctttgcctagacatagttccatgagttccctgtgtctgcaggagtgtgtatagcttcagggctcattctctttctgagctgcagattagtggcagttgtgccaagagcctcatgcacagacagtgggagcccggagagcttgaccacattggctgttggcctctcctagctgacctgtgcccctctgtgtttatttcttccttcacctcttcagtcaggatactcctggcagcaccttgtccctcttggcagtcatttggttgtcatcacagattcctccaaagttattcttcagtcaatgaaagaaaatccttcagtgattaccaagccatagtcaaggacaagaaaataaggaaattcttaggggtttgtcttagtccgtttggcctactataacaaaatgccttaaactgggtaattaaaaaaaattttttaactttgtttttcttaccacctgtataattgcagaatagactgggtaatatataagtaatagaaatttattgcttgcaattctggaggctgggaagtccaagatcagggtaccagcacagttggtgtctgctgagggcccactctgcttcatagatgatgccatcttgctgtgtcctcacatggtagaagaggcaaacaaggtcccctaagccgatccccctcatgaggacagagcctttgtgacctaatcacctcccaaagtcctaacctcttaatatcgttatcttgggggttacatttcaatttatgaactttggggggacatgaacattcagaccacagcaggatttcaatcataagattagtgagtgttaattttcgtttaggaaatacaatttttaaaacatatttttaaaataaatcttttatgatctttccttttatagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtatttttttttttttttttgagacgacagtcttgctctgtcatcaggctggagtgcagtggcgcaatttcggctcactgcaacctccacctcctgggttcaagcaattctcctgcctcagcctcccgagtagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 38291 - DNA, 10040 bp, Homo sapiens
agcgcgcgactctctcctgtacctgggcatccagaaaaatggtggtgatggcgcgactctcgcggcccgagcggccggaccttgtcttcgtgagtccacagaggagccgggggtggcctgcgttggggcattgggacctggacgccgcaggggatcgaggctgggtcggcaaggagatttaggccgaaactgccaggccaaggtctgggaaccctaatgggccagagaccggatcgtcatgtccgcaccgaactgtccaggagtaaaaatatggtgttgtatcttcgggtctgagtagaaaaccactgtcgaagggaagcgtctagcctcccgaaccaggggcggaaatgggggcgtgcagggaatgggagaggaggaagatcgcataactgaaccttgagaggtgaagatcggtgtctgaagtaaaggcttgcttacgaggccagggttctggtttctgggatgaaggcttggttttctggatagcggtctctaggcctggactgcagcatgacagtttctggggtggtggccaggctagaagaaccctggtgatgtggagcttgtcaggcgatggccagtgaaatacttactctctggagtagaggcgtgacatcttcaccagattcttggtgtgcagagttaaaggcttggcttctggtgtataactcctcctgtgagataaaggcctagcttttaatttctggggcagagttgagctagacgctggctagtgggatcctgggggcggggctagtggcttggaatctggacctgagagccctggtggctggggtaaagatctggtcatctgggcctggggtggagatgggtcagatggtgacagtgggagtctgaggggccaaaggcctggtgtctgggaagaggcacgttttgaagaagtggggtctggtgtccaggactggcatctgggccagggccttggtatctaaggagtctgaccatctggggcagaaagcgagtggtgatgcggactcattcctggcccagagccctaatgactgagaagtctgatgatttgggttcgattttgggtagttgaattctgaggggtaaaggtctgggccactgtcttggtgtcgggcatctggtttggtgcctgggcatctggtgacctgacttccttggtgggtggtgggatctaggtaaaagtccggagtttggacctgagccccagcagtgggatggtgctgcacacaggctctgagggtaggcctctcttcttcccattccctggccctggcaggaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcaggtgggaatggctccagctgccctgcccaccagcccccaccccacctggtccagttataacaaaactgccaagtgggtcccgggtcccgggtgattgcttcgtgtttcatcactgacctgtacatcccttgatgggtcagcacaccttctctgatgtcccagtctgtccctgtcattgctgagacatgtcacccctcccacaccccttcttcccacatttgccaactggggcagggcaaatggttctgggggtgtccataaagctgaccgatcagcatctgtcccctcctattccccagctacaaactctggtaccgatacctgaaggcgcgtcgggcacaggtgaagcatcgctgtgtgaccgaccctgcctatgaagatgtcaacaactgtcatgagagggcctttgtgttcatgcacaaggtttggggctcggcgaggggatgaatcgggaagtggagctcagtccatggtggtgggtggggcggggacaggggctgggctcagcatgttagggatgggggcttggattcctgttgcttctttgcatgggaagttgggctggactcagtcctggagctgggggtttctgggtcccgccgcatttatgtggtggccccaggtgtggctcagccacaggacatcgagtgtctgtggccaggccatggagtccgtggcttagccccagccgcctctccccacacccccagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaaggtgagcctagcaggtgcgctggttccccaggttagtttccagaaacggcctcactgtgacactagctccgcgtaggatgtcacccagcagacgggatgtgggaagaggctcctggagatgcatgtgttttgttgttgtccgtgattcatgtctttattttccaaatagtttgttcacactggtttcacattaggcatagcgatgggtgctgaggacagtgtgactaagacactccctgcctgcacggagcttttagtctaagtaggaagacagatgcatatgagctgatggcatgaactagagtaaaaccacagccatgaagagggccaggaataggggtggggagaagcaggcagggtggagagtggaagcaccagccgggcgggagtggggcatggtttgctcaaacttaaagtatctgttttatgacgtttggattctaagctggaccagtcaggactgaggctggacccgtggggcccaggctggacactatagtcaaggctggacccatgggatcaaggctgacccaaaggggccaaggctagaccagtcaggactgaggctggactagtggagccaaggctggacccattgtgggttgggggtcaattctaacccaaaaggaccaaggctggaccattggggctgagactggaccaccgcagtcaaggctgtgcccttgcgggtcaaggctaacccaaaaagtccacagctggtctagtcaggactgaggctggaccagtggagccaaggcaggacccacagggggttgagcctaacccagtggggccaaggctagaccagtaggaaccgggctggaccagtggggctgaggctggtttgacagggcttgcttttgcccaagacactcataaatgggtggggggggacgccccgaagccactgaatcgggaggtgggcgtagccctgccaccccactgactgcctgaggggtggctcggtccccagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccaggtgggcctgccgggagccggcaactgggtgggagggccaccccctccatgactgagcctgagactctcccccactgccccatgccctgcagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggtgcatgctggcacacggggctctgggttcggggcggggtctccctccgacactcggggacacatgttgacacatgcacaggcagaaaacatgccatttatggctgggtgtggtggctcacacctgtcatcccagcactttgggaggccgaggcggtaggatcacttgaggtcagcagttcaagaccagcctggccaacatggtgaaaccccatcactactaaaaatacaaaaattagtcagacatggtggtgcgcgcctgtaatcccagctactcgggaggctgaggcaggagaatcgcttgaacttgggaggtggaggttgccgtgagctgcgatcgcgccacggaagtccagcctgggtggcagagcgagactccatctcaaaaaaaaaaaaaaaaaaaaaaagtgccatttttgacagacatgcatatccctgcacacgattactatcctgctgagggtgggggagcactcctgcccgcaggcacgtcagccttggagtcagccacatttgcgttcagggttcaccctctggctctgcggccttggccccactaaggtggggtgtcttcatttgtaaaatcagggtgacagttactgcctgtcaccaatcagctcagtgacgcaggcacagcactgaggaggtacgtggtgtgagggccactccctcaggggttagctgactgtggctcttggcaggcagtggagtggcaagctcaggggatggcctgggggcaggtgggtgcagagggggccagagccgagagcggggaggctcaggaacccagggaagataggttgggagcctcgaaagccaaacgggctggccatgctcctggctgggggagccgccagtggggtgtgggcggtatgcgcttcgcagcgccccttccaggggcacgtgtaggccaaggctgtcggaggcagcagggcaagacccgtcagggctgggtagagagaggggacctgagctggggtgggcgagccaggtggaggacaggcgggctggggaagagggtcaggcaagcgagagggacgctttggagcaaattctgaggcctcggaggatgagctgaggcgagggtccctgcagggtggacccataggcgctggggggtttttggccacctattgggtgccaagtgcttcacacatgtgtctcagtcgagccctgaggtcactgtgtgcaaagggcagtcacccagtttactgaggaggtcctgaagctcccaagaccaccctggcagtgcagggcagggcgggggtgagaaggctccacggaggctctgtcctggggtcactacccagaggtgctggatgcgtcactacccagaaggcccccaggggttccacattgaggctggtgctaagagtgctgctgcctgtcccctgcgccactttcctctcacctccccttccctgggtccccacaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggagggtgagcctctgggggccccggctggtggggagagagctgagtggacattagcggtaggggcgggacacatctcaggtgaggcagccctgggaggctcagctgggggccagcagggaaggaggctgagtggatgcagggggtgtgggggtcttgaaggagccaggaatggggacacttctcaggcctgggccagagcctggcagggcaggagggctaggggaacagtgggggtaggagggggtatccacagtacctggggctgggggtggggctcaggtggacacccgagctgagtgtctagggcccagagcacttggctgggggctggagcggagtgagggtggggagtggaggcggtggcatccggggacctgcatcctgggtctccgcccctgacaaacatgttcgcggctcccagatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggaggtacatgaagcctgccccagtcctacccctgagggccagtttcctgcagaactggggagccacccaccttcacccataatgtcaccttctaggggcctgactttgcttagtaggtccaattccacccctgttcttggggttctcctcctgcccgagccccgcccctcagagccacagtccctcctggccccaccccttggagggccacagctccctcgtggccccgccccttggagggtcacagctctctcctggccccgccccttagggccacagctctctcttggtcctgaccattgtcaagggccatagttcgtttctggcctctcccgacaggggccacagcaccctccaggccccacccctcagagccacagctctgccccgaccgtcatctgcagggtcctgagtcctatatgacctcctccctcctgtccccagatcatcaacacctacacagaggctgtgcagacggtggaccccttcaaggccacaggcaagccccacactctgtgggtggcgtttgccaagttttatgaggacaacggacagctggacgatgtgagcaccctgttgcgtgtgcctgtgtgttcatgcatgtgtgtgtgcttgtatatgtgtgcatgtatgtgtgtgtacatatttgtgcatggatgtgtgcacgtgtgtgtgcatgtgcatttgggtgcatgcatatgtgcacgcatgtgtgtgcctgtgtgtgtgcctgtgtgtttgtgcctgtatgtttgtgagcatggtcacctttctgacccttgatggtgggagctgtccaggtgggcagggtctcagcctcgcctctgcccgccccggcaggcccgtgtcatcctggagaaggccaccaaggtgaacttcaagcaggtggatgacctggcaagcgtgtggtgtcagtgcggagagctggagctccgacacgagaactacgatgaggccttgcggctgctgcgagtgagaacaggcccaggctgtggggtgggggctgcaggttgtagggcaagggccagggacagcccctgagcgcctccccggccactgtctgcccctgcagaaggccacggcgctgcctgcccgccgggccgagtactttgatggttcagagcccgtgcagaaccgcgtgtacaagtcactgaaggtctggtccatgctcgccgacctggaggagagcctcggcaccttccaggtgagctgcctgtggctggggagggacggggccccggactcagctccagaaccagctccaacctttcccatccccacccctgcagtccaccaaggccgtgtacgaccgcatcctggacctgcgtatcgcaacaccccagatcgtcatcaactatgccatgttcctggaggagcacaagtacttcgaggagagcttcaaggtgaggggctagggtggacccagaggcccctgatggcagtgtcccctccccaggggtcctcagcaacttacgaatctgctggggcttgtgtgacacagtatacagactgggtgacttaaacaacaaagatttagcttctccccgtcctggaggctggaagtccaggatcgaggcatgggcagggctggttcctcctgaggcctctctccttagcttacagacagccgccttctccctatgtctttgtgtggccttctctttgtgtgtgtcacttttgaaatttcctcttcttataaaggacatcagtcataatggattaggtggcccctaacgacctcagtttaacttagtgatctcatcttcaaacgaatctactttctgaggtactgggggttaagatttgagcatatgaatgttttgaggggggcacagttcattccatagcaggcacagaatcctacttccacgtgcacccatgactcatggggagggtgttggtgccagtgtgtgcgggctctccctgccccgctgctcaggagacgggttgtggggtccagggggtgggttgcgtgtccgtgggaaggccatgtcccgcggccggagcagtcatgtttgagtgtgtgtttctatggatcgtgtgggcattatacagatacacaaatggggaggtcgtacatgcatacgcgtgctactgcctgcccctctgtcagggggtgcggccttctccctggggacaggcagccagcgtcagcggagctggggagccacccaccttcacccatcatgtcacctcctatggggccagactgtgcttagcaggtcccattgcacccctgttcttggggttctcacagagggagacagtgcagaggacagacccccacaactgccattagggacagggaggcgtggacagggaagggccccaagggagttcctggcaggctccctacagacgccacccaaggacatcccgggtgcctggtggtctctatctgcagactctcacatgtgactctccctctggtaacaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagagtgaggcgggcagagggcatggggggggtggcgggcgggctgggtttctgactggccccggctgaccgtgctcccctctccccgcctaccccgcccagccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtacccaccgtggggggctgggccggggccagaggtccctgagcagacggaaggggtccaggcaggtgggaggggctgaggaggagccttctggaagcacagggatggccatggtgtgttgggagcccccgagctaccccggcctcactcccggcctccccaaccccggtgtccaggtgctgtcggacgagcacgcgcgtgagatgtgcctgcggtttgcagacatggagtgcaagctcggggagattgaccgcgcccgggccatctacagcttctgctcccagatctgtgacccccgggtagggctgtggggagggacgggtatcagggttgggggctgcggcggagtcagccagctcacgggcacacacacccacccctgccctgccccccacgcagacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccggtgagccgtcccagctggctgagttcctgatccagggcatctcagcccggcctgacctgggctttccgggtctgggagcctcggatcctgatggcaatctccttgagggctgggccatcacctgggggactgggatagtgcaacgtccgatgtgtgggaggggcccccgtggcgctgaccccctgctcccaccccctagtgtctgacctggcccctgggcagagtggcatggacgacatgaagctgctggaacagcgggcagagcagctggcggctgaggcggagcgtgaccagcccttgcgcgcccagagcaagatcctgttcgtgaggtgagggcggatccttggacgggacaggactgggacaggtcccaagggggcccggggtggggaactgaggcagcatggcccgtccctaggagtgacgcctcccgggaggagctggcagagctggcacagcaggtcaaccccgaggagatccagctgggcgaggacgaggacgaggacgagatggacctggagcccaacggtgagggcccggctggggcggggacggtggcattaccagggtgggcctcgggggacaggccaacgccaggagggtgactggctcccgccttccccacagaggttcggctggagcagcagagcgtgccagccgcagtgtttgggagcctgaaggaagactgacccgtccctcccccatcccccctccccaccccctccccaatacagctacgtttgtacatc

SEQ ID NO: 38292 - DNA, 1244 bp, Homo sapiens
gctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcctggtcacgcgcaagtcctggctgtggcagcacgacgagccgtgctactggcgcctcacgcgggtgcggcccgactacacggcgcaggtgcgtgcaccccgtccgcaccccgcccctgcagccgcctggtctccccgcctcccctcctccctgcaggtttgcgtggctgaggctcccacctcctgacctcgggggccgagagctttgcgagctgaccccgcttccttctggctttgcagaacttggaccacgggaaggcctggggcatcctgaccttcaaaggtaaggctcgggagagcgggtgcccggcagttcgatgccgaccgccgacggcacagcaagtgtgtgcagacgcctctttttcttcatcagggaagactgagagcgaggcgcgggagatcgaacacgtcatgtaccatgactggcggctggtgcccaagcacgaggaggaggccttcaccgcgttcacgccggcgccggaagacagcctggcctccgtgccgtacccgcctctcctccgggccatgattatcgcagaacgacagaaaaatggagacacaagcaccgaggagcccatgctgaatgtgcagaggatacgcatggaaccctgggattaccctgcaaaacaggaagacaaaggaagggccaagggcacccccgtctagaatgccagaaccagcgggtggccttaggggctgtgaggcagtggggaccttattgatgaaagaaaccgtctttgcgttacacccgagtctgcctctcggagcagggagctcaccttccgcgacgtgttctgagggtctgcatcttaggggggagggctggggcaaatcgccacctgtgcctttcctctggccctgctgcccccacacccaactccgagggcccacgctggggaaagcgggaagcgctcgctccctttcccccattagtgctctctctgcctggatcccggcagaagctatgaaagggaataaagagaaaagaagt

SEQ ID NO: 38293 - DNA, 10935 bp, Homo sapiens
atctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcaggtgcggctcgcgggtgggcccatcccggacagatcgagagaccggcgtgggatggagaaagaggggcagggtgggccgaggggtcaggtttgtgaagattattgaagagatttgcagcagccggggttgaaacgggacactagggttaaccggagatgaataaggaaccggagaagatccggcctgtctgacaccccgggctgggaggtgggcccaggtgcctctcggagccaggatttggggtgctgcgaataagtggaaatgggctggggagggaggagggagccgaaaggccgggctgaacagcagacttagtgcaattaatcacgtgtgaggggtgagatgagaactaggtgggcttttaaaagctgaatttactatttttagtcgcccaatgtaaagcagcgagccacctggctttgggacggccccttacagttgaggaagccttggtgatctttccccgccctggaaacggcctgttgcgttgcggcgccgtctccctaccccgcgcaggttccagggcacccgctttgccgcagaactttccggcggtggaagggcccccatctgtgctgtccattgggcagctgccggccacttgtggccgtagagcatttggaatgtggctagtgcggccaggcaaccgaattttacatttgcattttaattaattaaatatatataaatataaataaataccatatatatagtatatatgaatataaataaattatatatatgtatatataaatataaataaattatatatatatatatatatatggtatgtgtgtgtgtgagagacagggtcttactgttgcccaggctggagtgcagtggcgcgatctctgctcactgcaaccttcgcctcccgggttcaagctattctcctgcctcagcctcccaagtatctgagattacaggcgcccaccaccacgcccagctaatatttgtatctttagtggacacggggtttcatcatgttggccaggctggtctcgaacgcctgacctcaggtgatccgcctgcctccgcctcccaaagtgctaggattacaagtgtgatccatcgcgtctgggtcattttaatttaaataaatttaaatcgccaagtggagcgagtagctgccgcattagacagcatagtttttgaacttgacgggatgatacttcctgatgtggtctaggatattactgtttatataactatcgtgtatatatagaatatacaaacgtaactatttgcaataaatagtatattcatttatgtgatttattaaattgcatgaatatgtgatttattatgaaatgtattgattacattatatgaatatgtgagttttgcaccgtggagaaattcctgagggtcatggttcttttcatgaaacttatgtgtagtttcttaattgaggttccaacacaaactcaatattaaatgttatttttaagttaaagcatttgaggagaaaaggaattcatcttcttttcctataacgttataaattggaaatgtgctgaatgctaagagtcacattagtgaactgaaaattcatgtatttattctgcaccagtgctcagccttcagaagacaaggatggggccgggcgtggtggctcacacgggtaatcctgacactttgagaggctgaggcgggcggatcacttgagcctaggagttctagactagcctgggcaacatggtgaaacccagtctctactaaaaatacaaaacgtggtgacacatgcctgttgtcccagctactcgggaggctgaggcgtgagaatcgcttgaacccgggaggcaatgctgcagtgagctgagatcgctgcagtgagctgagatcgcgccactgcactcctgcctgggtgacagagggagaccctgtctcaaagaaaaaaaagacaaggatgaataagaccagtaccatgcccccgtgtcaaaggcccaggccaggtctggcacatagcaagtggcatataaatgtttgttccataaaatagtgagccagatgggcaagacccctgactctttggagcttacattccaatggggtatgaggtgttatgattgtgatactgtctttcacttatttttaagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaaggtaagtgaggatttctcttctatgtgcatgcttgatacaggcataagtatgaaaacagttcctttttttttttttgagacggattcttgctctagcccaggctggagtgcagtggcacaatctcagctcactgccacctctgtcttccaggttcaagcgattctcctgcctccgcctcttgagtagctgggactacaggcatgtgccaccacacctgactaatttttgtatttttagtagagacggggttttgccatgttggccaggctggtctcgaactcgtgacctcagatgatctgccggtctcggcctcccaaagtgctgggattacaggtgtgagaaagcagttctttacgtttaaaaattgacctcgtcatttctctacagacttacaaaatactgtactctgtagctcctttggtaaaactctaatctaggatgaattaggtagataaaggaagcttttgtcttgctctttaataagttgcagcttgcttttatatgtattcgacgaaccagatgaaatgaccctttcccttctgtagctcaaaaatggttgagtattggcaatttcatgtgtttccacctaataattgttggcaggtcctcaccgcaatgtattcagagttgtgttttgttactgttcgcaaatgttgggggatctttcgagatggactgtgtgaaagaggaaagggaaagcatgtcagcacatggacttccctgatcaaggacatgcttctctctggggcagagcacttcagtacacggcaaaacactgaggaaattcctctcctttcagtgtttggctgatcatgtggaattgatgataatcctttttgatagcttattctttttaacctgcattaaaagcgccatttaaaacactgtaattgaacagccctaaaacactgttaggagtaaaagaacagtattcctgcaaggcctttagcagctcaaaaatacatttttttaaatatcagggatagtaagaattcctagtattttttcctttcaatgttaacctgaaaaatggttgtcttccacagctttcttacgtaagaagatgtggtaagatgaggaaaaaaaatatgagaaccagttaacagttcattattcatcattaaaccaatatgtaatatgttcttaaattaaccaccttttttttttttttttttttttttgagacagagtcttactctgtcacccaggttggagtgcagtggcacaatctcggctcactgcaacctctgcctcccggattccagtgattctcctgcctcagcctccagagtagctgggattacacatgcctgctaccatgcccggctaatttttgtatttttcatagagacagggtttcagcatgttgcccaggctggtctcgaactcctgacctcaggtgatccacccatcttggccttccgaagtgctgggattacaggcgtgagccactacgcccagcctaaccacttctattataatacaatcttgtgtttctaatattttcaatgtctaattaatactgttatttactaggaatgtatggtttcaacttgccccattttccctaggtttgggcattccatcttcttcttttttttttttttttttttggcttctaagctttcaagttattattttttcctgatctaggggtcaccaaattatgggctacaggtcaaatttagccagctgcctattgtaaataaaattgtaaggagacgcagctaccccagttatttaagtattgtctgctcttgtgctacgtggcagagctgagttatcccacccaacaagactgtgtggcctgcaaagcctcaaattttactctctggccctttccagaaaaagttcaccggccctgtttacccaacgacatgcatttctgttttttgtagcctttgccactttgcgtaaagcacactccaggtctctgctgttgggaagaggtcttcacctaacttccggcagccaggtttcttgcttctcttccctaaattccacactcgcactctctctcagttcatttaccccctgactcagacagaggggattgaggtatttcagaagaggctttgtatttgacagctctttctccctctctcctttttatttttatagctccaaatgagaagatgaagcaagtgttaaagaagactatagaagaagccaaagcaataatatctaaggttggcttttttaaatgatgcactaaaacttgttgggtttttttttttttttttggagatggaattttgcttttgttgcccaggctggagtgcaatggtgcgatctcggctcaccacaacctccacctcctgggttcaagcaattctcctgcctcagcctcccgagtagctgggattacaggcatgcaccaccatgccgagctaattttgtatttttagtagagacggggtttctccatgttggtcaggctggtctcgaactcctgacctcaggtgatccgcctgtcttggcctcccaaagtgctgggattacaggcatgagccaccgcgcccggcctaaaacttgtcttttgagataaaactccaactctggcttccagagttgcctctcagccagccttctctttcagccttccggaggcaaaggaaacaagcgtatttggggtaggctgtagcttttcctttcataatcctgacggttgcccagaggcctctccgttcctccaggcagacacaaatttttgttggcttatgtaaatataggttcacgtataatacaaatatgtataatacaaatgttgatttcatttcttttacctttttgaagaacttaacaaagttaagtaggggagatttgaatattgtggccatcgagtagctctccagacacttgattgacttaatatgtatttgatataaatggttttttgtaattgtcttcagcattttatacaaaggctagtttatagagggaggagcgtaaatttataccattgatatacagataatgtgtatctggaggaagagaatttaaggctattgaaagaagtggtatctgtatctgttgcttgtatttgtgtgttggtgatattagttgctaccgctctcaactgcaagtctcttgactgatcaccactttttcttctgcttctcctggtttgctcagcagaactgttatttttaaaccaatatttctcaaacttaccaagcttttgactaatctttgaagagcctcagcaaaggctgccctgaagctctgtgcctgttaatataggaaaggctttatgaagctctacaggagaggccctggttgagcccgtcgtttgcgtggtgatggcatctaggcatgtgagcacgtctcaggccatggcaagaaaacagtggtctggctgttgttctgcacccttctccccacactttgctgtggaactcctctctcggtcgcctcacttctcccctttgcctgtgtacttctgaaagtactttttatccttggtcttcttcctctctcagtatcttatctactctgccaaatgcaaattccaccctctgcagataactctgaagcttccatcctttccccctgacatcttgcttcacttccaacctgaatttccagctggttgtgagatggttctatctgaacacccagtcagcactttgaagtccagttttctagaaatgagctctttgcttcctcactcctctccctctctgttctgtccctgagaatcagcacctcctatgagcttctctgtttccagtaacagaaccacagtgtcttggttttatagggcaaatcctcagtgtcatcttcaacacttctcccttctgtcacctctaggtttgaagtggggttctgtaccgtctgctcccatgatgcctcttaagtccacctcttcctttcacttccacagctgtggctttctttaaggctctcctgtagccttttgcattctgatgcccactgggggtcctgccagtcaattcaattccgttctgacactaactactcagagacagcacagaccccacaggtcaagggcagatccttcaattctgacactaactgcctggagttagcatcagacctaaaagttaaagggtgagatcaccaacaagactcctcttatttcagacaccagctgcacgtgaggtccccaggccacccatacttgtgtccagcttgactacaaatttggagcttcccacaacgcccccactgatgtgtgtcacccggcacatcaacgtcttcaccaatcaggaagcttcactgagccatgatgtctgggatttttatagcgtttttgttcagtaggcatgatggcttaaaccactggccacgtgtttgatcccaacctctagcgcctggaggtggaggaagggagtgaggccgaaagctccaaccctctaattatgtgcttggtctcccaggcacggccagccccttccttgaaacccagcgcggactacaggttactgtattagcacaagctcaggtatggtgagaaggggctcgttataaataacaagacactcctgtcactcaggaaattccaagagttttggagctctgtgcctggaactgagtagcaaagaccagatatatttgttatttcatcacaccttcctctgtactcttcagagcctgctacctggtctccctccaactaggtctgttcttttttttgaggcagagtcttattctgttgcccaagctggagtgcagtggcacgattttggcttactccaacctctgcctcccaggctcaagcaattgtcctgcctcagcctgctgagtagctgggactacaggcacctgccaccacgcccagctaatttttgtatttttagtagagacagggctttgccatgttggccaggctggtctcgaactgctgacctcaggtgatttgcccacctcggcctcccaaagtgctgggattacataaggtgtgagccaccacatctggccaactaggtctgttctatatcagctacaagataaatctctcaacattaccactccttcccagaaaaggcagtcgcttcccgtggcctaacagaggaaaggtgaactcttcagcctggcttttgtggccattcaaaaacaaacttcagctgatccagctagagctggcctcatcttctctccttcctgccccatgctgagggggctggcgcctgcttttctttgtttcagcttgtcctgaagcacctgctgccatctgtaccttttcagcccatctgcatttcgaggcccacctgcggtgcctgctccgcctgccgtatctcccgatcctcactgccatctgtgctgccagcattgggctctttctcctttgagaattctttgcacttcattgtactccatgctcagtgctgctcaccgtctgctttataatacaggccacggtgtgcttcgctcagcccctgaaatagatggtagtcactctgggagcaagaactgtttgatttctttttgttgctctggcagtatctggcaagggtcttgtacaagatcttgatcgaatttatggaagtgattagccacactgtagataacgatggctttctgcttgcagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggtacgtagtttgtgagtgggtactctggaggttgagttcctggcccccaaagcccttaagatttgatgcccctcttctggatgtagtgttttgctccctacacagctttcaggtttgctatgccctgcttcagagcagagttctgaattcaggagcagcccctgagagtgggtactcatgagtgaggggtttggccccacacacaggaggcagtggacgcagtttgtgaggccgctcatcaggagtgactgcaaacatttccactgtctttggctgctaggaagccagctacctaatttcttcctatttctacccaaatgcgtcagtccctttgcatggaaatttgtgtttctagtcttacctgttgcttcatgttattttctgaccctcatgttccattttccttgggttttctcacttcttatcctattggacaatattctttgtctaagccatgttaaataaatgaaatatgcagaagtaaacaggcagcccctttatacctcgatttaaacacccagcacgatgccagtgcccttccctggcagtggcctacagatctgtctaagacgaactatatggatcaaggtgcaaatgagataggatctccctgttgtccagaggaggaagttaactgagtcagggcatgagtggaaacttaacagggaaggtactaaagtcagcaaggacttagagtgaggtgcgggagtcaggcctcccatggtgagcacggggagaaatctgtcccctgccccctgctgggaggggctcagctgggctctgccccctgggtgggaacacacagtcaagccattcttacgactggccccaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctctttgcagaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcag

SEQ ID NO: 38294 - DNA, 21183 bp, Homo sapiens
ggagggaggggaggccgagtcctggaagcggagctccgcgctgggactggttccttcgcagccattttctgtccaaccaaacagccgattggagacgggagccaaccagggctgcattggaggtttgtgtctcgcttcggccaatgatcgctcctaaaccgactccactttagctcgaatgaaatgtccgtctcctcccggcgccgtccccgccgccaacgccgccgcggccgggggcactagcctcccgccctcccgcgcgggccgaggccgggccccgcgcctgcgaggccgctcccgcagcgggccgggccggggagcgggcgcggggccgcggcgcggctctttgtgcgccgggctgaggagcggcgggacgcgggccaggccacctcaccctcgccgccgttgagctccgggcccggggccgaggaggggccgcggggctgcgtcggggccccgctctcgacggcgtcccgggccggctccattttgtgcggggagccggccgaggggcgggagacgcggcccgggccctggccccgtagccccggcggcggcgcgagtccccgggggcgccctcctcccgcccgcggggctgtggcggggcccggcgctttgtctgcccgcacatcccgggggccgcgcggcgggtgggaggcaggcgttgggcgcggggccggggcggccgggcgagtcaggggatgcgctctgggggcggcctcctggcactcgcagggctgacaggtcgccgggaccaggccgtggggccggggccacccaggcacctgcgtggggaggaaggcatggctttagcttccccgcagcctggtttgcgcgtaaagaatgcagccatctggcggtttgcggtccctgtacttgccccgaaggtgggaaggaagcccttcggattggactaaggttttaatcattagtggtgggaggcgggaggatatgcagggccttaaagaacggtagtcttagagaacaaagaattacagagcacccacaaatcgtaatctcgcccaaagcactctaacaggataatttaaacaaggttaggtagcctgcgacctttaaaaaaatggcatcccactaacccgcatggaccccatagttgcgtggttcgtgctacaaatcactggggtggtttcatctctcttagtatggaaactaatcagcaacataaagtgatgaaagcaaacggatcaatatcagtggcactaatcagtggggggtttatttgtaaagtattgaaagtttaaccaaaattccttaaaaggcaaattattccttccctgcattgctcttgtatcttaatttaaggattactgtatattgatgcaaaactctggttgttgatgccaaagaatggagggtggaggaagggactactgcttttcttggatacaaatttgcatttcttaaaacattaaacagatgtatgcattcccttgagcttttacatatatcaacctgcccttaagaaaatatacaccatatgaggtgacagtgtttttctttaatgtactgagtctaaatatatactgaatcaactatttgggtgagtgagtgtggtgtggtatgactccctgcccacacccccctctcccattccaagcaaaatacataaatatagctcccatgttttaagtgttctgagggcttattttttcaaagacactctttaaaaaataacatttctcgttacaaggaaggacttttctgagcagttttggggttagaggatactattaatatttgaaaagaaattataaattacttttaatattatagcaaacgtcaagcagtttttgctacctggacctttttagtggcattaaaaactttcaattcagtggctacaattttttctgctatttgctagatttcatgcttggatgcgtatcagtatatcttctccctttaaaattaacactgaaaggatgtgtttttgttttggcatcctacccctcccccatttaattgtttcctttgagaaagaatggagcaaatgagaaatgaaacttgtaacacagcaattggtactaatttgttcagctatttatgccttacagtgagactgaagtgctatttcgatgcaattttagtcaaaaatggtggtgcttcaaaattataaataagggtcttgattgtgttgcttttttgatatcttctcagtgcagaatgtatcttcattacagtataatctgagattcttaattgaaaagcattatattctcagataattttttcctcctcttgagctatagaatgtctaaatgttactctgaaacatttaagaaaaccatcaccaaaaaattaagatgataaggggtgtgtttgcatcttgagtgttaatgttttaagtaatttagatgtataatttttggtctcttgcatattatataatttggtccctttttggtgtattgtaatgaatgtttatgatgaatatggctaaattcagggttatgttggaaaatccattttctcctttccccatggaattaacttgtttttaagttctccaaaataaatctttcaagtcaacaaacatttattgggtgcctttttatactattttataccatgtactccattgattaagaatagtagtcaaaattatacaagccctctttaattttatgagaaaaaaagcctataagtgatacatttgatgtatttttactattgatagatgttaggtcctaatagatgtttatcttttaggttgaaatcacaaagattagacacctttttagataggtgttcttcagcaccactgacaacacggttctgacagtatttcatgacagtaagtatattttaccattttggttgttaattagatttgaatagtaattggctggaaataaaattgtaaccaatttatactggaggtgcctggtagaatgaatgcatttcaagtctagacagacagtacctctgctcattcctgttgcttccttattttcagcttcttgcatatattatttcccatgggtccctaagtgctgttgaggctacagggtagcctgtcccagctgtaaaggggctgtctgtttagccaattaattgaatacttaggggacagttatgcccagaatggaaaatgctaactcttaagtgcagtagatatgggaagaagagaggcatggtgagcctgggtacttgggaatgtcacagagggatcctgcagaccttgaactgagccttgaaatagagggtgggagtggattggtgaagggtgtcaccaaaagcaaaagcctgatggcaggatgggcaacttaagtttaggggatcgggagtagaggtgcatggtccagggtagatctcaaaggataatgtaggaaagagaaagcacttgtcccctctggatatttaattctggatgtgctactatatctgtaacctcgggtgtgttacagcttctttgagctgtggtcgcttcactcctaaaatgaaagaagtgcactcagtgatccctaaataaagcacattctagcacaaagatttttattaaccatgaagatagagaaaagtaggaaacaagtttggttaggttaaatgtgcgatctgctcatgtgaagtcatgaaaatgaggtttggatttgacacaggaagcctttaggaacctttgagaataggttcaagagtatagaactggtgttgtggtgagattagtcttataacaatatgttaagatgggctgggtggtaatccagtggaaataggaaagggaaagcatatctaggagacatttttaaagaggtaatagatgaggtagagcttgaaggagatggaagaacctaagatgatgctggtatatttggctgggcagagtgaagggctggtattcttcttagtagaattacagtagtggaaagggaaatctccctcctttccccgttgcagggaatggggcaaggtgaatttcatttcccaatatcttaaatttgccgtgatgagatattagacatgccctacaggcatgggttgcttgagtggcaagcagaatattggttgtagatttggcatttataagcatagaagtgatatttagtgagttcattaagaaaataagggaagaaagagaaggataaccttgggtgaaacaattagggggtggggaggaaaggatattgctttggaaatcagagtaggagagaattccaagcataaatgtgtggcgagtagtagccagcactacaaagaacagtcaagtaggatgaggacaagatcactggcagcttttaagagtggtttcattctgggttggggttaaaaagtacatgttcaggagtttaaataggaatgaagaggtgtcttaacaactgtcagggcaagaatggtagctaggcaagggtatggggcagaattaagattttatatatctctgtgtacttctgtatgcttaatgagggagactaagcatgtttaaggaagagtgaaggagctggtaaggaggattgaagatacattatagaagaggaatctttgtattatttcttatcctcagatagataaaaggaatgtaacccagaaaacaggtaaaagggtaaattaagagagagaagaatctctgcctggaagaataatgagaaccgtatttgagggggcaatactaagattacatttgttaagttcttactatgtatcttgcactttgctaggtgctttttatacaatagcttcctcatagcaacatcactttaaaaatggggaagctgaaaacacaaagagagctcataaatggggagccaagcttcaaacccacgaaatcggtcctaagagccagtgctcctcaccgtcgtccagggtgcacttcttaaccatctcacaaacaccatcctggtttgagaagctaatttcagtgttttcagtgtataatcagtagccttagaatgtaaaagggacaaattaaagaagtaggtgtaaagactgtatgaaaaactaccaggcaggaatgctgtagagagtagttggcatctgaggccctggatttcagtcccatttactgtgtcacctcaggcaaatcattagcctcatgtacctcagttttctcacctgcgtcacaggcttgtgaacattgcatgagatatttagaaagtgttcaataaatgtaaacattaaagagggcagtatttgtttgtggaacaaattattagcatagtttaaatacggctacatcaaaaaaataaagatttattagcccactacctgtttatttcaaataatattttcaagaataattctgtcaattcaactaaataatgagaatagtcattaaaatgaatttattgggatttaaccactctttgtccatatttatcagttccttgagtctaacgattcatcactgtccgtgtccccttgtcattatcctacatgctgtgctcttccagcctcattacctggatgaaatccaacactttggcttttgtagtctcatatcaggcctttcaagtgtcacactggacatactggcaccactgtaaactcacggtcattagcttcagctaggcttacactgtccagcactcccctccctttcctttcccattctctgcggtgacagctgtctgtctctccagctgcaagaatcccagcattatccttggtcttcctgtatctctatcagtcagtcaccaagtcacctactaaaaagctgtctagttgttctgcttctcttgatctccagcgctctcacccagacctgatgctaaaatgatcattatcttgcttgaagtcatgccctgactgcagcattgcagtcctcactggtcttctgtgcctatttgtgctcccctccaggtcggtttctgtactgaactgtagccagagggatttttttttttaatgtgatttgtgctcttctgcttaaaactctttgatttcctcttgtccaccggacactgcttgatctagcccctccttagcgccttccaatccaccagtactgtatttcttggttttctctgcctagaacattcgtttcccacctttctttttgcctgactgatttctgtttatctgtcagtctcattttcaatgtcatttcctaagatagcctttcttgacccctcagactagtgaggtcccttttggagtaaactcacatagcacataacaaaacatctttgtttttcttcgtacttggcactagcaattacttaattatttgtaattattttaatagctatatataccacttactgagtatgcccattgtactatgctgtctttacatggattagctcctaacctgtacaggagcctgggaggttaagtcttgttctcatccagtttgttcacggtctcatggtaagtggcagggaattcaaactaggtgattcgattccagagcctgtgtcctggaaggactaataggctctgttctctaccccttcaccctgcctcccaggttatgtaacatttgtcctgcaagctgaggacagagaccttgtctgttgttgacagctacgtgaccagcacatagcatgaacctggtaaatactaagcgctcactcagtaaatatttgttggctggcttactgacaatctacagtctgttttataagtttttataggatgttttagacctagaaaaaacctttgggatgcatctagcaagtttttttccatcattcttatatataggcgaatggctggcatattctaagcatcaaagattaggttgacttattgagtgaaaggtactaagtgccatagagctttaaagaacagaacatttgtttttgaattgcagaaaggataaatcagaaagattaaaggaggatagagaacactgggattaaagtctggggcaggattttaatggtagaaagacagaggaaaggaagacagaaggcgtgaaatgatagaaagctaaaacttgcagaactgaagacacatacagttaagcagatgatgtgcggcttctcttcaaaggagggaggatgagatcgaatgtctgtggggtacactacgtgccaaacactgtctttagcagctttctagtctttatttaattctgacaactctaggaaatacttttatcttcacttttagaagactgaggtttagcgaggctaatgctgttagtccaaatgataatcatgttgctaattccagtgcatgacaagataatatgatttaaacttttttcctttaatacttttgtttgtgttatatttctaaattaattcatctcccagatccgcctggttatttgaacagtgtcttgctcatagccaattttaaaagacttaatggtatcatgtaaacactcattcaggaaagaatttctgttattcttcccaacccaccgcctgccctccccacccccaaccaaagtttgtttccaattgtaggctctgaaacaaccactttggtcctgtctcctgcaccttgatcttccttaggttattgtaaaagctagtcaactcacaggtatcataattgatcattcttttatggctgtaaaaaaaaatccatcatgtctattaaaggatactctcctagtatgttagcattttaagatcaaaatagcatttgatttttgggcactgtttcacatttatttgtgttagtttaagatggggagggtggtattgttatttacattttatatggaaatacatttaattggcagggatgcttattttcaggggatcagtaggagagtcagaatcaggtcactgactttgttgtttacttcttagaggctactaaaagtatcaaataggtaccctatgttcacagattattaaaggtctgtaaattctattttctacccccttacaacaactatataaattatagaaatgtgtctctatctacagttatattaggcatcacagtcaacagatgcatgaaagaaatgccgtgttattgaagacctggaaactagcccagtattttaatattaaataaaaattcaacagagatggagaagacatgtgttatacaaggactaaaattttgcaattaataacattaagtttatactgggtcctgggccttaatgaagggtcaaatttctttgttcagcctgaaagtatgtatgaattacacttgatttttgctatactttttattcagataatgcatttaacattttttcactcacagatatcttattttgagtagtagtatttgcaaaacagaaagccttctaggatctgccatgttggtgaaattgaatggagccagctcagggcttatgatttacttttttccagactttccctcttggaattcttttagctctcagcaaaattaattaagcaggctttttttaaaataggaattttaactcttattcttgtctgtgcaggtaattttcctatctttatacatagatcttcctgacccctcctcctgaccccactctgtcactgaggctggagtgcagtggtgtgatcacagctcactgcagcctcaacctcctaggctcaagtgatcttcccacctcagcctctcaagtagttaggactacaggcacatgccacaacgcctggctaatttcttaatttttgtttttttttagagacagggtctcactgtgttgcccaggctgatcttgaacttctgggcccaagtgatcctcccaccttggcttcccaaagttctgggattacaggcatgagccacacctggccctgatttggcagggggagagaaaattaacctttgactagaatcaggagtttatgggttcattcaaaacatgggtgtacttttggcttgcctgggtacagaattgtgcagagaatccgcatgcttcttataccaagtaacagtttgaacggagacattgtctattttggaacttctatgagaaagcaaagaaagttcgcaagcaggagcaaaaggaaaatcagggtttagcaggagagctggaagtgatggatacaggtgaattccagttgatgacttaagctgatttttttttttaagagacaggttctcactacattgaccaggctggtctggaactcttgagctcaagcagtcctcctgcttcagcttctgagcagttggggctacaggtacatgacactgtgtacagctttactaagctgatcatcattccagggataaattaggttgtaagtcagggttgcctgtggtactatatttgaagattatgcacttaaaaagaaagaggcatatgctttagattcatttccttgtcgctattggccttatgcttatatcacttatggaagatggatagggaaatcttgaatcgtggacaaattgtgggaaagtttccaaatcaagaaatataggctggttgcggtggctgatgcctgtaatctcagcattttgggaggctgaggtaggtggtttgtttgagcccaggagttccagaccagcctgggcaacatagcaaaaccctgtctctgctaaaaatacaaaaaaattggccaggcatggtggtgcatgcctgtagtccagctactcaggaggctgaggtgggaggattgcttcagcctgggaggtggattctgcagtgagctgtgatcacgccactgcactccagcctgggccacagagtaagaccctgtctcaaaaaaataattaattttttaaaaaagaaatataaattctcttttagtaagcttaaggctatgaaaagtataattgatgcatcatcctgtgacagtttataagtgttgaatctgttacgtttgttagtactttgaaaagtattgaaaaactgtttttctcctcatagatggatggtgacagttctacaacagatgcttctcaactaggaatctctgcagactatattggaggaagtcattatgttatacagcctcatgatggtaagcaagccacaattagaaccaaattctcaagttgaagcaagttagaaagtggacatttcattaatatggtgttctaggctacttgtgtctttataggaaaatttacaatcttgtgttacggttcaatgagaaagtctaaaaaggcgtaccatgctatttttattagaaatagtcttcaaaagaatgagtccttgaaaagacttttactataaaaatacaccttgtctaaaatctgtacagtttcttttaaaatttgttatcgacttcctgtttaaatgttaaataagaaatttataatcaattgatagggtaactaaaataattatttagagggtgagttaaatttctagctattatatttcttgcacttatgatttatttttggttttcattcaatattaactttgaactatgtcaggtattagaatggtagtgttggctcagtgtggtgctcacacctataatcccagcagtttgggagggcaaggtgggcagatcacttgagctcaggagttcgagaccagcctgggcaacatggtgaaaccccacctctacaaaaaaattaaaaaattagctgtgcttggtggcatgtacctgtagtcccagctacttagggggctgggggctgaggtgggaggattgcttgaatctgggaggtagaggcttcagtgagccatgtttgcaccactgcacactccagcctgggtgacaaagtgcaaagtgagaccctgtctccaaaaaaaaaaaaaaaaaaaaaggcagtgttatgttggcctatcagaaataatttacttttgtggcattttggtttgtaaaaaaaattttttttttttttttattttttattttttttgagatggagtcttgctctgtcgcccaggctggagtgcagtggcacaatcttggctcactgcaacctccgcctcctgggttcaagcaattctcctgcctcagcctgcccgttagctgagatcacaggcgcccagcaccatgcccagctaatttttttttagtagagacagggtttcgctgtgttggtcaggctggtctcaaactcgtgacctcagatgatctgcctgcttcagcctcccaaagtgctgggattatagtcatgagccaccacgcctggcctgatttgtaaaatttttaaaaattgagatatatttttagaagaaacttgccagagggattaatttcatcctgaaacggatattcaaataaattaattctgataacatcattttaaacacataaaaacgtaaattgaatcaacttaagtgccttgcctccttacttagtacatatgaagagtgggcagtttacttacaggatactgcatttagtcataaaaggatgttattggtactgcgcaagcttcagttatagctaaatttatataatttgaaaagtccctttttgtatgaacagttggatcactgctctagctttgttcaaaaactagttacattagtaagccaactggatcagtaataatcaagtccagtttttccattctttaaagaattttatataaactttatacagacaagacaactttatatcaactttaaaagttttatatagacttttacataaatgagtttatataaacttgggtttggagaaacatacaacctcttaatctagcagtattgaaggagccataggttacggtctgtaagttttatagctaagtcgtataataaatatttatgagtacctactctgtggaaggtgctgtaccaagctgtaggaaacacaaagctgattcgtgacattaagtagcaaaaatctaataggagaaatgaggaataataaaaattctaaaaatgtgtaagagaaaaggcatagagaagcacttacattttatgaaagaaaagatcatttttgaaggtggtatggagatgttatttgagatttttggagaatgggcaagtaggattttagcaggtatatttgaggataaaaagtgttctaggcagtgagtctgaaattaataaaaaaaaagttcagttctggctctgtaaaaattatgaagagacttgctatcctaatccctaaataatggttaagaggtgaaccagaatgattttattctggatcactttggtagttttttctatcttgaaatagaaataataagaagctttacacctaaatatttttatttctttagatactgaggacagcatgaatgatcatgaagacacaaatggttcaaaagaaagtttcagagaacaagatatatatcttccaatagcaaacgtggctaggataatgaaaaatgccatacctcaaacgggaaaggtaacgtagaggagaaatttaactaggttttttcaagggaaacacgaaactacatgaattcataggtcatgggtacagttagctgttgatttcaatcattcaggctttcagcaaatcaaatatttctttcatgtctacatacacagttactgaacagtgtcccattttcaattctgtcatgtccctaaatgttctcctctctcccacttattggaggcagataaaatagaatttagactgttttttttttttttttttttttttggggacagagtttcactcttattggccaggctggagtgcaatggtacaatctccgctcactgcaacctccgcctcccaggttcaagcaattctcctgcctcagcctcccgagtagctgggattacaggcgtgcaccaccatgcccagctaattttgtatttttggtagaaatggggtttctccatgttggtcaggctggtcttgaactctcgacctcaggtgatccatccgccttggcctaccaaagtgctgggattatagacatgagccactgtgcctggcccgactgttttaaaaaataggtacgttgtcagaactatcaggtttgggtgtatgaagctgtaacttttttttttttttttgagacggagtttcgctcttgttgcccaggctggagtgcagtggcgtgatctcggctcattgcaacctccacctcccaggttcaagcgattctcctgcctcagcctcccctggtagctgggattacaggcacgagccactgtgcccggcctgaagctgtaacttctcccatccaagtactaaccaggcccgaccctgcttagcttccgagatcagacgagatcgggcgcgttcagggtggtatggccgtagactgaagctgtaacttctataatgttgcagtaaatttaggtcgtattggtctgatataggtgtaataagaattttccaaaacaaatcctggtatttggaaacagctatttttacataattatagatactaagatacatttaaattgatatttttttttcttaagtagttttgtcttcttagaacttttaaaactcattgtcattgctcatcacttggtctgaattaaaattcacacgttttatatcattttctattggtaatttttctgtcattttatagtttaaaaagacttatggaagtaataaagcttacaaataaatatgctattaaaatacatcactaagcttagaacttacagtttgagaattttgtccttatgttttaaggaaaaaaaagcacaaatgctgattattgcttacataggctatgtatgaccagctatgccgctggtcagtaccatagccacaagccatgtgctcaggagcacctgaaatgtggctggtctgaatggagatgtgttgtaaatttgaaacaccagattttgaagacttagtatgaagaaaagaattaaaatttctcatttaaaaattgattctatgtttaaatggtaagaatttggctatattgggttaaattaaatatattaaaattaattttattttattttatatggctactagagaatctaaactgacatatgtggctcacattatattatcttgcttgactgcatttatgcagttcttgtttactttctccagtatggaaaataggcatggcggtgaaagacagtgtgtttcggcagggagtttgagtggtattgctgttacaagtggctttgcaattgcttgattaatccattggagtttcatttttagaccccagacccttaagggaaaaattgtttttataatgaagtggcagatgtgtgcttctttaggcaggctttttagtaaactcaaaacctgtatctgacactgtgtatcccaaataataaaaaagtcaaagtcaccgtatgttatcatttctctcttttccaagccttatgtgaattcagttttttagttcctgttttgctttttgttttctggtgtctttattcatggaaatgctagggcagagaagtggtacttatgtcgcccacaaaatatgcatggtggaatggattttccaggggcactgggttattaagagttttcatcctctgtggggtggtaggaacatccagtgattgctgttttatatctttttaaaatttttttaattttttttttgagacggagtctcgctctttttgcccaggcctggagtacagtggctcaatctcggctcactgcaacctccgcctcctgggttcaagcaattctcctgcctcatcctcctgagtagcagcaattacaggcacctgccaccacgcccagctaattttttgtacttttagtagagatggggtttcgccatgttggccaggctggtcttgaactcctgacctcaggtcatccgcccgcctcggcctcccaaagtgctgggattacaggcatgagtcaccctgccaggcactcttttacatctaaattagatttgtttctgtaaatagttgtcaaggcttctctcacttgtatttgagcttttattctgactctgaggtgtggacttttgatagcacacattgtgttaatgttataacatatatttaagagattaaatagtcataaagtgaagatgtgttcttctgaataggctttcatttttgtaggttgttaggaaggtgatggttatagtttctgtaatttacctatgattttctcttcagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggtaaataaaatatctcccattgtgcttttttttttcttctttttttttttgaggtggagtatcgctctgttgcccaggctggagtacagtggcaagatctcggctcactgcaacctctgcctcctgggttcaagcaactctcctgcctcagcctcctgagtagctgggattacaggcgtgcaccaccatgcctggctaagttttgtatttttagtagagacgggggttacaccatgttggccaggctggtctcaaactcctgacctcaggtgatccacctgcctcggcctcccaaagtgctgggattacaggtgtgagccaccatgcccggcccccattgtgcttttaagaaaataagagacattatttattttaactttgtaaatgtattacttgttttaaaaattcattttgtagtaaattatgtaacatttctcagaagtatttaattgcttatatcagcagtcctcaacatttttggcaccagggacctgttttgtggaaagcaatttttccacgctctggggtcaggggaggggtgcgaggggtagatggcttcaggatgaaactgttccacctcagatcatcaggcattagttagattctcataaggaacgcacagcctagatcccttgcatgcgcagttcacaatagggttccagcgcctatgagaatctcacgtggccgctgatctgaccgaaggcggagctcaggtggtaatgctggattaccagaccctcacctcctgctgtgtggctgggttcttaacaggccacggacactcatcagtctgcagcctgggggttggggatcactgacttatattacagtacttaaatagaaagtcctttctttttccctttgtttattactaactatagcatagttatataatgatttaagggcacagactttgtattcagactaccaggaggctgaatcccagctctgccacatgcaaattctgtggccttggacagattatttaattactttaggccttggtttcctcatctgtaaaatgaggctaatagtacctatatcatagaattatggatggtactaaataatgttcagtgctcattaatgttacttcttgctgctattgttaatttcaaagaagtagcattaaaagtagtaaggttggagtcttttagataataaaaagaggaaggtataatcatatgtcttattattgattgaattcttctatatttcttaggtttatctttgcctgtaggaatggattttgtgaaaagcagttgagttcagcatatttatttccacatgccagcttaggtgtcagattcacattactttcaaaatatattcttaatatctttagtgtttgaatcccattaaattagtgatatttgcatggaataattgaagtaggaaaagaatgtgtaaattcctgacattatttttacagatcttcagtatcataggaacctagaagtatttggccaaattaatttaggaatttttaactctcagcttgctacagtactgcccagttggctgagagacatatatatacttaagtgatcacttggatcatttgtagatttataagctcaatattggtggtgttttgcagacttcttcatctgtaagtagagttacccctttgatatgatgtggaattagaataatttatttttatctgtaaatactttgctttctaggtcattactaactctgtcttgttaatgattacagcttatattaaaagttagccttctgaaagccttcttcatatgtaattaaccagaagtgttaataaatactctgcttagagtttgtaataatagaagctcctaattttaggcaataagtaagcatttgcatttggaagacaatttcatttgaatatcagtgactttttttttttccttcctcaggctatgaaaggagaaaagggaattggtggagcagtcacagctacagatggactaagtgaagagcttacagaggaggcatttagtaagcattgttataatacaagtcatgtagattgttagcaatgattcatactaagtatctaatggtatttttggaatgtcagcagtgagtattttgacaaagcactattttaaatagttcttatcagttcatgcccttttatttgaagtcagtgagtgataagtgtagaaaagtttaattctgtagacattataacctttcactgatagttctgactgagttctgtagcccctagtttttggtgaagattcatatgagataggaatattaaggaaaagtttgtaatataaaatcttatgatttaaataaatttcaactcagttttttttaaattgagtatcatgttgtcatattggtgaaataaaagggctatgttgagtaaatttctcattatatatatttctcatatgtaaactatatgctgctcagttatatgttgctcctagccaaacctcatggtgtagtgtagtttaatcatgaatcagaaacttcatccagtctgtctacagatttgtacacatgggcagttagctaaggtacatgttagagataggaaaattgaaaaacgcaatataaaataatgtggtttttagggaacattttttaaaatggaaaattggaggatttattattttgtccaagactacatcattgataccgggcagaattgtaatgagacattaatggtacaaccttaagatacaacccaagaaagtagatatagttcatttccctctttaactaattttttttcttttagctaaccagttaccagctggcttaataaccacagacggtcaacaacaaaatgttatggtttacacaacatcatatcaacaggtacagtcctttgtattttaaatgcttaaaaaatttgattgtatcgacagggccccatggctcatgcctgtaatcccagcaccttgggaggccgaggtgggtggatcacctgaggtcaggagttcaagaccagcctggccaacatggtgaaaccctgtctctactaaaaatacaaaaattagctgggcgtcatggcgtgtacctgtaatcccctctgcttggaggctgaggcaggagaatcacttgaaccctggaggtggaggttgcagtgagctgagatcacaccactgcactccagcctgggcaatagagtgagactctgtctcaaaaaaaaaattttttttttattatatctattgatatagttaatttcaacatgctattaaggacctgataaagaaggttattaaaattgtgttttctcaatgtagataacagtatatagtgttctcttaatagttaaaaataagcatatgttcatatttgcataggagatttctagaaagatacacaagaaatgggaattagacttgttattgtctttttattcactgaatttttataatatgcatatggtacttttaatctccttttctttaattctgctcaatttaaattttctaatcttagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgt

SEQ ID NO: 38295 - DNA, 3328 bp, Homo sapiens
cacctcgactgcgaattactgtttatgaggtgactcgctggttctatcggtggacagtgggacattctgaagggaggcaaggaggcggactgagcgctcccaattggggtgagcccgcccgagcggagagtggacggcgggtgtccagggggcggggctttcggctgtggggttcggtcgtagggcgggaactccccaactggggtgcgctggcgctcggagggggcggggccacaggccgcgaggctgccgggagccgatgacgcccgaacgccgaacctattgcgtccgggaggaggcggggctacggattcggccgagccgagaacacccgaacgtcaaattgctggcgttcgggaagggggcggggctgcggattcggtggagccgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggtaggtacggcagtgcgggcacagagcgggtgccgaccgcagggtcacaagggtagagcgggaccctgggggcttggcgaggggcgagggtcgggggcttgtctccggcgtctcgtctccggcggccgcgaggcctggtgggatcgcccgggggcggggcctggcgctcgggcccagcaggtggtgaacggcggctgagcgaggccccgccccctgaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggtaagggggcggggctcgaactcgggttcggtgggagcgggacctgggagtcaagtttcctggcttctgaagggaccataagcttggaggttccagcgaagtgtgcttctcaggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggtgagcatgggaggtggagtccagggaccacgggaaggagaggagagatcttttaggaattttagctgggaatccagtgcctgggtctccctgagggtgagaagactttaccccttgaatttaccaaactcttctctgtactccccaccaggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgagtatgggttggggcctctggttgctgtgcctttccatacgatcccaatgtattctgcgtttttcttttttttttttttgtcttaatagaggtggggtctcttgttgcttaggctggtccctattcctgggctcaagcaatccttccacctcggccccccaaagtgctggaattataggcccagctgcatttttcttttttgtctcactttctcttagcctctgaaattcatagacagacaggaaacatttgggagctcctgaactcattgggcaagcagtttaacgacttttattaaatgattactgtgatccagaagattcacttagaagtagttagacatcaggctgggcgcaatggctcacgcctgtaatcccaacactttgggaggccaagacaggtggatcacctgaggtcaggagtttgataccagtctggccaacatggtgaaaccccatctctactaaaaatactaaaactaactgggcgtggtggtgggtgcctgtatttccagctactcgggaggctgaagcaggagaatcatgtgaacccagggggcagaggttgtagtgagccaagatcgtgccattgcactccagcctgggggacaagagcgagactttgtctcaaaaaaaaaaaaaaaaaaaagcctagaagtggaatagttgtgtccaagagcatctgttttagagtatctatagtgatggctgaaatgatctcagatctcctcccagtggtcgttcccgtggcgtccagccgtctgccattggtcactgcttcagtgcctctctccttcccccaggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 38296 - DNA, 14885 bp, Homo sapiens
gcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctaggtaaaaggcggccggtggtcatggcgggtttggggcgggcagaggtccgggctttggctgcaccgctgcaggccggggacgcggggctgagagggcgccttgagggcatcaggagggtgagacccacccagtctacaccccaccctctctcctgaagcagcggcagcagctgggcgttaagggggatgccgggcaacccccggagttaacgtcctggtccttggggcgcagattgctcttcgtcatctgccctgttacgcttgagcgcgctgttcctcgccttccgctgttctcactgcaaagactcagggtcttgacaccaactttcagcctcccgtgtttgcgtgcgggcgctgggataccaaggtagtgagatagcacctgagtcccagtcagagtaaggactgcaaagaaaagttgacagttgacagtgcctggctctcagtggatccctaacaacagcaatagtaaccattatgataaaagtcagttccaggtgaatgaggtgtttcgtcacagacttctgtgaatttccccaccccagccatgcacatatactgattcccaaggcgtaatttttgttgtttttctctgtctattccacagtcttctggaagttaatccggagcagaaggagcagtcagagagctgttcttcttgttggcctttgtgattccgggaaaacgttgctctttgtcagggtaaatgatttcattgacacccctgttaagcttaatagaaaattttatagatcccagtattcctgtcatctcacggtttattttgtaaaagaagctgatgctgttaaatttggaagttaattcttgacttacttgggagaacaaaaagactcgtagaaacccataattgagaaatattggtcatttctccttttttttttctgtttgcccttgccagatgctgatatttagtctttatcacattcaaggattttatttaattagtttcattccagaatagcagaaggcatagaagctagtgtcctacagtttataattccttcgttaacaaattcttaggacagtttatcgaagacactttttcacagggtgatccttctttgacatagtgggctagttaggcttctttttactaatatttatttttaatacatttagtatttttaacagtgtattttaatgtggtgaataggagaggttttctgctttttaactcttctttttgagagtataaattatttcccttccattaaagaaatacctccattttttttttttttttttttttgagggagtgtctcactccaatgcccaggctggagtgcagtggcgagatctctgctcattgcagccttgacctctgggactcagatgattctcccacctcagcctccgagtagctgggactacaggcgtgcaacactacgcccggctgattttttatattttttgtagagatgagattttgccatgttgcccaggcttcaaatcatttttgttggttaaaaatctttacagaagcttggcaaatttggccactaactgtcttttgagaataatgttgtttttattccactgaggagtaaaatatgcaattaattagatttttttctacaggtaaaaaaaatcaatatcgtctttttcacctgtcggaagcagcattcatttacttaaccttacacctgggagacttagaataatataactcaatttaggtgtgctattaaaatgttgaatatcacccatcttgttttttttacagttgttaacaggcctttatagagacactcagacgtccattactgacagctgtgctgtatacagagtcaacaataacagggtaagatgtttgtggagttttggagtctgacagtcttactttactgtggtgtgtcagttaaggacatttttaggatgagttcatctgaggatgtaagtaccatttgtagcttatttttatggagaaacatattctttgtgacaaattctcttgacaatctgtacagtagatttaatcatgccctcctctgcattgttgtaccttaatgtacagtaatgttatatcacattttattcttattttttgtttctgtgtcttctttccaactttacaatgagttcttaagagtgggcattaaaccttttaagttttgaataggtaatacatgcacatgggacaaaaattcaaaaggttagaaaagatatttggtgaaaagtaatttttcctttcctttccccactacctagttttctcctcagaagcagtgacttacttttttttgtatgtagtcttccggatgttctgtgcatatacaaacatgtctgtatatcctttattgttgtttttttttaaatgctgttctgcccattatttttctcatacggctgatacaacttgggcttttcttattgtcctacatttgtatacatagtaccatctggttggtttatgagctgcatagtactccactctgttgctataccataaaattaaattcttacttaatctggaccgtgttaatagacatttagttttgttattataacctttgcttttacaaacagtgctgcaatggatatcttacagagtatatatgagtgtatttcaaatataaggaatcatggggcctggcttggtggctcacgcctgtaatcccagcactttgggagaccaaggtaggccgatcacttgaggtcaggagttcaagaccagcctggccaacatgatgaaatcctgtctctactaaaaatacaaaaattagccgggtgtggtggtgggcgcctgtaacccagctactcgggaggctgaggcatgagaatcattttaacccgggaggtggaggtggcagtgagccaagattgcgccactgcactccagcctgggcaatagagcgagactaagtctcaaaaaaaaaaaaaaaatataaggaatcatgggaaagacattttacatacctctgtaacttcagaatgtagacagtgactaccaaaccgattgtaatgcataagtttgtttgtttgtttttgagacaggagtctcactctgttgcccaggctggagtgcagtggcatgatcttggctcactgcaacctctgcctcccgagttgaagcgattctcctgcctcagcctcctgagtagctgggattacaggcgcccaccaccatgcctggctaatttttgtatttttagtagagatggggtttcaccatgttggccaggctggtcttgaactcctgacctcaagtgatccgcccacctcagcttcccaaattgctgggattacaggcgtgagccactgcacccagccatgtaataagtttcggtgagtgagtggagtgagggctcgttggaggatgtggatggatagatggatgaattagaattgtggtttgagaccttttcttcttctctttgtcttctttcccctttctcatgcctccagaattaaagattgtaaagaaaaataaagggacatgtttttaaatatcttagcgatatctttgttttttttttcaatgatgacactctttgtggcccagacctttttaaactcccaaggattcagattttgaaattccaggtttgcaagatcatctagtacctgcactagatttttaacttaggatactccaggatatgctttaaatctgtaccttctaatatgtagccactggccacatgtgactgttgagcacctaaactaggactagtccaaattgaggcatgctgtaagtgtgaagtacacaccagatcttgaagacttagtatggaaaaaaagaacgtaaagtatcattaataatttctttttttattacattttaaaagataatattttggatatattagattaaataacttaaaattaattttaccaatttctttttacttttttattatggttactggaatatttaaaattacatatgtggcttctgttattctatatttctactatatttctattctatcaatatttctactgaatatatagagcatttttcccttccctcttcactctttctcctacccccttacgttttcgatctaatctctttagatagtaatatacctagtaatgtatcttccaaattgcttagggtgtgtggtatagtgctgcttttgaaatggagcagttaagtcccaacctgggatctccagactcttaacagtacttaaaaaaaaaagagagggactaataaaaaacatatttgtctataaagaaatgcacaggctatgtgaaaggtaaggtcataataaacccagctggaattgtgttaaatctgtgcaggatactgattgcctgcttctgaactgtgggtatggttggctgtggataatgtagaacatgtaagaaatgatggtctgctgcatgtaccaggccacatctaagagtcttattgttgagcacagccacgtttacactgaatataaactttattcaccattccaggccttgaccttatattcaggaatggcagcctggcatggtgaatagaacttattagggtgcatcgtagatttgctcagtaggggctcaggaattgacacaaatgctgacggagttggaacaagtaaattatatgtctggaagataaatatttaaataattagattaagggtggaaatgataaaagtgtactttgttataaagattggagatcccagtaagagtaatatgctctatgaaaaattgtaagttcttatattacattattagtttatgagtacttgttactgttttcacatttttgcttatactcatacagtactcctactttgctatactcacactggtttatctcccaagcctcaggtagatcatgcttccctgactcccccagacaggtttttcctgtaccctcaaaacatttatcagtgttctcattttatatttatgtgtaattttacattatgttcacctttctcataaattttgccagatcaggaaccgtgtctttggccactgttacatccccagaacgttgactagtgttttatgagtagaagatgctttgtgaacatttgtttggttaattaggtaccagtttggtagccaatatatgatactaaaggtttatattgtgaacgtggaactgtattgaaacgttaatgttattgctgccatccccagggcaatagtctgaccttgattgaccttcccggccatgagagtttgaggcttcagttcttagagcggtttaagtcttcagccaggtaagaaggaaagaagtgaagtgggcttgtctaggtctgtatctgtatatcaaagccactcatgtgatttgctctggtggtgtttgggaggcagcatggtatcctgtggtagaccttgaggtgaccttggggtcagccagttctgggttgcaagtccaccttcacctggatgatgaggattttatgggattaaaatgcttaaaaagtgttttttagtgtttaggaaatgttaacccttcttgtcattgttactaaatgtttgcatttattctgaaggtgaatttaataatgtatatgactattaaaatctgaaaaaagaattttaaagctgggatgaatcctagcagtttttaaatgccaacatcatttatatatatagtgtttttttgttttttttttttgagatggagtctcactctgttgtcctggctggagtgcagtggtgtgatctcggctcactgcaacctccacctcctgggttcaagtgattctcctgcctcagcctcctgagtagctgggattacaggcacgcaccaccacaccctgctaatttttcataattttagtagagatggggtttcaccatgttggccaggcttgtctcgaactcctgacctcatgatccgctggcctcagcctcccaaagtgctggaattacaggcgtgagccactgcacctggcccatatatattctcaaattacgtaaaattgatgtttcaagaagtacagaacaatatttccatatttcttttagtgtgtgctctggtgttactgactcttaagttcttccctaaaaagtcttatgctgcagtttcagatgcttcttttttggtctctaacattaataagaactgaagaggaaaatcagtatgccacatttcactgatttgaagacacattttaatatctctgaatttagaatatatcttatagttgatggtgtcatagtttaattggcagtattttctcttagcggtccctaaaataatgtctttaattggcagcattttagttttgatggaatgaagtagtagattctttgccttttattgaagatgtctagactgaaatttcattattgcatctttgcccacaagatggtggtgatgaacaatttgtcacagataagaaaattccttggacaattgagacaaatctagagctggtaaattttgccataattgggtttttatttccaattaaatgttttttctttttctattgccagttctaaatattttatgatttgcagtataactactctgtgattcatgtattttgggtaaataaaacatgcaaaatatgaagataaaacttagttcaaataaattataatcatgataacatgcaagttgaaaagacatttactatattggtatgtgacttttttttaatcctactttctggcttcgccaagtttccctagtggctattttccctctcctgatttgaacatatgctgttgctgttcttatcatggttcccctcccccatcttttaaacattgcctatttgattgtctgaatccaataatatcagtttccttttcctgaaccttaaacactttaactttcatcttcctcacatcttccttttatttatgctcctttttaacccccatccatacttttttttcctcttacattcagtgatgagaattaccaggatgcttatggtcttttgctccccattgcttcttgaattttacttcttccctttagattcagttttccctcactgagtatatcttttagaagtgtttccagagagggtgatgagtagtcaaatgttttcagtctttgttcatttgtaactctatttggccagcattttggaatgtctcttttagctgagtgcagagtcctgggtggcagccgcatcactcctgacctcatccatctgttgcagatgagaatgtttttgccagtcagtctaattgtcatttcactgtagtaagtctgcctgatttgaccttctatccagggatagattttcttctgttcaaggatggatttagctttatcattcttggaattcagttgtgctattccaaaccaaagattctcctcagttttggaaaattctcaccatcgtttctccaggtagtgctgtttccccatgatcatttctcacactctggaattcttatgaatgttattgaaccttattatttttgcctttcttgtttcctctctatcgtatcttccagatctttctacttcgcatattgtaagattccctcagatttgttttctagtttattacattattttcagctgagcatgatctctgcttaacttttccattgatttattaatatcatttactatatttgtctaaaatacttaccttttcaaaccagcctgtttctttttatactattctattttttattgtagtttgtagtattttcttaaataattttaaacatttactttatagatagctttattatcttagttttggggtgctgattattctctttggggtaccagttattctccctcataattattttattctgtgccttgtaatttttgctccagaacctttcttcaagagtgacacatcattgatattgtggtggttctttaatcccgtaggatatgaaagccttgctccataagcggttcatagttccttctgttggggccatagggcttcaataagtctggcccaatttttatgtaagcctttccccttgggggtcttacacctggagagagtataaattcataccctatatctgtgtgaggcagtggaggcccgctgtttctaagggaactttttttgcaagccccgacctccctgagactattttaagttgtaggctttgtgcagggcattcagttctagctccccagctgcatgttggccattgcatgtctcttatctccacctgggcattcaaacccttgtccataaggcttgtatttttttttttttttttgagacggagtctcgctctgttgcccaggctggagtgcagtggcgcgatcttggctcgctgcaagctctgcctcccaggtttacgccattctcctgcctcagtcccctgagtagctgggacaacaggcacccgccatcacaccaagctaattttttgtatttttaggagagacagggtttcgccgtgttagccaggatggtctcgatctcctgacctcgtgatccgcccgcctcggcttcccaaagtgctgggattacaggcgtgagccaccgcgcctggccggtttttttgtttttttgttttctttgagatggagtttcgctttgtcacccaggctggagtgcagtggcatgatctcagttcactgcaaccttcgccttctgggttcaagtaactcttctgcctcagactctcaagtagctgggattacaggctcccgccaccatatctggctaattgttatatttttagtagagattgggtttcatcatgttgcccagacttgtctcgaactcctgacctcaagtgatctgcctgtctcggccccccaaagtgctgggattacaggcgtgagccaccgcacccggccccctaagacctgttgtctgcagtttccctgggctgctgcactttagctttgatatctctttgtttctgtcacatgaggagtcccactatggctgccttagttcaggccctacctggtcactgtgcttctagttcaagcgccctctaagattgctttgtcttccatttaggcaccaatattcttcataagacagaaaagcatgaactccacaggtcattgtgtcacgcctcactgtctgacttggttctccttcatttccccatctccctgtgtaccagcttaccttgacttccccagggaatgtgtttcacgtatttgtggcttgaacatactgtaggctgagtatcccttatccaaaatgcttggaaccagaagtgttttggattttagactttggatttttggattggggatactcaacctgtactttccagacagcctgtgccccaatttttggtctagctaagattcaactcaactgttacattctccttaaagttgcctttgacctggtctcatttaaatgatctttctctttattcctgttacacatgtgcatagttttgtcttggcatttatcatatggttctctatatgatgatttgtcttggaggacaggcatcatttcttactgtcttttttcagcttcagtcattgatacacagtagcactcaatagttccttgttaaatgaggatttatgttatatgataacatatgcacagacctgcatgtgtgtctgctgagtgttaatcaccaagattgactttgaagaagttcaggatagtttttcaagataatgatgtcctgttacacgttcacatgccagtttttcttgttttctccctccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaaggtgccatcatgttttcttgcaataataattgagttttttggggattgctgctactaagaattatttccattatttacagttgttattattgaggatgagatacaattgctgtaaagaactataaattgaaggatttttaatcttaaaatttatttctactcctaccttttcaccagtcttctaaccagaagaccaaggaatgataaccaagtgactgctaactgatttttctttgatacagtgttttttctgattataaattattttactttaccaagttaagttcatcagattgacaatatgtgatatcagatgcacagttttgcagggtggagtttctgctttcaaacaagtttactgtacagcacattttatcaagggaagtttgctgaagttgttttcttttaacctgataaccattgaaaacttttctagtaatccccaataaaactgggcttcagttccgttacctgtacaataagacagactagtggatctcttcaggtctcttccagatctgaaattctgattctatgaagagttcaaggcatttctcagaagtgaccagataatattgataatgccttattgggaatgcaattagcgtcattacctgacctctttatttccctgattgaatataaggaagggagttattgtttatttgccatgggctttgtgccaaaccagagcttgtttcttacctttagtacacttaatgctttaaacataccgtcttaggatcaattggaaacatgctaagtttactttaaaatgacagatagggcactgtcttttggcatgtgaaggcacttctcataatcacagcactggtaggttttctttctgttaaactgagtaaacttatatgttttgaattgaaaggtctataaggtgtggagaactttagggaaagctaaagtcagttttagggtcaccagcataatatgtttataagcattatcttgggaaagcccctagtgcaagtataaagcttactttgatagagaaggaactagtgataaaaggtctttttttaaaaaaagagaaaaacttactggtttaaataggaattttccttctgtgtaagaagtcttggggaaaaaactcattctcgtttaaactacaacagtgtctttatttctttacagatattgcaatggcaaaatcagcaaagttaattcaacagcagctggagaaagaactgtaagtgtgaaagaggcctgttggttaattatatatcttaacacttagactgtaagcagcatattcatgtttcttttgtttggttttatgtgattatcacaattatagactgaagattagtgtgataaatatttgttaaataatttacaaaataatggaatcacaaaaacttactagggtgcttatagatattttaaaatttcatggaaagaagatttttttgaaaccataaacttaatttattttaccattgttactaaatcatttatagttgaaaggttttagaagctaaaaaagtttacatgccaacttgagaacggtgttatttcagtgagtggaagtgtttgttcaccactcaataatgcctgtgaagtggtatttaaggatgcatgtaaataataaaaaataaaaactgagaatcaggaaaaaagaaattaaaacatttaaaagccactttggaaattattgttgacagaataagaacagaacactgaggaagactacaagtctttgatactacattatagcttcttagattgttaaaatacttggcaatattatatatcctgctttgagtgtttcaaggtttgtaaattgagctataagcttttgaattttaaggcatctagcatgtcttctgcgttatgccaatttgtaagagctagccaaaagctggtgtagaagaaatgatcaacatttatagtaaagcaagttatgttttcttattgcttttgtgtaaggccttgaaaaggatctgatgaggaaaaactgtataaattcaacttttagaaacttttctccccactatgacttactgactcccttattcatttaagaagcacctgtagtgcatctagtggatgccaagactgcagttgggagcagctgtaggaggaaatgtgttcctgtactcaggagcttagagtctggtagaatctagtcagcttcgggcattggcaaactcctgcctgggcctgcaagccaagagtaaatcgacatttttaaagggcaggtaaaaaacagaagaaaaatatgcgacaaaatatttaatttctggctctttgcagaacaattttgccagccctgcctatgccattttcagtggttcctttcccgtctggagctgcgagtttatcaccctgtcctcctgtgctcttgatgctcactctcttggattgtatctgttgctgccattaggttaataaggacattggaacaattggatggttgggtttttctaaaaattctcttgaaattgttgggaattgttttggggaagccaaaactgtcataatgttatttgtgaatcagtcttgggttatttttaacagtacagtccaagtctcccgtggttaaaacacatgttttccataggctgtttgcttttcactctatagacttagagaaaaacaatacagaagccaatccttttttaaaagcattgaaaggcaatgctttcttaaaaggcagtgaaacaaaatgttgacaaattgtaaaggttaacatcagttaaaattcggaatctgactaattttaatctcagatttatgagaattaggccctgttagcttagaggcatttcatagtctctcaataacacggtatattatatttacatggccttgtggcaaaagctgaatacatgttttacttttttccttaaaaaatttttattgtaaaatatcttacttataatagtatatatgtcacatgcattaagcttaaaaaatattaaaatgaatacctatgtactcaccaccatgcctagaaggcccctgtttctccccaaaagcttttccctcaagaggtcagcaatatccagttttgtattgttttttaaaaatacttttacagtgtgtgtgtgtgtgtgtgtgtgtgtgtgtgtgtgtgttccttcctaaacaaggtattgcttagttttgcctgtggattcttcactaattttgaagcaactttacagaacaagaaatgctttattttgtaagaaagaagattggcagcatgtattcctctgcttctggatagcagaaaggggaaggggaggccgacaaatgagtgttgcttatgcaccctttattagggccagcaggtggcagtaaggggacttacattgggaaggttttggtggttaaagaggttggataatagtaattctgccctagttagatatgagaatctggagttggtggatttctaaactccatatccaaatagactcaagataaaaatacataccctatctacccacacttaactttcagaaacttatgtttttataacacttaaagcatgtattttaaaaatatatttttagacggcttcattcagtagatcctcttagaagggggccttgggctgaaagaaagttggtgtgacctggtctactgctgacctgccttctagccctgtgaggtctgacccccccagcccgccccacctacctcacctctctgtccaagagagggacttataaatgcaaaggattattcaacaatcttaatagcataattggcaattctatagttaagttttaaatgagtgctgaaatgtttagaaactaatatgatttaattgctgtataaaaattttgcctcctgacttctttccttttgccccacagcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttg

SEQ ID NO: 38297 - DNA, 16933 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgaggtactcggcggggtgcggcctgcggactcgcccggaggccggggggcgggagggggcggccggggaagggggcgccggaagcctctgggcgtctgcgtgttgccgcgtgttacacgcacgcacgccccttacacaccttttcacagaccccgccgtcggggcgcggccaggtcagatcccttttgatccgggcctgggctgagtgctccccccgggcttcaggtgacgcggccccgcggagcgtggggtcgcccgagttgggctggggaagccagggacggaggtgtccggccgtcacccctagaggagggcgtgcgggggtctgttttgcgtgagtgcgggataggggagtcgtgtggtgcggtgaggggcttgtggggggcactggaggactctgggggtggcgggggatccgagggggtcctcgtgaacccgcaggggagagtcctgggtgagggtgggtcccgagcacctgtgtctcaggagatggtgagagctgtctggagggctgggcacttggtggcaggggttggcggtgcaggggacaccgccgggacagggctggggtgccctggagcgggggagccgagggagtgggagcgggggcgcagcgcgcgatctctggcccggcagggccgctggttctccccagtgcgcggctccgggtttgcaggtggacggtgcgcgcgtgtctgcggtgtgtgctgtgcctgcagaccggggagggcgggggacgacagccacctccttccctctgcctcacccccctcctgtcccagggccgcgcttcaatttccgctgaaacttctgactcggacacccgccgcctttcgcttgggctcccacgggaggggcctggctgcggggggcggggcggggtgggggtgcggccttgctcgggtagaccatgggtgtgacagctgggagggctgtgtgtgtgtgtgtgtgtgtgtgtgtgcgtgcgcgcgcgcgcttgcgcttgatgtaacccgccctcatttccctgggtcccgagtgtggcagggaacagcaagaggtagatattaggggctgctttcattccacatcacagattctattctgcagtgtggtctgcaaaatgccttgcccaagatgtatagactcagttaccgcatctgtccccatctgggtggagcttatcccaggccccaacaggctctgagggatggccggggccaaggcagcctggactactgatgtggcacaggccagagggactccaggcagtctcctgctgcacagggcacaaagcatgtgcacagccaggtatcatcctgcgtgactcagaacagccttgagatgtaaggagtgtcatcccagcctcgaacctggggagctttctaagactcccaaggatggtacttatgcatcttgctgtgaagaataacaggatgagtgctaataatgaccatttcctgacacctacctggcaacaggtccataagctctacatgcttcatttgtgttttcatttcatcatcacgaaaaacctgtaagctttgcatcctgttcccactttacaggaactgaggctcagaaagcttgaggaacttgaccaggggtaccccccagctagaaagggtttgagacaggattagaacccaggaatatctgactacagccactccttactgcattcttaccaagccaaagtcatgacctttcactcatgtggggaggccttcccttccaaggcagctcttccatttgggagcagcgtacttggagaggtgggcctctgtctggtaactgactcatgttgccttgttaatcctgccttgaactgttgggaaggtctttaaccaggctgaggtctctcgcaccaatgcccatacctgggcatgcacctccttggaatggagtttaagtgggtgggcagatgggttctagagagaacccgtctgccctgaccatgccctactgccctctccttcagccaccacacacacagtcacacagctgcgtgaatggtggctttcctttcacttaacagttcactctggagatccttccaattaccctataaagagcatcctcaaccttttaaatggctgcacattgttccgttgtgtggatgaagtataatttatgtaaccagccctgtaattatagacagccaattatttctgtcaaaagggctgcaggaataactgtgtatttgcatgcttacacacacacacctctacagaataaattcttagcaatgggattaattgctgaatcaaagctcacacgcttttcatcgttgtttttgttttgttttgttttgctttgttttgagacagtctcactttgttgcacaggctagagttcctgaccatggctcactgaagcctttaccttctgggctcaagtgattcccctacttcaacctcctgcatggctgggactacagctgtgtgccatcatgaccagataattttttttttcttagggacagggtctcgctacgttgcctaggctggtcttgaactcctgggctcaagtgatcttcctgcttcagcctcccaaagtactgggattacaggcatgaagcactgcacccagcctgtttttcattttgatattgtcaaaatgcactcctcagaggtggtaccttttatcctcccactagcactgtcttcattgttagtggctgcactgccactattccacagtataaacccacttttcatgacactgccaagacataagggtctgaaatacttaacagttttcttccacagtccccaaaatacaggcttctcccccagctcaggacatgaagccatcatccctcctcattgcaggagccaaaggctggacctcacctcgattccaccctctccttcacccctcacatccaatccatccagtccatccagtctgccactgagtcctcttgatcttcctcctatgagcccttaacttcgcgtctccatctagcaccccctagtccaggtcaccttctcctgcctggactcgtgcttgtgtgggcctcctagctagtctcactgccccgtcttgtactttcaaatccaccctaaaagcatgatgttcccctgctgaaatccttcagtggctccccactgcctttggataattccaaatcctattgtgtgttaattaggattaggctcagctgtaatatagaaacagccacttaatagctaaaatgaaatagacgtttttttcttctttttctctttttttgagacagagtcttgctctgtccccaggctggagtgcagtggcgagatctcagctcactacaacctctgcctcccaggctcaagtgattctcctgcctcagcctcccgagtagctgggactacaggcatgcaccaccatgcccacctaatttttgtatgtttagtagagatggggtttcaccatgttggccaagatggtctcgatctcctgaccttgtgatctgcctgcctcggcctcccaaagtgctgggattacaggcatgagccactgcgcccagccttcaatagatgtttatttctctcctgtgtaaaaaacctggaggtctggcctgacaactccatgtgtcagggacctaggctcctctcttgctctactgtatgtggtacttctgaagccaaggtagatgctggagctccagcagttaggtccacattccagcatacaggaaaggaggaaatgaggaagttgggccctccctttaagaacactgtcctgggcattgtacacaacacttccacttgtgtcctactagccatatgctgatacaaggatacaagggagacaggaaatgcagtttattctaggtgtccttgtgctcagctgaaaatctcaggttctaatcctatgtaaggaggggagacctgaaactggggaccactaaccacctctgccatatgatgctcgtagagcccttcacaatagggcctctactaacctcaccttatttttatttatttatttatttttgagacggagtttcactcttgtcgcccaggccggagtgcaatgacactatctcagctcaccgcaacctttgcctcctgggttcaagcaactctcctgcctcagactcctgagtagctgggattacaggcgtgtgccaccacgcccggctaatttttgtagttttagtagagacggggtttcaccatgttggtcaggctggtctcaaactcctgacctcaggtgacctgcctgcctcggcctcccaaagtgctgggattacaggtgtgagccaccacgcccggcctattttttttttttttttaacttttcacttttttttgcagtcacgctcattctccaccgtgttcttggggaacatgcagcatgttcttttgcctcttccctcaccccagaacaggggttactggacagcggcatcaacttcacctgggaactggatagaaatgcagattcagaccttctgaatgagctactttgggagtagggcccagcaatgtatgttgaaacaggcctccagatgatctcaatgcttgctcaagtttgagaaccactgaaccgcagtatgactctccgtgtcacctggctaactctgcctcactttcaggtctcagtgtagacaccacctcttctaggaagacctctcttgacccaccagcccaggagagaggcctctctgggttcctagaggcccatgcttctctgtatagtagggctgatcacactgtatgtgatttttttttttttttttgagagagtctttactctgtcaccaggctggagtgcagtggcacaaacatggctcactgaagcctcaacctcccaggctcaagcaatcttcccacctcagcctcccaagtagctgggactacaggcatccaccaccacacccagctaattaaaaaaaaatttttttttgtagagacagggtctcactatgttgcccaagctggtcttgaacttttgggttcaagcagtcttcccaccatggccttccaaagtgctaggattacaggtgtgggccactgcacctagccttggacgtgattttattactcatctgccctccaaattgactggaagatcctgacggcaagactgctgtctaacctacttctcttcctagcacccagtgttaagtgaatgaacaagatcatatctctcatctgtgaatgtacgagagccatggattatgagattagttgattttcttaactataatttttagaaacaagctgtgtttttaagcaggtatttatttccttaaatgtacatttctgattacaaaatacttttttttgagacagagtcttgctctgtcacccaggctggagtgtagtggcacaatctcggctcattacaacctctgcctcctgggttcaagcgattctcctgcctcagccttcccagtagctgggattacaggtatgcaccaccacgcccggctaattttttttttctcccgtgacggagtcttgttctgttggccaggctgaagtgcagtggtgtgatctcagctcactgcaacctccacctcccgggttcaagtgattctcctgtctcagcctcccaagtagctgggattacaggcccacgccaccacgcctggctaatttttctatttttagtagagatggggtttcaccatgttggccaggctggtctcaaactcctgacctcatgatccaccaccttggcctcccaaagtgctgccgtgggctgcactttggcattgccttggtcacgtgctgctacctgggattacaggcataagccactgcgcctggcctaatttttgtattttttagtagagacagggtttcaccatgttggccaggctggtcttgaactcccagcctcatgattcgcccaccttggcctcccaaagtgctgggattacaggcgtgagccaccacgcctggccaggaaatacatttacatggctcaaattcaaaactataaaagtcggccaaacatggtgactcacatctgtaatcctaacactttgggaggctgaggcaggaggattgcttgagctcaggtgagaccagcctaggcaatgtagggagacccccatctctacaaagaataaaaaaaaattagtcaggcatcatagtgcacacctgtagtcccagctacttgggaggctgaggtggaagaatcacctgaaccctgaggtcgaggctgcaagtgaactgtaatagtaagagtctcctcctaatcttgtgcatcctttcagagagagagatgatagatattcaaacaaatacatacatatatataacatatttatatatattctttttaacataaaagtatagccaggtgtggtggttcactactagagtcccagctacttaggaagctgaggtgggaggttcacttgaggccacgagtttgagaccagcgtgggcaacatctcttggggaaaaaaaaaaaaaaacccaccataaaagcattctataacacgtaattctgtgtttgtctttcttctcttaatacatcttggagatcagtacgcatcagtatatagagagcttccttgtcctttttcagggctgtgtagtattctgctgtatggctataccatgatgttttcactagctttctactgcctgacatttgggatatttcctgcttttgctattggacacaaggctctgatgaacagcctttactatatttaatttttttgtgagaagtttaactggaagataaattcccagaagtggggcacccagttaaggatatgtgactttgtcattttaacacacactgccagatcaccccctataaatgttgtgccacgtatcctcccaccagcaggggaaaggaggggccaccaagcagtctcactttagtgcttttctctcctttttaccagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtacgtgcccatgggcggctgtcccccagcaccacaggaggcctgggaaggaggcctccaaaggattgccagggtgcagaggggtccttatgttcattcattcttgtgtttgtttagtggggaagcatccagggagcccctgctggactgatactagagaggtaaaccagaggtcgtcccagtcctgggggagttcacagcttaggccctacagtgtgataaatgctgcaggggtagaacttagggatcatgggcgcagaaaaggccgagcagaagttagccaggtagaagtgggagatgggagttgcaggcagggggaacagctgttcaaaggcctagaaaagtgaggggatagcactttagagaatgaaaaggacttctctgtggccagagtggagaggatgtgcagaaaggggcaggagatgaaggttggcagcagctggtcatgaaggtgttaacaaggggcctccactgggctgtgcggagctactgaagatgtttgcacaagagaagggtagggcatggtagacatcaaaactcctgggacctcggaggtgatcgagcctaacctggggccattttacagataggaagactgagatgaagacaggagaagggccatgcgtgaagtcacatagcactgggcctggctcctggggtaaactaaggggtagaaaagtctgaggattcctggcagaaaccaggaaatggacagggtcaaggcccctgagggtcagcccatgcaggacactgacaagtgacagtccaagaagacagagatgagaataaaaagtgtaacaataggtattcactgtgcaccaggtactatgatgattgcttagtgtgcacaatctcttttaatcttgacacaaccaatgaggtggtttctatcattgtgccccttttatagatagaggacactgagactcagaaagccatggttacttgccacatgacagagccaggtggtatcagagctgggattgggcccaggaggctgagcccagagagtcctgtgcccgtgctaggataagcgtttcacacaatcagggcaggctgccctggcaggcaagcataaggaagataagggggacctggaaacccaagggagagtagcgggggcctgggtcccttgggaatgcacagagaagcagaaggacttaagcctcctcctggggcagcagcagagctttgctctgttgacggagatgcagtgaacagcggggcagatccagacagggtccagcccctagcttcacctggcctcttgtgcacagatctccagcgcccttaccaggtgccctaaggagcccagaactctgggtccccttcctgcagcatcacaggctcttttccactcccgctggggaggtgagtccatgataagaggaataacccaagcaggctcaggagagaagcgccatgcgttcacagggccctgattctcaagaaacatttgggaaaatccactggaacatactcacccctatgccaatgtgcaccatgggtgctgaatggtcatttccacacttcctcagcttttctggtcagtgtgtagaaagatcaaaatcttgtctttgtaaatgatcaacttattcattaattcaacacaacttcattgagcacccgtatttgccatgtaccatgctgtggttaaaaaacaaagttctgttctcatcaagctgacgttctagtgggagatacagacactaaacaagcgaataagtaaaatacgtgtcaggtggccgggcgcggtggctcacacctgtaatcccagcactttgggaggccgaggtaggcagatcacctgaagtcaggagttcgagactatcctggccaacatggtgaaaccttgtttctattaaaaatacaaaaaattagccgggcatggtggcaggggcctgtaatcccagctactcgagaggctgaggcaggagaatctcttgaacctgggaggtggaggttgcagtgagccgagatcacaccactgcactccagcctgggcaacaagagcaaaactccgtctcaaaaaaacaaaaaacaaacaggaaaacccttattccagcatctttcttggttcctttgcaatgcttatcagcatttgtcaatatttggtttctgggcatgtttgcatggcctcccagtgggcaccggagagcagagcccatggctgtcagtctagctggacatgtggctggcccgtgcaggcccagggccagcatactgaatgaatgaaagcgtgggtgggcaaagaggacgggagctgtgacggtgatgagcatcaggtgccttctgcatcatccgcccttccggattcctcctgctttgtgggttatttttctgtttgggtgacctgttacttttcagttatccgatgtttgaggccatatagcgtagcagttaagagcacagacaaaaggccgggtgcagtggctcacacctgtaatcccagccctttggaaggctgaggcgggaggatcacctgaggtcaggagttcgagaccagcttagccaacatgatgaaaccccatctctactaaaaatacaaaaattagctaggtgcggtggcacatgcctgtaatcccagctacactgggggctgaagcgggagaatcacttgaatccaggaggcggagtttgcagtgagctgagattgcgccagtgtgctccagcctgggtgacagagcgagactccgtctcaaaaaaaaaaaaaaaaaaaaaaagcacagacagtggagtgcatacgtgcaaatctcagccgtgctgtttgctggctgtgtggcctctcagcttcgttaaccgtaaaatggagcaagtcatcctaccttataggaccatggtcagggctgagtgactcggtcagtgaagcgcttggtgcgatgcctagcacatggtagtgtctaataggtcagctgtgactgtttgcaatgccagcctcagctcccgggagtccccagctgtgctaacaccatgctctgcccacaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggtgagtgtggtctcagagaccccagccacagacacacccagggggtgggccatgatggagagaaaccgaggcccaggaaggcaaggtaacttaggcaagaagtgggagaaactgaagtaaccagcagcccctgtttagttccctgagaagagttgactcaggccaggtgcagtggctcacgcctttaatcccagcactttgggaggccgaggtgggtgaatcacttgaagtcaggagttcgagaccagcctggccaacatggtgaaactccgtctctactaaaaatacaaaaattagcctagtgtggtggcgcacacctgtaatcccagctactctgaaggctgaggcaggagaactgcttgaacctgggaggcggaagttgcagtgagccaagatcacgccactgcactccagcctcggcaacagagtgagattccatctcaaaaaaaaaaaaaagagttgactcagtcctcttgggagccccttgggattctgggatggagcactgagatgtgaaagtcatagtagccgacagtgacgaaagcatcgccacattatctaacgtggtcttccatccttacaaacacgaggcaggtactgttattatccccatatgatcaaggaaactgaggcccagagagctcaagtaacttgcccaagatcccatagcagaataaatggtagagctgggatttgaacctagatctgactccagagcctgggtcttaattcaatctgagcttgagaggcaggggcctggctgggcttaccaactgactttgggtgacctagtgtctctgagcctcagtttctccgttggtaaggaaaagggctggattgttagggtgttttcaggattccaagaccacagccaaaatagggtctgaggttccccacacgggaacgttttctgtgaaactgagaattagcactttttggttaaaagaatcttccttctctaggttgggatgctaagaatttttttttttttaattgagacagagtctcactctgtcacccaggctggaatgcaatggcgcgatcttggctcactgcaacctctgctgcctgggttcaagtgatacgcctgcctcagcctcccgaatagctgggactacaggcatgcgccaccatgcctggctcattttttctatgtttagtagaaacggggttttgccatgttggccaggctggtcttgaactcttgaccttaggtgatccgcctgcctcggcctcccaaagtgctgggattacaggtgtgaggtactgcacccagcctagacgctaagaaaaatttttaaaagataattctggggagaagggcagagagactcgcctcctgttccctctccagattcctgggggcagtcaagatgtgtcagggagtgcactaagctgccagttacacaggagttttctgtggagaaaggagtgtgaccccatggcattttaaaaaactttttatcttgaaataattttagacttttagaaaacctacaaaaatagttcaaagagtttctgcatatcctttaaccagtgctctccaatgttaacacctgacgtagctatggtacaattacccaaactattaactaagccacagattgattcccacttcccgagtttcccactaacaccccttgctgtgcaggatccagtgaggatcccaatttagtcatcagtggtttccttggtctcttccaatctgagacagttcctcagtctttccctgtctttgaagacccatgaccttgacacttttttttttttgagacagggtctcactctgtcacccaggctggagtgcagtggtgtgatcacagctcactgcagcctcaacctcccgggctcaagtgatcctcccacctcagcctcctgagtagttggttctacaggtgtgtgccaccccacctggctaattgagatggggtcttgctatgttgcccaggctggtctcagactcctgagctcaagcaatctgcctgcctcagcctcccaaaatcctgggattataggcgtgagccactgctcctggccataaccttgagacttttgaagagtactgatcagttactttgtatgtccctcaatttggatttgattgatgttttctcacagttagattgcagttatgtatttttggcaagaacaacacagaatcgataggcccctctccacatcatatcaagagatacttgagctgatagtcattcctatgtcgtgaccttgatcacttggttagggcaggacctaccaggtttctctactgtaaggtcctaatttaccctttgtaattgacaaataccttgggggaggtaagctaggcatataaatatcctgtttttcctcaactttcacccactaattttagcagccatccatcttgcctatagcagttattattgtggtgcttgcctaagtctaattttctttttcttttttttctttctttcttttttttttttttttgagacagagtctcgctctgttgcccaggttggagtgcagtggcacgatctcggctcactgcaacctccacctcccgggttcaagtgattctcgtgcctcagcctcttgagcagctgggattacaggcacacaccaccacacttggctaatttttgtatttttagtagagatggggttttgccatgttggccaggctggtctcgaaatccgcctgccttggcctcccaaagtgctgggattataggcatgggccgctgcgcccagcccccaaggctgattttctgttaatatttccttctacattttatattagaacaagcatgccttttttaaagaagtaacatttataatgatgtttaagctagtacataacttcaaacacattttaggcttagggtagatacaactaccccggacctcctggaggagacagcgtgcttcctgctcttttcaagaagtcacttgatggcccacacctgttatcccagtgcttcgggaagccaaagtaggaggactgcttgagcccaggagttcgaggccagcctaggcaacacagaaaaccccatctgtacaaaaaatttataaaaattagccaggtgtggtgatgcacacctgtgatcccagctacttgggaggctgaggcaggaggattgcttgagcccagaagtttgaggctgcagtgaactaggattgcaccactgcactccagcctgggtggcagagtgagaccctatctctaaagaaaaaaaagaaaaaaaaaaagaaaaatcacatgagagtcattggtagaagagggaccgtgagttagatagacctgtgtttaaatcctgggttctgcttcttacctgctttttggccctgagcaaatgacttcacctgcctgagcctttgtttcttcatctgtaaaatgggctaataatgctgacaccccttgtcccccaatactgtgattcataggattggtcagtatttgtgaaatgccactggacacccaggaagtaatgccataaagaagaaactaatagcagtggtaatagaatgattactattaaagtcatctttgagtgctcagtggaagttgtttaaagtagaaattgcaaatggcaggacacactttttttttttttttgagacagggtctcactctgtcacccaggccggagtgcagtggcgcgatctcagctcactgcaaccgccacctcctgggctcaagtcatatccttctgcctcagcctcccaagtagctgggactacaggtgcgaatcaccatgcctgctaattttcgtattttttgtagagataggtttttaccgtgttgcccaggctggtcttgaactcctgaactcaagtgatccccctacctcggcctcccaaagtgctaggattaccggcatgagccaccgcgcccagccttacacacttttttttttgccctgcttacctgtttgtgttttttatataaactggttgccaatattttttaaatggggaccttttcattaaaatacaattcctggcttctcttggggaaaacaatgggaatgtggggccatcttgggaactgcgagggtgggtcacagcactggctctgagtatctgccagccagcgttcccatcccaggcccatgctctacagctgtaaaatggtgtcttccttgcaggctgtagcctagatagaatgaggtgagccaggtaatgagctgggtcaagggccaggaacacagcaggcacttggtaaaccctagaatgcgttgtgtaccctttttaggtagcgcttgtgctgagatgtcaggcacacttcctgtttctctcatcttattacctgcctggaccctaagtttgtagctggtttaagagaggcttaaccctctcagccccatcagccccctccccaagggactctgttgaaaaatgtattcctttcagaattttagtttaaatttaattgctctgtggccttaaatgacttaacctctctgagcctgggcttgggtatctgtaaaacaggatcagacatcacaggactggcttgtgtctgtcaaaggccagcaggcacttggaaagtgggtgccacaagggtgatagcatggggtggtggcatgggggttctgggtaggacctgacccttctgtttctccccatgtcccaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataatt

SEQ ID NO: 38298 - DNA, 40874 bp, Homo sapiens
aagtgcgcatgtgcgcgaggagtcgctcgggcacttattgagcgccgactgtctacgggcggccgggggtgtgtagcccaggcgcgctgggggcgtgctgggcgggtgcgggggcgcggaggcgcggggggcgggcgggggtgtgtcccgagtgtcgccgctgggcgccggctggcaggggctggcgtgctgctccgctcccttcccgggcgggaatccgggccgggttgtggccgcggccgcgtacgtgagcgcagtgtcccggggaggagggcaggccggccaggtgggcgccaaccgagcctcggcgggcggccggagcggagccgggccgcgggccgcgccgggagggcgggcagggccgcggccgctgcagcccggagctgagctagccgtccgagccgagccgtccgagccggggaagccgggcgcgtgctgccgctcgtggcgggccgaggtgagctgcgcggggacctagcggcgcggcagccggggacgggggcggccgcgaacttcccacgccccgcgcgcccgcggctgtcgggccggcggcctggggggtccgggggtctgggaggccggggccgcggcgggcggggcgcgggacgctgcggcagggccggggtggcgggcggggtggctgccgctcccgcgcgtcgccttgtttacctcgccctccgccggcgcccccactctcggagccccctcccgacttcgggcagtcgggactcgcccctcgcagggacagggaccggcccgcctgcccctccccggccctttccggcggggccgcccgcccggccctcccgcgcccggccctcccgcgccccgcgcgtttctgccggttcctgcccactccggccggcgcgcgaggccaggctgcgggacgggcgggacagagggacacaccctccgcccgcgggcgacccgcgtccctcccgccctggcggccaccgccccctctgcccgcacgctctcgcccggtcccgcctccgcccgcgcccctggccctccccggcggtggcaccgtgggctcacgcgggtgcccggggggggggcggggctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctgggggttttgcttcaaagtgagtgatccacaggtatctaaggccttcttgacaccctccctaggcgttgtgtaaacagaagcacctggtcgcaaacacctcgaaacacagggaaacatggccattaagttcaactccacaggtcctgtcagggagctgctgtgctctcagcacggtgccaggccctctgggaggtgggagaggcaccgaagagaccccaggcttcaggaagcctaggactaggtggaagtgatttaggagtttacgttcaagttaatgtgcagtggctgcctgagttagtggagatgctggagagggagtatatcagataaaggaaaaacgagattggggaagggacttggagtactaagttttgaagtaaattatgcctgtggagagtaactcacccgtagggcccaaagacaagaggagaagaaagtaacaggtgggataatttacaaagtggagcagaggagcagaggctcatacctgtctcggggagagaggagacagaaggtgtaagagatgattccctccctccagggcttctgccctcatagaggggacagaaggatgtcagcatgtgaaatcagacgccaagagagggaatggtaactgtcaaagtgcgaggtgcagaaatagttctgttggagtcagagaagggagttgtgggcagggatcagtcaccaggactggaggctgacgctgttgagataggctgtgaggtgggaatgaacatggctttccagagagacaaggagatgtccttagccataccagggaatgtatcctgaacagtaggagatagaggtggagaggaacaatggttgagattgtgaaagtcttagcccttttggtgattgcatgccaccctgtgtgtcctaaggagacattcagggtttttgagtgagggaatggtgtaatgaacaactgtaatggaagggttttggaaagttgtgttagggggacacatcagtgagcaggctgttggagttgcagggtggccagagtttgcactgggatcactggaagtgaaaaaggtgggtttgagaaacattactgttgaaataatctgtttacagggcagggtgaagggatgagatgaatggaaattaattcttggtggaaattgattcaacgccagggccttggagctgctgtagttggtaacttgagaaatcggaaatgtgtattttggagagaaggaattggctactcaggctatagagaagtttcttgtggctgctaagatatccagatgttagtgtcctgcaagcagctatggctctgagatgggggagcccaggggggacagtgttgcagaggctacagatgccgggagagggaaggggctcagagaagtggggaggctgctggtaataggggggcagcggaggatgcctttgagtggtactcaaggcctgaaccgaggggcttctgtttccctctgctgcactgccattcacatgacattgctcggttctgaacctgaagttggaaaagcaactgtgggcaattgggccctgaggagtatgggctgttgattcttctaatctcgagggtggattggaggttagaacggtgtagaatgggatttgctaaagacagtaaattgctgggctttgaaacattttgaacttttctggggtggagggttggagggtaggagagagagagtgaggcaggaagacattagccctagggatattgtgattcccagggctgttccaaccagagcctggcaccctgcaagtagaggggagctggtgctttttttcttgagctctgttcatgttgcaagggtgacacagggtgatttgctgaacaaattccccaagcctcaacttgcaacatctgaatttgaatgatgattgcaaaaagttgtggaatgagctgagaatgtaattactgttacttagcctccttgtttctctgaaatgcaagatcagtgaactagtagaagaggacttgggaatcagatatttttctttatagagtgtgtctgattgtccaaagaataattgcatgaagcagtggtcaagctaatttactcattgtaaagcagtgtctgtactgttttgactgtgacttacattaagaaatgaaatttacatcgtgacctagtacatacaatcatgtatataaaaatctaatctaagttcataaagtacctacctccctttgcttggtgtcatctctgacatttctattttctagtctattatttttcatttaaaaacctcttgtctcccactaagttgatctaatcgttctctaatggatcataacccacagtttgaaaaatagagagttttcgcattcagtgagtatttattaagctgtttgaagagctactgtagtactgaaggtggaagaaagcatgaggaagggtggaagacttacagtctctttggaaagatgagagacaccttgattaaggagcaagccaagatgattaaatgccaacataaagaataactacctgtggggttcagaggagtggggcgtgttctgtgctggtggggcttggaaaaacgtttagggacaaggaaggaagtctgggatgaactgtttttggtgtctcagggtgctgcagatgtggggaggtatagagtgggcaaagccttggagttaggaaagtgtaaagtctatgattgtgtgagagagaagaacagagggttcttgttagagattagggagaaatcaagttgttaaagtgggctggggtcacatatagggcaaaggttgtaaaccggtggccagggagtgttttaagcatatggatgtgttctagtttggactacataaaggtgtttaaaaattgggggaaaaaatacagaaaaatctctggatttgcagctcttttaaagagtcagatctggtgttcatctcaagctgagaaggctgtcccctatggacaggagacaggcttgtggtccccgggcttccttttgcctcagtccagtcactttccattcttcacttagtcctgtaggcgttttgctttgcgacctgagttttcaagagactcgaatgctgggccaggaaattcgggattgctgtcatgggctctgggtggccactgaggattccgggtaggagtgtggcattatggaatctgagatatttctgtgcaccggatttgttttaggcaagtcaatagcactttttgaggagctgctggctgggactttgaaatatttttatgatgatgggaatggaattatagagggctttgacctgtgttctccgtagtaaggcaagtttcaagtgaccccaagatttctccagcctttccattttccgcttctggctggcagggatctctgagagtgatgtcgaggtcataccttggtgaggtgtgagtcacagccatcaggtgccatatgacgtacaattctcaggagcctggtattgatccaaatggctcccagcagacgaggctgatttggggtccagctgaagtgactaagttcaggactctgtgacctagaatagtctgatttaccacccaagactaagagctcgtcccagatgagccactggtgagagagactgacaaatagtaccctgatgtttacaggtgggactaaaatcagttatttaaaaatactgatccggctgtagtggctcacacctgtaatcccagcactttgggagcctgaggcaagaggattgcttggaccctggagtttgagaccagcctgggcaacatggttgagaccctgtctctacaaaagataaaaaatctagctggggctgggcgcggtggctcacgcctgttatcccagcactttgggaggctgaggcgggcggatcacgaggtcaggagatcgagaccatcctggctaacgcagtgaaaccccgtctctactaaaaatacaaaaaattagccgggcgtggtggtgggcgcctgtagtccaagctgctcgggaggctgaggcaagagaatggcatgaaccccggaggcagagcttgcagtgagccgagattgtgccactgcactccagcctgggcgacagagcgagactccgtcaaaacacacacacacacacacacacacacacacacacacacacacactagcagggtgtggtggtgcatgcctgtactcccagctactcaggaggctgaggcgggaggcttgcttgagccctgcagaaggtggaggctgcagtgagctgagatcacgtcattgcactccagcctgggcaacagtgagaccctgtctcaaagaaaaagtatactgcttttgaaacattaacaaaatgaaactgaagtgcattttaacaatgtgtggctatcggatgcaaggataaccagaagccagctgaatcgtatcaaattaaatctatttcctgtcttatatggtggtttgtttactaggccagagaatagtgcagcaactatggtacattttggcttcagtaaagtatttaacagttttttgaggtatgatggtccttattaaatcataagtggtaagacgtgggctggatggtgttattaatttaacaatcctatgtgaaactgttaattattggcactgaggcagcctggaaggagatctgaaaatgagtacagtagggttctattcttggccttgatctgttcaacattttcccagtgttggcggtgaagacagagaaggcgcgctcatcagatttgttagtggcgcagaagtgagaggaattgctggttttgcagacaaatcaaggttcagtcgtctagaattaggagtgcaaattaaaaagaaaacagaaaaaaattcagtaagggatgaatttaaagtctgatttaggtttaaaaatttgaattgtagcgttttgagattttcagtatcctgataagataataccacttctggggatgtagctgagaccatatccacaatgtagatgatgatttatgcacagagattattcagagatttttttttttaaactctagtaaaaacttgggaataacctaaatatccaatggtgtgggctagaggtaataaataagtgaattctgatatctttaaaatagaatgttatgaagtcatgaaaaataatgtttaggaatagctttaaaataacagggaaaaatgtttttgccaaaagttaagggacatctacagtgtgacttcaaatgttaaaaaagcaatgtgtttagaaaataattggaaggaaatacaccaaaatagtatatcaaaatacaaataccagttgcttctggttgggttgaggcatgcagcttttttttttttttttaacgtttgtattatttgtcttttctagttgtgtatgtattccacagtggggacatctgcaatttttaaaactttttatggttcaaggacaagaaagggtaaagtagatgattcattcagtgattaatcttgagtgcctgctcgctgtgtcaacctcaaggtcagaaactagagtcacagtggaagacagagtctttgaccccaggttggcacaggtccactgaggaggggcagggcatggagaaaaaaagcgttgggatttttctgttgttcatcagttcagtgtgagccttcagtggatgaggcttttatttttatttgtttctatttttatttttttcagagagtcatgagtcttgccatgttgtcctggctggattcgaactcctgggctgaagcgatccttctgcctcagcctcccaagtggctgggtctacgcacatgggccactgagcttagctctaagatatggcttttaaaaaattgaatgcagtttataacaggatcagaaattcagtgatctaatcataagatctagtcttaatgaccttggctggtcaggtgacatttggaccctggagagccaagagttaatagggatatgagcaagaagacttgatcctggaaaggagagtaggatgctgtaggatagggaataactaaactgtattcatgcattgggtacacagtagcaccttcaaatattttcctggttatcagacataggaaggaggagacgttcatttttactcctggtgttcgaatacaaccaatagatgaaacagtcactttattctctgtagctgcagattcctaatttatggcatgattacatgattccttgtctgtagaatgatcagcgatcatgctgaagttgatagactttgaggtcccctttgacccgaaagactgggacagcagatttcagttcaatatgaaaaaggattttctagctggcagatctgtccaacagaagaaatgtctgcccaggaagtagtgagcttacggctgttggcggtattcaagtagggctgaatgctgttgattagggatgcggtagaagagaaggacaggaattaggccgacctccaaagtctcttccaatttagagggtcagttatttaatatatgacttgtcaaagccgaaagacacatagaataggggctttaccttcagtggcaagtatttgagtcaatatcatcaagtgtgttctttaaaaatgtttataaataggtcccagcatttttgagagacccttctgggatcattttagaaaggatgaacaaaacaaaacaaaaaacaggtgaggtgcattgactcacgcctgtaatctcagcactttgagagactgaggtgggtggattgcttgagcccaggaattcaagactggcttgggcaacagagagagaacttgtctatgcaaaaaatagaaaaattaaccaagcatgatggtacacctgcccatggtcccagctcttaggaggctgatgtcggaggctcacttgggcctagagtttgaggctgcagtgagccaggagcagtgagccgtgattgtggcacactgcactccagcctgggtgacagagtgagacctcgactcaaaaaaaggaaaccaaggatgagaactattttaagttgggtcagaactcagtttgtgaacccagggctgctgaaaattaaatttggtccttaggaaaagcaagaaggttggtggtggtggggggccgggaaatggccagtaataatgaacaacacagattgacatgtagacaagtagtaggatcatgctgggtgtggtgtcacacatctgtaatcccagcactttgggaggccgaggcgggtggattgctggaggccaggagtttgagaccagcctggccaacatggtgaaaccccgtctctactaaaaatacaaaaattagctgggcgtagtgttgcttgcctgtaacaccagctactcgggaggctgaggcaggagaatcacttgaacccaggagacaaaggttgcagtgagccgagatcatgctactgcactccagcctgggcgacagagtgagactccatctctcaaaaaaaaaaaaaaaaaaaaaaaaagtgggatcatcatgccacttctattcgggatgatgactaaatcaagagggggctgttagtgggtgctgggtcctctgcttggccgtggagaatgtggagtgaccttgaatgtctcctcccacttcctgtcccgcactgtggatttatatccccaggagcaccttgctcaacagcatcctgacaccagtgatgagatggagccatctgattgctcttcagtttagcgataaagagaatacagggcagatcaatttaaagacattttaaagtgggattttccaggaaaacatatgtttagtttatatcagacaataaatttgtaatttgaattaaaaaaaatttttttgagacaggatcttactctgttgccaggctggaatgcagtggcgcaatcatggtttactgcagcctcgacccactgggctcgaggcatcctcccaccttagcttcctaaagtgctgggattataggcatgagccactgcttctggcttaaattttttttaaatttttgcatatgtattacttatagcttacatatgaaattttttttagtttaattctgcttaactttcactgaaatatatgctttatttagaatccgccctgattatttaaaacttttagattcctcttcctgatatttttggattacttttgttgttgtttttgttgttgtgcaggtcactgcttggactaaatcacttagcaaaagtttcttagctctgcaaagagaatagaggtttatctcatctttggagaatattgtaagatgatttttgtctccacatgatatatgcttgcattttggcatttgagaaatcagtatttggcaagaaagtgctctttttatatgggatgaagcaattttggggtgcgctgacttaacaaatggcagttttagatgtatgtgaaaagcataggcaggacctagttatttagaactagagttgaaaatttttgtacatttgatgacaggccttagtctcctttgtctctgtatcatttatgcctcacatggtgtctgtcacatcaactgtgcttgttgaattgctgtgatttggttccctgggctacatatagtgggtttgggggaaagttgggctaacatgccttttttttttgttttgagacagagtcttgctctgttgcccaggctggagtacagtggtgcgatctcagcttactgcaacctctgcctcatgggttcaagcatttctccctgcctcagcctccggagtagctgggattataggctcccgccaccatgcccagctaatttttgaattttttttagtggagatggggtttcaccatgatggccaggctggtcttgaactgacctcaggtgatcctcccacctcagcctcccaaagtgctgggattaacaggcgtgagcccggcctttttttaaaaaaagcaaaatatgataagaagtaatagttcccagctgggcatggtggctcacgcctgtaatccaagcactttgagactacctgtggtcccagctgctttgagaggctgaggtgggaggattgattgagcccagcagttcgagaccagcccgggcaacatggtgaaaccccatctctataaaaaatacaaaaatgagctgggcgtggtggcatgcacctgcagttgcagctacttgggaggctgaggaaggaggatcacctgaacccggggaggttaaggctgcagtgagctgtgctggtgccacttcactccagcctgggcaacaaaaagaaaataaaaagaaaaacaaaacacaaaaaaccagttgtcagcctttttgtcctttgagtatcaggaagccatatacaactctcttagtaaaaacacccgcattcagtcagtggctgcttgtcaaagtgccggaggaattgaaaactccctctcctctttctatttttcttctgctgaaaatgaattgctcttggtgtgctgttcttaaattcatgtgtcctgtgtccattttaatcttgttatctatttttatggtgactgtcgccatggtactcatgctccttgcatagcacaacagagatttccaacgtctgataggacagctcagagttctgctgcagccgggagagaaactgtgtgtgaggagttcttttttaaattgaggtgtaatttacatacagcacagatcttaagtgtgctgtttaatcagtttcgacacatacgtatggagacagaacatttccatcaccccagatgagttcctcgtgaccacttccagataagccccacccccaaccagaagtaccacaaatctgatttctattgccataagttagttttgctcagtaggttctaaatattataattttgtctctctctctcttttttttttttttttagacagtcttgcactgtttcctaggctggagtgcagtggcacaatcacagctcactgcagccttgacttccccaggctcaagccattctcctacctcagcctcccaagcagttgggaccacaggtaggtgccaccacacccggctaatttttaaattttttttagagacagggtctcactgtgttgctcagtctgatctcaaactcctggccttaagtgattctcccaccttggcctcccaaagtgctgggattacaggcatgagctacctgtgcacagccaattttgtatttctaaggactctataggtagtgctttgaggaggaggcagggggtgcgtgtctgtttaaaaagcagtaacctatgtggttaggagtccccagtgagtgaataataatgttttagagtttgtgcaatgggatgttcagattcttttttctcattagctcaggggatttggatttatattaggaatcctgattcccatctgaaagagtcaaaaccacagacagctaggcctggtatggaggaagtgtgattgggcaagggctggcttattagggaacgtgtgtgttgtgttggagtgctgcagtgctgggttggaagaactggaattactcctaggacatccctttggatgatcagaagtcccattgacatactttctcttttttccctgccttttccttgaactagcatataaatttaacaatccacagagttgcggagttgggcttgtaatattgaaacaagatctgtgctgcaaagcccactgctgactggaaacgcagatgtgcactgctgagctcacagcccctgggaagcatggcccagattcagggtgaaattgcccccaaacatattattgaaatgcattgaacagggactgtttcttttctttttaaaaaaaaaatttaaatgaaaatttcattgcgcaagttagtacacgaacacattctctggaggggaaaaatgcaaaacttctgcagcaatcagaaagttttccttgatgactgttcctaatcccagtcccttccccagaggtccagcactttcatggacttgctgttcttcagatgcctcacatactcacatctatacctataggacttacaaaaagttaagtgcattggctgtggattacgtaaggtctctttactgaattgcctctccctccctcaacagggtgcttggtgatagttcccggctcctatgcaaaggtctccttgattttgtttaacctctgcccggtctccctttgaattagaaggctacacaagtacttcacctttccctaattcatgggcacttcagtcatttccagatcctttactgttaaaaacgctgataccaaaaaacattgctgcacagacctctatagcacctgtgagttttctctggggtaggtactgagaaagtggaactgctgggccgtagggttcttgagttgtacattgtaacaaagatgcattatggggtcagttcctcacttagagttactgtgggacgggggatgcctgccctgtgctcagacattaagcagttatttgaagacaagggggcaggatttagagtgtgctaggtggatgctcaccggcctcacaggtcgcacataccattgctggtttgtgggaagggttggtattgggaagggctcttctgggcctcctagttaattctacctggttcccgccccccaacccctgaggactttgacccgtatgttgatagtggttgtgtggaaaagaatcacaggccgaacgggcagcccgttgtggactctggatgggaaattctaaactcagttcacttggcctggagaccgtcaccgcacctgcggttcttctccaggctgcctttgtaatccagtgtggcttaaacactcaagcaaagcgtgaggcgtttggaagcatgatgttctttaaaggcatctagaatgcggccacgtggctgttattagcagtttatgttaattacagaagaatggcatgtgccactgtttacgattctggccttcatctctatctctctatagaacttgtggaaaacatgagaattaatcctatcagatcaaacccatgcatttaggagccagtgtggcaagggagggagtggctgtgcccttcccgaagacagctttgtggccggttgtgggccggtgtccctggccacctgggtggggagaggcagaggcccctttgcagccttcacgattttacgtgcattcaacctcaaatctccatgcagtctgtaatgaagcagtgctagttggagcctagggcaaccccactcgtgcattcattcactgtccaaatgcagtgtgcacttcatttgccttcactggggtattccagcatcccctctttggtctccagctgatgttagtggggcctcccttttctgtcatttcaatatttggtgaccaagttggcattctactcctctctccaacttggcggattctcttggggccctcctggccttgatcctttgtcctgaagagcgctgccttcttagcttgccctccctgtcacacagcacatttaggttaatggtcctctggcctcataagtcatctttttttatccccgccggccctgagacagggtctcactctgttgttcaggctggaatgcatgggacaattacaactcactgcagcctcaacctcccaggctcaagtgatcctcccacctcagcctcctgagtagctgggactgcaggcacatgctaccacgcctggctgatgtttgtattttttgtagagatggggtctgcctgtgttgcccaggctggtcttgaactcctgagctcaagccatcctctgcctcggcctcccgaagtgctgggatgtgactgtttccatagagctcttgcatggttttcatttttttcttaccatctattacactgcccttgttgatgttaaaatttactgtatttcccccgcatttgcacaaactctttctgataattttccgataggtttggctcttcactgcccgggatttggtgtctactttttttcaggtcagcatttatcgcgcacttttgctaggcacagtgctcagtatccaacatgcattttctcactgtttcctctctcagacctgggggatcagaatctctaggaaggggagcttgggaactcttaacaaaatcaaggcacttctggaaaaaaaaattcattgcctcattaaagccccaaattatcctctgggataggatcaatactttttctcattttgcacgtgaggaaactgaggcacagagtggtgaggtcatttggccaaagtcacaatggggaagtttgagcttttttttaaaactatttttttttttgagatagggtctcactctgtcacccaggctagagtgcagtggcatgattttgactcactgcaacctcctaggtacaagcaattctcatacctcagcctccccagtagctgggattgcaggtgcccaccatcatgtccaggtaacttttgtatttttagtagagatgaggttttgctatgttggtcaggctggtcttgaactcctcaccttaagtgatccacctgccttggcctcccaaagtgctgggattacaggcgtgagtcactgcgcccagccggaagtctgagcttaaggcagccctgactgtttgtgcattctctttgggatatttgtaaagggtgaaataagaagaattgtcgccctgctcctgggggatcccatgcttgattctttgctgtcataatgcacatttcccgttccatgccacaaccactaataccacattagcctcttggtgactcaagtttttaaaaacaaggaagcttatgtggtcatctagtttggtctgtcacttgatgcatacatttcctggctgtacaacatagtagaaagagcatagcttgtctgggtctggtggctcacacctgtaatcctagcactttagaaggccgaggcaggaggatcgattgagcccaggaattcgagaaaagccttggcaacatggtgaaatcctgtctctacaaaaaatacaaaaatgagtcagatgtggtggcacgcacctgtagtcgcagctatttgggaggttgaggtggcaggatagcttgaacctgggaggtcaaggccgcagtgagctgtgatcgtgcgactgcactccagcctgggtggcagagggagaccctgtctcaaaacaaacaaacatagcttttgaaatcagacacatttgggctcacattctgagttctgtcattttctagcttcgtggccttgggaaaattactcaccctgagattcagtttgctcatctgtaaaatgggaatgatgatggtatttataatctcatgggttatttgtgggggattaaatgagacacagtctgcgaaatgctcagcaagttgactggcacttaagtctttgataaatgatagctgttagaacattcctgaatgcacatcagtctttgaaaggccacggattacatataagggttcctgttattctcttgtcacttagatgtgattttatttcttgggaacatcctactgccttttcttcaaaagattctcctcttctgctggccttgaactaagtccagtctacctgctggcctgaggtggcgggggtgtgtgtgtcagccccctcagttgtgttcctggggcaggcagaactcaccagcacccggtgctgattttatcccttccttctctgaaaactcggagagtatgtgccagctgctgtctgcgattgatgcacatttattttgtcacttgggctcagaacgtcctcaccagtgagcagcttctgattaatgccgccaccccatccatttcaagaaaagcttcagagagtggcaccccaacatcctaagctgggactggggtgaactctcattcagcctgtttctccatctctctttcgtctcgaaactcattctcatgcccacagttattggggcataaagattccttaaatggcttcctccagagaaaaatacgtttaaggcacttccttagtggtttgagccctgggcgagcccctcctccactccgtttattttccactatgtatttaaatcttccccgatggtgcctgtcttctcgtcactaaggctgactttctgtttttggggtgaaacctgtgtctccttcaacctccagtcactcagtggattttttttttttagattcataacatattttattttgacttatctaactgatgtcaaaaatggaaaatgttcacatggatattcatctaactcatgggctccattctaaaaaccccctttttaaaaatcaggcttcagtgtcagattgctgaatgtttttttcattttcctgagagatgcaaatgttcattcattcatctcattatacaacacagtacataaatgtagcttcagagcgtattaagtgcttttatacacaagtgctggctgtgtggaccaggtggtagctcatttaggccccaaattcattaagggcagggtctgactcttaggcttcttaatatttggtttggtgcatggtcaagagctggacccacatgttgcatagcagcagggctgatatgtttaaagacgctgggctttttctgctctggggccctttcccgggggttccggtgagtccctccccaggtgggtctgcccccacccgtgtgggcgggattagctcccagaggctggccaggccccacctgggggaggcttgagggcagggccccaaggctgagattcaggcttgggggaacagagcaggaaagagacccggtaccgaaagtgagcggggcaggcacctagtcacatgggtaatgggcaggggtcggtcactggctttggctccagggccagagcagtctgacttagtgttgagctccaagcatggaacactggagttggttcattttgaccagcaagcctctaaatgggtgccttgattacccaccgcaaggagagggcagttgcctttttatgacatgttaattccagccaggtgagtcaccaggtagctctcatcctcctgccaggctcccctgcctgtcggtttggcattgtcagataatgtgatcattcattgaagtgacatttgagttccaaaccagttttctcctttaaccatttcaccctcaggagtgattctcctttgtttggcattgtcagggaatgtgatgatccattcaaatgacttttgagttccaaatagtgtttctactttaacttcctaaatgaaaaaaaaaaaaaaaaaaattggccaggcacagtggctcatgcctgtaatcccagcactttgggaggccgaggtgggcagatcacttgaagccaggagttcgagaccagcctggccaacttggtgaaaccccatctctaccaaaaaggcaaaaattagcccggcatggtggcaggcacctgtaatcccagctacttgggaggctgaggcaggagaattgcttggacctgggaagaggaggctgcagtgagccgagatggcgccactgcaccccaacctggtcgacagagcgagactctatctcaaaaaaaaagagaaagaaaagaaagtagagtccatgttcctgtgttcctctgctttcttcaaggagcgagaatgtaggaaccctttttgtcctcttgggattggcacctggggcgttgttaggcttttaaaactctcacgtctgtgttttatatttttggaatggcagcttttttttttttttttaattggcagcttttgcttgttgttactgcaagtgcttccagtaaatcccttctccatgaaactcactctcttcctctggatccccccaactcaccctccccaggcctgagccgcgccttgctgctgggtctccacttgtggggaagagagaactggaccaggacagcgcgggaaactgacaatgccactgcttgctagctttgggattttggacaaataggtgacctttttgaacctgtgttctcagctctaaaatggggataatgttgttccttcatattttattgagttgctgggaagttgggaaagaagagaagcccccagcgtgtgcattcaagagagtataaacctgagtgccattcaagcatttgtgggtgctttgaggtcctgtgcaggtctcttagaagtttaccctgaagactgctagaattgctagttctgtgaggcttgttctccccagggatactcggctcctggttccctccctccagtcctggctctgggtaaaatgccaagtcagcaatcatccatctccccacctccttctggaactgtcatgtggtttgagaacagtttaaatcaggtttaaccacactgcacgctgcccctgccccaccacatacatgcacgccccagcgccccatgcatttacaaaaacactgcaggacaactgcgtcccctcacccagacatctgtcagcatagtcctgcttatacctgcttccttctgtctacctgtttttaaggaaaccctgtcttggaagcaagttcgaatgctcttgatacttttgccttcattttagggccagcagcaggtattctttcttataacacgtttttcttgaatctgggcctcttcttaccgctggaagatcagctgtttaagatcagtctaaggaggctgcagtcccatcggtgccagtagagagggttgtggattcctgagccctcactatgtgccaaggagtgtcctaagagctgtcttgtgtaatagggtagtgtgaactccagagagtcgtgaacaaaggcactgcgtttctgagagcaaatggggaggtaggtgtgaaggaaggggaagtgtattttttcctgggtagagctgtggaaacgctttcctgccagcagcgcaaacagaaacagtctcttttacttgattgaatgactgttgtgcagtcagaccagcaggaatatttgttgatcaggatcgtttattatttgctggagagaatttgctgtaagcagatcagatgacctatttttatggcccatctgctggaatatgaaaatagtagtgttagttgggagtcccttcttcctcctttccattactgtattacatctattacttagagtaataggaaggctggatgctcagttatagggtatgccatcaagaaaataccagccctgaatgggagttggacaattattctggtccctatcagtcttgatattctatcattttaattttactggtagtctaaactattctacactgatgcagtgtagtccagttttttaaaaccttcagaaaaagacaataattagaatgccctgagaatccacattgtcacactctgaccagctgattgagaacttgaatcaatcaccaatatgctcagtgccatgtgtctgaagcttgtactgtgaaaatcctaagtacacaccacacccctcttaaaaatagggtaacaggacctggtaattccagagagctagaagttttaagtcacggcttttgatgctcttgctaaggccctggctttctattgaaagccaggaggagttttctcctatttcttcaaagaaaaggtccatgtatgcttagcgaagtgtcttttttttttttttttttaaactttctttggggaagacataccaggaaaaaaaaggcttgagaaccagccaccaggtagcagttgggtatgggatgggacagtttgcttctgccaaggttcaaatggtgacctgcaaaccaggaggaccataaacatatttgcatatacttacaaatatgcttgcaagtactcatggcatttgtcagcagagatgttggctaagaattgctgaaaatgaattctttgggaatcttgttctccatggagttccattgtgaaataagagatgcaaacattcactgcaaacattttggcctttgattatttatttatttagagctcagacgatcctcctgcctcagcctcctgagtagtggaactataggcgtgtaccactatgccctgcaagtttagaacatcacactgaaaaacttaagtaaaaatgttatagatttaaaggaaaaattggcacttttctgataaaagataaagaatgatatggttaaatattaaccaaacacctaaaaacttaaactgttgttcctgcagtgatacccggtggagataataaaatatacagagagctgagtttagcagagaactgaagctcttggcaggagggtttatatccctcagttgacctataaattattcattagagaagtagcaagcacccacgcttttgcaaataggagtcttactccaaacttcacccttcttaagttaaaataaaccccacgagttgtgcagtgaatcactttgacttatgacttgtgttctggaagtgctgctaggtgatatcatagctcgctgcagtgtccctgggtggtaggagagcacagccaccgtgcgtgtgtgtgtgcacgcacacaagtgtgggggcgtgcctacgtgtgctgagacatgtggttgtccagcaacagttacatgacaaatagcagtttgcaaccccgaaccacagagagagtttgttttactgttctgcctgttccagttccttaactgatggcagatgtcctcattaagggctattagcacatcagaatgtgtttgctgagcccagaaaagaactaactccttttggacatggactgaaagatgttatctagggtagccaacccctcctgttggtgacggcagtagggagtgaggaacacaagagggcttggtatccccttaaaactttcctgagaagccttcagcacgagtttgtttcagtcagggaattccataagaggagaatgtaaaatcataaagtgggatttggctgtgtgttgaactactgttattgttacccggaaataggtgtttcttgatttctcttggctgctccagaaccatatggcaaactaggggatggctggtttatagggaccattgatagctcccaagaaagaacttaccagaggagtgaatgaagtggagattctggaggagagaggttggaaggaggccaccgctggaatggtggaagtgcaccaggtgggcaggacccccggagtgattatgaggcagcaggaggtcctgaaaagtcacgggcggcccagagttaaccttgctccttgacccacctgttggcagacctttgctgatgctgtcattcgctctgagtccccaaagacccttggttacttgtgctgtctatcgagttgcatctgtaaatgtcatgagtgtgctgattaacacaggcgaggcatcgagtgatgcctggtgatgctgcccagcctggattagtctagatttgtatttctcccacttccatcctattaatccccagtataaacttggctaaagttttccctgactttttgggttgattccattatccctttgcgtgccctgccagagggcaatatgtgtataaaggtcttccccaaacctgaactgctaaatgattaacagtggcttgggctgcttaacagggtcagattaaagcgttgacctttatcctgtaggtaagaggccaagatccaagtggagaagagattttttcaaggaatgaaagtacgtgagaaaatggatgtgtagacttttagatcaggagctattttttctttttatctttttgagatggaatctccgcctgtctcccaggctggagtgcagtggtgtgatcttggctcactgcaacctctgcctcctgggttcaagtgattctttttttttttttttttttttgagacggagtctcactctatcccccaggctggactgcagtggtgcgatctcagctcactgcaacctctgcctcccgggttcaagcgattcttgtgcttcagcctcccaagtagctgcgcttacaagtgcacgccaccacacctggctaatttttgatatttttagtagagatagggtttcaccatgttagccaggctggtcttgaacctcccgacctcaagtgatctgcctgccttggcctcccaaagtgtttgggattacaggcgtgagccactgcacctgtccaggagctatttttcccatcaaggttcactaacatagggaaaaaaacaccaagttgatgaaaatcaacttaattgagtgttttattttgagagatcccacacctactagaatcatggcaggattgtgacctctgacaccagacagacgtgagttcatactcaaggctgcagttcctagttgtgcagctttggcatcctgacctctctgaggttgtcacctcatcagaaatagaagaccattggttcatctcagatccttttgaggattaaattagatacaatttatgaaagctagtacctcttaggcacttaataaagacagtttcccttccttctttctcttctgcttttaaaaattaagatttgggagtactataaataaagccaatgagaaaatgtattttggtgtggaattctggccagttaaaggagaaaggggacaggagggctccagtcagaagtggcaggttcaccagctccatgcgaatccggcaggcctggaaggttgcaggcacaaacaaaataggcagtagaaagcagtctttaaattaaaaaaaagaataaggcttacaaaaaacatcgaccgagtttgttggccaaacatttcaggcgccgtctgaagactgggagcccaggaatttgggaaatactaccctttcttcattttcagtggtagaaaccccaaacttcctgctctagaacgtggggaggccattagttttgttttgttttgttttgttttttggccaagaaaagtggtgcagtttctttctctgggttgatgctgccatctcatgtctctacatggcattgcgacttcacctctggatcctatcagcccagtgaaattgaactgagagttagaggtgctccattttagcctgaggctccaaagacgaaggtatgtaggtgacagtgttttaaaaaacagtttaaggccaggcacggtgcctcatgcctgtaatcccagcatctgcctgcctgctgaggcaggcagatggcctgagctcaggagtttgagaccaccctgggcaacatgatgaaaacctgtctctactaaaatacaaaatattagccaggcgtggtagcgcacacctgtggttccagctacttgggaggctgaggtaggagaattgcttgaacccaggaggcagaggttgcagtgagctgagatcacgccactgcactccagcctgggcaacaaagtgagactccatcttaaaaaacaaaaaaaaaaacccaaacaaaaaaaaaacaaccaatttagcttaggtatacatttttttctttatagtggcaaagaatctactctttacatttgtctccctttttattgttacagtgaagctttcagcgagagtgttattggatgtagttaccagatacctaactaggaatttctgtctgcgtgctgtgactccaaccttttccttatattattttatttgctttctggaaaattcatggtggagatactatgccagtagattctaaccttgagtttctgcataaaatgctcatgaaaaccagcattttgcccctttactcaatatttgccaatctattattattctttacaattcttttgccattttggttttgttactatggagatgtttgcgaacataccttgctggaatgatttggaaagaggctaggatttgggaggtgtggagatagtgtggtacccacagaaagagagcctggggggcttctggacaagggtgaaaaggaaagaaggcttatgcagctgttcaaagatagcttgagctaagggctgtgccacaggtgtcttcttcaggtgggtgggatgggaggggcacacctgagtggaattagccccataggcactgggggtggggtagtcagcattgatgctgaggtccctggaaaccctggtgttttatacctgctgtgaccccacggcacctgggatgtgctttgcacataataagcaaatgagcgaatagtagggaacagaggactggaacagcagagattaggaactgaggagccacgtgtgctctgtaggaggagggcaacctgaatttgcaaagcactgggtctgactcgtccccttctgccagccgggtcaggcctgggagcactgcaggtcagctggtcccctggtagggacccacttcgagaggcctgttcagattcttgcaccaactacctttgccatctgaacaagtcacttgtgctcaacatcagtgtcttcaagtgtaagatgagaggaacctggttcatttcttttttctttcttttttttttttttgagtctgagtcttgttgtgttgtccaggctggagtgcagtggtgtgattttggctcactgcagcctcccgcctcctgggttcaagcaattctcctgtctcagcatcccgagtagctgggattacaggcatgtgccaccatgcctggctaattttgtatttttagtagagacagggtttcatgacgttggccaggctggtcttgaactcccgacctcaagtgatccatctatctcagcctcccaaagtgttgggattacaggcatgagccaccacgcccggccaagctcggcaagtttctgtggctctttgcagctttgagcctgctgagcttgagaatctatgtgcatcagacagacgtcctcaggctttgaccgagcaatattgtatcctggaagttgccctacggaagccgtggttgatgtgtgtgtgctgaggtttagctcagaggatgctcactgcaggcagagaagtttagacagcagaccattgggtgcagcctttgggtacaataaataataagagattagaataggaatggtgcatccacctaggaaaatgctgagtggcttctaaacatgtttttataaaataatattgaatgatatagtaaaacttacacagttaagtaaaaatacagtttaccaaacaacaatcccatttttacagaaataaaagtgtaaatacatgcacagaaggaagcctggcctgctgcataggaagagtgggcctccctgggaggcagattcctcagtggtttgcttttccgattgtcctactaggaatggatatcacttttgtaaaagggaaggatgctagaagttgactttaaagggttcacttattttagtagacccttcctggctcctgctgtgtggggctccctcctgaaagcttcctgattcccccaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtaggttgatcccaacatggacaggtgtcccgtcttgccagtcttggggtagggggctggggtgccctagtgacaggccggaaactctctgggcaccgttttgagtgcagacctttgccctccagccacagggcacctgggcagcagatcgcccaagagaatatgacattgttagtagacccagggcttctctaccacagtgttgtctgtagaaggtggcaagacctagcatcagacgctgtgggctttggcttgctcaaaacctcagtttgaaggatgaccataaccacgtttctcttaatctgtctcagtttgcaactttagcaaaggaaggcatctcaggcttatgagaatcagagaacattgcatctttgaattccctttagacacttttaagactcagagatgtttgtgtagttggattcggtgtggatttccttttccagcatccctgcccctgtgccagggccctgggtctgatgttatgaggtccaggtgcctggggttctcttctgttgccctctcaaggcctcctaaatgaggactctacctctggctccctgccaaggcttgtgcctccaggcctccctgcctgtgagagaaggtggcctgccaacttccaggtccccctgttgagaggttggcctgtctctgcacccctgccaccttgtccccaggtagactcagcatcctttgagtgcaggataatgagcaattcagagtggcagttgggcaccagcagacaggcagtgcatccgggtcaaggaaggcaggatgatgagcacagattctagattcagagaaagtcccagaaactgacatgtttgctgtctgccagtctagagagctgataaggatctgtcttgggaggaattgggcctgtgtgggtgctcaggtgggaagcgagtacctgggaacatctgcttgaataaaagatgagtgaggcagagaacatggtttgtggcaggcagatcctggctcctgggacgtggggtgcatgagaacttcagggcgagacccatccagggctgaccactaactgctgtccctcttcccacaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggtttgtgtgggagaagaaactgggttttaaaagtcacgtgggtagtgtggtgtaagggtgtgggctgtgttgtggtggggaagaaatgtggtgtcattggcatctgggtgccaagatattgggacaaatgggacacagaaaaggggaatcttttaagaaaaccagagtggcatcttttctttctttttttgagacggagtctcactctctcacctaggctggagttcagtggcatgatctcggctcactgcaacctctgcctcctgtgttcacgcgattcttccacttcagcctcccgagtaactgggattacaggcgtgcaccaccacgcctggctaatttttgtattttttggtagagatggggtttcaccatatttattggtcaggctggtctcaaactcccgacctctggtgatccacctgccttggcctcccaacgtgctgggattacaggtttgagccaccatgcctggccgagtggcgtcttttcttttccatagctctattatgggcaatgtacctttggttgggcatagggctattttttcccctctcatgcttaaactgaatcaggtcatagtttatgataagagacagggaagaactggcttaaatcgagagtcaacaaacttgttttgaatgggccaaagagtaaataatttaggcttgatggactacacagtctctgtccccactgctcagctctgctgtggtgtccaaacagccaggggtgatgcagaaacaaatgggcatggccgtcctccaataaaacctcattcatggaccctcaaattttagttttatatactttccatgtgtcacatgtcaagaaattatatccttcttttaatttttaaaactatttaggccaggcgcagtggctcacacctgtaactccaccactttgggaagattgcttgaggctgggagtttgagaccagcctgggcaacatagggaaactttgactctacaaaaaaataaaaaaattagtcaggtatggtggcttttgcctgtagtcccagctacttaggaagctgaggcaggaggattgctggagtccaggtggttgaggcttcagtgagcaatgatggcaccactgcactccagcctgggagacagagcaagactctgctctaaaaacaaaaaccaaaccaaaccaaaccaaaaaacaaacaaacaggctgagtgtggtggctcacgcctgtaatcccagccctttgggagacgaaggtgggtggatcacgtgaggtcaggagtttgagaccagcctggccaacatgatgaaaccccgtctctactgaaaatagaaaaattagctgggcatggtggcgcatgcctgtaatcccagctacttgggaggctgtggtatgagaactgcttgaagccaacctgggtgacagagtgagactgcatctcaaaaaaaaaaaaaaaaaaaaagaaaaaaaagaaaaaaacccacaaaacaaaaccatttaaaaatgtaaaaccattcttagcttgaaaccctacagaaacaagcagcaggctacattgggtccacagcctgcagcatgcttacccctggcttagatattcagaaccactggtgaatgaagaatgtattttgctttagaattttgtgatacaacttttttctaagaatatatatcctaatttctatgttatatgctgtatgtacattgatcttttaagatttaaaaggaaaatctgtcgactgaaattgtcttatatacaagatgtgcaagcagtcacaccctatcccacctctctgtgtttgtctatgagtgcgaaaaaacacagcagacccagtattttgaaaccaaattagagcagcaatatttgtgatagtgtattcagtggaatgcaggtaaagaatttatttttctgttctatggaaatgaaaattcaaagatcatacaaaaacagaggtgctaatgtgtttcacgttttaatagtcttggtttagctgcttcaaacccaagtcatattttggcggacctgaattgtaaggaataaattaagacagctttttgaaacagaccacttagaagtttatttcagactaacttttactaatactttagcattaacttgtagacagctctagttttacttccaaataatgtagtgatatacggatttttaaaaaattatgtgtaacattttatagaactctgctgtataaagcatggacacttgcattgggagatttattttagtgcttctggtttatttgcacattggcttgggtagtaggttctgttgacattcagaagctgtcagaatgccttaccatttttcttgggggaggggtgggagaaggtggttagtgtataattgttccctcttaaatttaaatatgggacaaggaaaggaggtaattgttgtgcttttgaattccagtgggcatcttttgtcctcgtgttcatttcgagtctatcctctttcccctaaataaaattctcctttttttaagctgcagagttcagcagcaaagtcatgggagaatggggctgtctcagggcgtcacagtgggatgagacccagcggcttataccggggctgcctaatattagaagcatcactcagaatgggtactgctcaggaagaaggggagaccttcatgtttcactgagtttatatgatctgagcacacactggctgattggagttgggggcacttggaggggacagtccagaagtgtaagatgattgtgtgaaaccagccagaagtggtgtctcgttttgcaaggaccatgggcccgccatgccaggaagtaacatttcccactcatccgtgtgaatccaggaagtcggacgcagtggaaatggatgagatgatggcggccatggtgctgacgtccctgtcctgcagccctgttgtacagagtcctcccgggaccgaggccaacttctctggtgagcaagcggggcccagctgggttctgggcatggtagaggcccacgacaaacatcctctgtgcagagcagctagttgcctatgtcaccagcctggcaatagaatgtccagggacacctcccactggcacctctgaccggctgcatgccatggagttagatgcttccgttctttttcctcagtttcctcacctggggaggagtttcctggtacattgtgaagatggttgagcatgggactgagctgcagtggccagtggagtaagttcttcaatgggagtggctgagcccagcactttggtggggtctgaatgaggccaatagaggaatatttagttcacaaagtagcaatatgctaaatggtctcctagtggcctcagaaaattcatgccctcattccacgtgcctaattcagcctcataaattagtgtgggcctatgggacaaggacccggaataaatgagctaaattctaaagtaaatctaattgcttaataaaaaccagtgattcaacttcaaggcaaatttattaaaacaaaattgctatagttgcaaccccaaaatactttatcaataatatgagggaaaaaagggttgctgagtatttgtcagtagtttggcaagactggtagtgaacctgaagttttttgggaaattcatggcagggctggcctaccctactcccagggaagaacttcttcattggtggacacctaactgaattgcaagctacttataaacttacaggaaaatatggagttagctctgagcacatagcaggaggaaagtggccttcataagtatccctcataaggaatctccctaaatagaaattaaacataaaggagagagaaaacttactttcttgactcaaagtcagctgtcaatgactaggctgccaaaggaagtcattgcattatgaggacacctagctgtgaagcttagtattgcatgcctgctctattagcgcagccaaatagggaagaggaaaggagttaatttctaagttctcaggagagtttaggagatctggatggttgggttaacagtggaaagatctaggaaagtgtcctaaagaaagaaaagaaaattattgactccagttcccatcatgagggtatgtataatacatgcatacacaagtgcacatcaacgtagaagcatctcactgatgatatgccatcatcctgacaattttaagtccctttgtaaaaaaaaaaaaaaaattgtctattaaattttttttgatgacagtatattttttatcttatagctgaagtcagtggaaatataaggcttccttggcctaattatcttgaagtattctgcaaagtgtggtctatacaacaaccaaaaccttgactaagagagtcgtagatactatttgcacaaatgccacatagtccctttggtttctgtgtggttaggatggcatgtgtgtgtgcatgtctatgtatagaaaacaggattataaatatttcttaaaagttcacttgtaagctctgagtgccgtgcatttgtagagcagtactttattttcatggtatagaaagtgtatttattgcctgtgtcctagaaaaacttatgatcaaagatggagtcacaacttacacattaacttataacttatagataacgttttgctttatgttttgctttctttgtgtgccagtcaaaatctgccatgcagatttcatgcatttgagccattgtgagtggttcctatagggaagggctaccgcatttgtagggtgtgcctgctgcttgacctgctctttgtcccggagtcctgagcatcctagatgttgccatgtagtattctgctcactgcccttctctccctgatcgttttcctatcagtggatgtgcgtgggtctttcacctgttggcctgtttaatgattcttgtcttctgccctgaaggtgtacccttttttaagcacacatgtacatgtagtaatctcttggttcccaggaagggacagtgatagctgtgagacatgacaacagtatctgggcagggaagagttcttcctccatctcattctttttgggtgggctgcttctaggatgtgagatgtaaggagagcctggactagaaacatggaaagatgggagcctgtgccgggtagatccctgattagcattgaaggagtctggactatgagcaagaggagagaaaggcagcaggattttatcctggccacaagggatgtgctagtagaccttggaatccagggttagggggctctgtggaacgcccctgttgggagttggggcttttgaggacaggtagcttttttccctctctcttggtatttccacatatcagaatttcagattcttctatattataaattcacctggatttttggccaaggagtgagagtctgggttgggcccatgcagcctgcagatgtgctgtttaaaaacggaagattctccatgtctgctgatgcccgtcctcctgctcagaggcattcaggagcccagcagctgcttcagggccatgtcaggcacgaaagccccctgccaccttgcgatgaccagaattgctcgcagagcttgtctttcctcctccaaacatgttacttcttgattaaagcaggttccacctgggctgcagctagcactgggaaatgttgtgcaccctcctgagagttgcaaaggctgagttgtttgttccacccacaggtttctatggactggcctgggtttagatgattgaagagcatttttcaggaaagctggtcaagaagacctttaagttggcgtcagctgtaggaaaatgctctgggtggtacccaacactctgggtgtgcctgttctcaaccaggcctggaggctgcagaggctttgcccttccccctccccatcccccctttatttaatgtataaagtgagaaacaggcagcactttgggaggctgaggccagaggatcgcttgaggataggagtttgagaccggcctgggcaacatagcaagaccccatctctaaaaaaaaatttttgtttaaaaagagaaatttcagttaggtttctctttgtatgaatcctatacaaagcaaacttgcagtgtgtatctgttggtcagtgatgaccaggtggctatggtaggaaatgtctgcgagggtagagcagttctaccaagagaaattgctgccatgaatgaactcctctccatgtttaccgaagctcagaagggagagtttgcccagggacacgcccgtgagcgtcctctcatcttttcttcatctggccagcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaaggtacgtgattgtggtgtgagtgggagcccaggctggagcggatgatgtctgtgtggggacagccagccgtggagagcaggggaccctgcaggccctagatagtcttgggttcactcccatttcggttttttattgctgcttctgttacctggtgatattcccaggattctccttctcctatttaaagcctcttctgttttagcctccaccccaatccctgccttctttcctgtgtttctgcagaggtctgcgtgggagaggcctccagtagggtcttagccacagcatggagcactgctgttggccactaggaccatctcttagattggggctttctagcccctggttgtaagtttctctggtcccagagaacccctttcctggaggtttttgttgggtcaggccggggacagcagccagtttgagtccccactgggtaaggttgagcgagggataaggagaaagacatatccactcaccctgtcttcctttcctgtagaactctgtgaaggtgatgtacaagtgcctgtggccaaactgtggcaaagttctgcgctccattgtgggcatcaaacgacacgtcaaagccctccatctggggtatgtgcgagcccagggcctctagcctagggtcgcgtgtgggtgtccctccaccctgccgagtccctgtgacccacagcccacagtgctttcaggaacgtggcttgctgggaacaccccctggtgtctcttcctggccccctgagaaagacatcctggtgaacattgttgctgttgatgggaagggagctctgtccatcttggggatgtgtcttcttgcctcattgcaggaagcaagatgttttagttctgggtagaaacggggtcatttggtttagttgctggtgagaccccgtttccaagatgtttagtggccaagcactgcaccacccactcttccttgggagtgggtctccgctagccccaccctggtgcctccgccgtgttctgtgcagagcgagtttgcaggctgctagtggtaggagctgactcatggccctgggggagaaagcgtgactgcaggcaggtggggcccagagagggctcgtggtcgtgctcagtgtgggatgcctcctgccagaggagaggttggcacatgttccgggagagaatgagccttaggtgccaggaaaaataattcccgttgatgtgcaacacataatcctggtgacacccgtcaggagcgaggcacctgggtgttctcttgggctccgtccctggcttgctgggtggcctcaagcaatcacttccctccctaccgcggtccccgctgggtttgaagggggcagggtgcccctgattataccgcatctccctcccacacagggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggtatggggcggggctcgctggaggctcaggctcatagctgactcatcacgggccagcttgattacaggctaccgaccaccctgatggaaggctgagccctttggccaaattgctaatctcttctacaaggaaacaaaaggaaaccgaattcactgctcaataaatgtgggaattcctggagttatctacattggcagctgtcatgagtggttactaggaatctagctaaatccctaagtaactgggcgatggatttgggtgggggaattgtcacacctctgcttataagagaggatggagtcgtgtagttgggcttcccacgtgacgtctaggtcctagaattgtgttctgtggacagacagtccagcacgcatgttttgaatacttcctgcgggccaagaattggactaagtaagactttcaggttgaagaaggcttagtccctgcccttgtggagggcatggttcagattgagagagaaatgaatatgtaactatggttaattataataaccagtcaaagtactaattactagaggcatgagaaggtgttgtaggtaccagagggaccaacctattttgcccttgtggatgagaaacttatcacagagggtgatatttaggatggtcttcgctgcatgtagtaggtactcaaggaacatgcagcttgctgtgtgctgatatttcttaaaattcttttgtgcctattttatcagtctgtgggccaatttgcaaattagttattaaaaggtattgctttcagtgagaaagctttatgaaatgggccagccctcctccttgttagaatgagtggccgcttagcgatttcatgtttggcccacttggagctgtggctgacctatggggcccagacatgtagctggtgttttcacaaatagccctgaacctggatacccatgagcacactactactctcaagcagttgctggaagatcccatatcttatcccagccatgccccctagacgcagaaggcttggggcctcttttggcacgtgccatggcatgttcttggtaggtgatccagttgagaagttaaatcttctgcggtgattaagtcatgaggctagcacgtagaccagcgctgagggaagggttccaggatgagattggagcctcgcaataaggagactactgcaaggcattggatgatactccagtgttgtcctcgagaaagccgagtgtgtcccagctctttctggtcattgcacttacgcagagatgcaccttctgctgctgtcatgaggctgtggggattgtgggcagactctgaacacttcctgagctagaatccgggctgacaccctcgtcttccgcaggctctgccatccttccagatcccagtctcaccacacatctacaccagtgtcagctgggctgctgccccctccgccgcctgctctctctctccggtgagtgtgcgggcagcacggctggggcctcgtatggccgagggctctcccacacatcccagggctggaggccatcccttgggcacggggcacgtggccacaggtcggtgtggccatcttgctttcagcccccaaacgtgttgaagatgtccttgtgctgccccctccctggcactccccatctggccatagcccctcgcggaggtggaaggaggcgcttgtagaggatgtccagagcaagcaggtttcttgccaagaaaatcaccaggcgaggctggggtcagttgccccatcagctcctagtgcccgtgggtgtttttaggattttaatgctgaggagaggaagggggagaatgtggaggctgtgtgggctgggtcagaaatctcaaggccactggagacaagggccataggtggacccccaactcaagtaagcgggaagtcattttgaactctacctagcaggcgctggtcttgagttatctcctgcagggcggtgtcacactgtaaatcagattgccagtgatgccactgaggcagtgtgaggcttccaggcatagcggctccgtctaagtcccctgcaggagagcctcagagggggccaggtccagtggctcccctgtccttgtccttggctgggtcctgagtgtggcatgaaggcctgctccttcctcactctcctgccaagagctcccctcggctggagtgttctccctgagaaggtgcgaggccttctgcaccaggagctggggacgggtggctgcctgtcttttaggatagctccctcacctttcctgaatgtccctgtgctcacagcccctctccccacgcccaggtccggagccggtcgctaagcttcagcgagccccagcagccagcacctgcgatgaaatctcatctgatcgtcacttctccaccccgggcccagagtggtgccaggtgagatgtccgctgtcgtcccctgccttctggtttctgtgccctgtctccagtggcgtggactccgaccccacccagatgaagtcaccagggttagtccccagagaggagcccagatggcggatgcaccagatgggatgactgtttggtcctcagagcctctggcccctggtcctggtgacttttgccgggagctgcccctttggcctctgcttgttctcccagccccacttggccactctcctgggcccaccacctgtgtggggctcgatttgcattcctctctttctgcaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgattt

SEQ ID NO: 38299 - DNA, 25892 bp, Homo sapiens
cgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggagggggggggtccgctgcccgagaatgggaattctcttcactagaatatggagactgttcaatcaccagggtgaggagctcggtccgcgggcgtacgggttggggagagggtcagctcgggccggctaggtgggggtctccgaatacttcggaatgtgggcggctcggtcgggcgccagctcagcgcggggtgcaggctgcgcggatacgggcccgggacggttcggtcccggctcccgagcttggggatggttcctgactcgcagccctttgtcttaggagaccttcctaagaagtcttttccgtaatagacccattgctccgatttcgaatgagagtggtaaaggtttcttgccctaggtccgacgtccctgagtagcacggcctggcctgtctttcagccctttctttgctcaccagttgtgtttggacaccacatagaagtgctggggtcttctggaatgaaggttatagattgctgccctaaccgcaccactgagcgaccgagggttgcagaatgcggaaaacgggaggaatcgctcgacttgtccattacacctctggtttatgagcctgccctccactgccacccgtctttgtgtgtgttgggggcagggggggttcttctgcctcctgaatagagatggacttctctccatttgttttacttattatatctgtgtttaaggttaagcttaaggtcatttttctactcgtgtgggttattagacacagtttttgtttgttttgctgggttaaaaatgttaaagtgtttcactgaaagttttaaaaacataccatatgaaacatttgttaaccataggtaactagcaagttactaagtgtaaagtgtgttatatagggatgcttaagttcagccaacttcagacatggccatgaaatacctatcaggcttgttaaaatttgttacaaaatgactaaaactggggaaagagaatacaattttaacccaaagactggatacttattaagatacagtggtgtacttttgtttctttttaactcaagttgggtggttcatcattccgctgtcaggaacttagtttgtgtttttctgttgtgtaagctgatggtgtcacgtcccagttttccaataaagacttacgtgaatggtggcatctattatgtacacctactactaccacctcctccttcatgatctagctgctcttttaagaagcttaggggaagcaagcagaactagaacttgtgatccctaatgtatcttttacgcacacacacacacacacagatgtgtaggtcacgtgataccgaaagaaagggcagtatcaatttttctgataagaggatttttcataaagtagagaaaatcagttctaatcagcactgtctctgactggactggctgttagtgttgggagcaggagagtgggaagcagtcacttgaactctcaggttttctggtctaggttttctcacctagaacaccagggatctgtggagcttccaaatcttgtaaactttatttctacattgcaaatattaaaacgtacattgctgtaagactgatggtacttatagtagataagatctattctagttttaacatccatcattttgtattatttttagcaaagctagtgtttcatctgctgtgaggtttagcaagactgtgaattgagctctagtgctgccagaaaaagagttatcaccactttctattttgagtcaatgataaaattatttgtttctgtaagttaagaataaatgagaactttgccaacagctccttggagtagtaaataataagggtgtgtgctctggtatcactacaaattgctaatagtagtgtttttataacctgtattttgtggtaatttttgacgggacatttatggcagtttggcggaaattaatagagaaattaatgaagttaagttctagaaaattagatatgaatattgtgaaagtgtgaataaattatttattttctgctaaacagtgtggctgtcttatcaatagggtcacttttccgaatatccaccatttaatctaatgccagatatttgttgggttttgtttttgtttttgtttttttgagatggagtcttgctctgtcaccaggctggagtgcagtggtgtgatcttggcccactgcaacctgtgcctcctgggttcaagcgattctcctgcctcagcctcccgagtggctggactacaggtgcgtgccaccacacccagctaatttttgtattttttgtagagatggggtttcaccacgttggccagaatggtcaccatctcttgacttcgtgatccacccgccttgggctcccaaagtgctgggattacaggcctgagccatggtgcccagcagggttgtttttttttttttctgtataggacatatataagttagatatgtgttggatgctcttgttttaccttcagtggattcagaatgcaatcttactttcttttcatagaaactcttggaaagtatgtttcgggagattacagaatttgccatctgatgaaacttaaactatgcagtatctcctgtttctgaaacccctcgagaacagctttttcagttaaagctcagattgagtgcacagtgaaagctatttgtataccgctcgaactagaaaaaccagaggtcacatttagttgatactgagattcagtagagtacaaactttatcctagatgctgtcatttaaatcattttattttattttattttatgttttaacaatcttttgaagtagttatttcccctgaaaagggaaaactgaggcttaagtggaatgattttttttccccaggccatgcaactggtatatgccagagccaggcaagttaaaaccctgaaggaatctcttaaagaagagattgacatcatttttccctccctcctcctccccccattaactttttcagttgctaatctctaagttgtctttagaacttcgaaaagttgccattagtaacttttttttatagaagagcttgtgatcagtggtttacttgttctcaataaacaaatattttaacacctatttagtccaggaagtgttctacatggtgggataagggaacaaaacagacaaattccactgcctttatggagctttcatgtagtgttgggagacaggaaattaactcactttgtctctacaagtaaaataatagtggttaacacttgtgcaaggttcacacaggttgtttgatttaatattcacttagttgatttactctttacaacaaccctacaaggtagatattattccccttattttacaggggtacggaaacaggtaacttgctttaagcactataggtaaaagtgatagacctggattttaaccacgattacgtagtgccggagttatttctcctacgcacacacacctggattttaacaagattatctagtgccagagttagttctacacacacatgcacgcacgcacatttgcacacaacttcgtgtaagaaggactttgtataagaaggactcagataaaaagaactgactgatgtgaactataaaagaagttgtggaatttcctcattaatagccttgtattgctctcttggttggttgctagaaaaggaattataagtatgaatgggtgcaggagaagctgcctgtgcttcaggaacctgatgctgaggaagccacctctgtttctggcttattattgttgttattattattattattattattattagggagtttaaatgtgtagagaagagtacatatggaagctgagtagccaaggggtagactgtgtcttagcttctaatacagatgctcctcaatttgtgatagttgataatttgtgatagatagataattgaaaatacagtaagtaaaaaatgagtttaatatgccagacttactgaaaaccatggctttagcctagcttgctttatacgtgctcagaacatttatgttagtttacaggttggcaaaatctaacccaaagcctattttataataaaggttgaatatctcgtgtaatttattgaatactgtactgaaagtgaaaaacagaatctttgcatgggtactcgaagtatggtttctactgaatgtgtgttgcttttacaacatcacaagtcagagaccatttgtaaaccctttttgcatgctctgtggaagtggagctaggtcctttaaacgtttttcttttgccactgggcaaaatgttaagttttgtcagtaggctgcactggagaggcattgtaggaggaaagggtgtttgtacttagttatagtgtgctttcttgacgggctctgcttgtagcatgaacaccgtctccaaggcctggctcttgtactgcatagtggtcagcagcagccaacagcttcccctagtacccgtcttagttggtttcataatggaaggtctccagtgaaatacctctcaataaacagttttcctcagcaccgaagagggaggatttttgggcaggttccactggcacctcaccacagctacttctctgccattcagtgagccactatctgtgccctccaacgagatctgcatcttaagtctggagggagggggaggacctttatctcaaccctagggatagtgagtgcttcttaaatttgacattcccataatcttttagccaatctctcattactccagtcccctgtaatatttttttgatgttgaactttccaagttcaaattattgtgtgatttctgcctcctgattggatctctaattttgccatgtgtaatcattgcttttttttttcagcaacctcatagtgcaaaagaaaatttggttattcccctgaaacttaatttaccattactgtaatagcaagtttattttcaaactttctttttattgttaagacttttaagttttaaaaattgaacttttaatacaaaacgacttaagcagatatctctctcctaacctttatattttccagatctgatttatttattcatgaaaaatattaagctcatgctttattccaggagctgtcctatggactaagagaactatagtgaatatgacaaatggaattttttgctctgagagacatagaattaatagggcttagtgatagttcagatatgaggtaaaaatgatgaatcaagaggactctccatttatttgccctggtgtttttgtgttttctgatgttgtatgattcacagagatagtaattctctacaataacaattattattatgcttaatttattgactgatgagttgggggaatatatattaacttttaaaaactggcaatgaatggaactggtagactgcctgtgtcaaaaggaaatgaaggaaaagggaaacaagaagcaattttcatgacaaaacagtaaagtattgattggtatgttaaagcctaattggtaactcacagttccatcaaagcattagaacagtgcagttgttgtggcttatttgagtaaatacaggaatgctgtgacatagtctaaaagaaaaatcatactaagcagtaaacttctgatgattcttgtgcatcaaagagttggaatggctgaaagttttattgcatttgtccacaataacattcttgtagtaggcatattgggattctatgaagtctttatttcgaagtgcattatagcactttttggctacaaatttacattttgtatagatgcttttccatcttgctaatgaaaggaacaggctgtggtggtgagagtaaggatgttcagaggaaattgatctactattaaaaactttgtgactaatctgaccctattattgagatgacacgtttgtctttgagcccattgcacagtttggtcttaattttatagttctcattgtgacccacatgctatgtcttagatttaggaagctattaaaaatggtcattggtggccgggacgcagtggctcatgcctgtaatcccagcactttgggaggccaaggcagatggatcacctgaggtcaggagttcaagaccagcttggccaacatggcaaaacccctatctctactaaaaatacaaaaattaggccaggcacagtaaacttctgatgattcacgtgcaggtggttcacacctgtaatcccagcactttggcaggccgaggcaggtggatcatgaggtcaggagttcaagaccagcctggccaatatggtgaaatcctgtctctactaaaaatacaaaaattagctgggcgtggtggtgcgcacctgtagttccagctactcgggaggctgaggcaggagaatcccttgaacctgggaggcagaggttgcagtgagccgagatcatgccattgcactccagcctgggcgacagggcgagactccatctctaaataaataaatataaataaattaaaaaattagctgggcatacggcgagactccgtctcaaaaaaaaaaaaaaaaaagaaaaaaaaaaaaagaaagccgggcatggtagtgcctgcctgtagtcccagctgcttgagaggctgaggcaggaggagaatcgtttgaacctgggaggtagaggtttcattgagccaagctcacaccactgcactctagcctgggcaacagcgagactgcgtctcaaaaaagtcattggtgctttattgtgaaaatacaaaaaaactcaaatagagctacgtcttgggaggaagcaactagaactttgtaatgaatgtagtttgtaggtgtttgggtggagtaaggaggtaaagatcctctggatcatggattcttcattggaatggccctccagagatctcagaccacatgactacatgtggtttttttggatattttccaggttctgcttatgtttgattggagtttctttcctcctttttgtttttgaagtattttaaccatttggtaagaatatgatatgttcaaatatattagtttggtttcccttgattgactttagaaatctgcttaggtcttaagagtttgggggcatggttgcatatttatgcatttgtaagtatataggaattcattgaatttgtaaaataggtaggcagaagagtaagattgtagtgtggagaatggcatgagcaaagttaaatgattggaaagtttatgacatgttctagagactgagtagagcagcttttctaagttttagtacgtaggtcaagaagagttaggggaagatttgggctaaggcttagctagctttgtcacactcatcctttttcatcatgtttatctaatgatcttacctggatttagttattcactttcaggtgcagacagaaggttatgggtcctccaaagcttcagaccttggctaatttctctcctcttgttcatagccattttacctttcatctttccttctaccctaacaataacctaacctttcacctgctaggacttccggacattcttaaccttgtagggcaggactggatttctttcccggcccaaattccatggctagccacttcatttctttcttatcactgtctccgacacgcttttctctattaacattttccaccatgccagacatatggattctgtttttttttttttttttttttttttggagacaggatctcactctgtcgcccaggctggagtgcagtgacacaatcttggctcactgcaacctctgactcccaggttcaactgattctcatgcctcagcctcccaagtagctgggaccacaagtgtgtgccaccacacccagctaatttttgaatttttagtagagacggggtttcgccatgttggccaagctggttttggactcctgacctcaagtgatccacccgcctcagccccccaaagtgctgggattacaggcgtgagccactgtgcctggcccagacatgtggattcctaccctgtatcatctactataccttctctctccagtgtgccttctttatttctaggcactgttaaagaaagatttaaagcagtttaaatcctaatccaccacaggataggttatctaatttcagcttattgatactctagttcattccatacagtggttgtaaaagatgatgcatcttgaaactgttaaccttttcctttcctcagtaggcaactaagttgtgttataagatgaaatcctggaatgagtaatttctgccatctgctttatcttagacttgtctgtgtgttatagcacatggttttgttcacagcagttttaccttggtgatcatgttcagctagtggccaggtatgataaagaattttacctctgcctcccaggttcaagcaattcgtctaccttagcctcccaagtagctgggactataggctcacgccaccatgccaggctaatttttttgtatttttagtagagatggggtttcaccatcttggccaggctggtcttgaactcctgactttgtgatccacctgcctcggcctcccaaagtgctgggattacaggtgtgagccaccatgcctggcctaagagtctttttttttttttcagtagtttttgcctagctagtttttcctaacagaactgttagaaaagcaccaggtttggaattaggacatagtaaccaagtcctaaggacatggctgaagtaaggagaccacttaaaaaaatacctgtactaaagccagatgaggttttactttaaagctatcattttaggaggctatatagtttttccactggtatgtcctactattattcaatctattctttgaaactcagaagttctttggaaacaaatttttaaataattcttcatatttcacttaacaaaaaaaaaatggcactcattttagataccttttaccttatgaccaagatgatacgaggtggctcatctcccactttaaagtcaagttcatcttcagagtttaaaagatttgccaccattaggtggcaatattcaaaatggtgtacctcaggctctgaaagcaattataaaagaaccgtagcaaactattttgaaaaaatggtaacatggttggaataagtgtttaacctccttagctgattacggcccttgtaagaaactgagagagtactgttttttacttcgttgtctctgtgtacattatttatacatatacacattttttagtcattctttattgttatatattatagattcttgcctatgtttttgtttccttttggacttttcctgctaattttgtactgtttttagggtcaaagtagttgtattttctctggtatttcattggtcagagtaattgtattttcttcccaagtattgagaagcccatctaaattctgccccgtagctaatacattgggggaatggggtggaggcgggggcgggatatattcccgtaacttaaaaataagctgacattttgagaatgctgtgattaaaaatcagtattctcctgggaagctaaaaactcttatccaagtcagagatcagagtatagcctgataatgaattctagttgtgttaaaaatgtttatgagtgcgtgtattaataaaactgaagaggagttacatcatcaaaaaaggaatgcttaattttgggacatagaaaaatggagttaggcagaattgccatgctatttaaaaactttctaggtgcaaaggtaccttgtcccaaggactcgattacctggccctcatgcaggcatggccttgctctaaagatgaattcagaccaggtacagtggcttgcacctgtaatcctagcactttttgaggctgaggcgggaggattgcttgagcccaggagtttgagaccggcctgggaaacacagggacatcccatctctacaaaagaaacaaaatatccaggcgtggtggtgcacacctgtggtctcagctactcaggagggtgaggtgggtggatcacttgagcctgggaggttgaggcaacagtgagccgtgattgtgatactgcaatccagcctgggcagcaagagtgagaccctgtctcaaaaaaaaagaaaggattcacatcagtcattgcagcctgtaacactccttgtggttgggattccatgctccccaagtaatcatctgattttaattcagccatcatgtaacatatcctcagggatagacttgttacttgtcattcatttttcaacatttgatcttattgtatgttactcatttgctgttcttatttatgtcttagtcatttccatgaattgctctctctgagtcctgtctattctgggatagtagcagaattgtttgtggatctgggagactaaagaccacagacggggtttcgctcttgttgcccaggctggagtgtaatggcatgatcttggctcactgcaactctccgcctcctgggttcaagcgatttttctgcctcagcctcccaagtagctgggattgcaggtatgtgccaccacgcccagctaattttgtatttttagtagagatggagttttaccatgttggtcatgttggtcttgaactcctgacctcaggtgatccacccgacggcctcagcctcccaaagtgctgggattataggcatgagccaccacacctggcctgggccctaggtctttaaattattcttaataactcataaaaggggcaggtggtcatgtcacttaaggaccctagtggttctaagctgcctgctctttcttacaaagaaatagatgactggataaaatggattgtattaaaatgttttatttacttgatcttcctatttttgtataataggaggtgcctatagatcattaggaatttcctctggtaagtggcaattatatggaaaacatctaccatttgaattataaagatcttactctgaggtgttataatcctcaacatttattacttatagaatgaatattaattcaacatttattgagtacctactttatgccaggaatagttgtagtcactagaaatgtaaagatgattaatatgtattctatacagttgaagatgcctcattaagcggagattagtgcacatgtaaataattaggataagtgctagagtagaggtagtgtgggaaagcaggagaaagtgattctacatggaaagctagactttaaaggattggtctaattccctaaatggagaattaggataattccgacatttagtgataccatgagtagctgtagagaaatgtttgctgtgaacatatgtgcagcttgtgtagggagagtgacttgaactttagtttatagatgcccttcaacttgtgatgtagttatgtgccaataaacttgttgtaagttgaaagtaacttaagtcaaaacacatttattacacctaacctgctgaacatcatagcttagcctagcctaccttaaatgtgctcaatacacagacattagcctccagtagggcaaaaccatttgatagcacagtgtatactattatgcagtattggttgtttaccctcgttattgaatggccgactgggagctgcagcttattgctactgcccagtgtcttgagagtgttgtactagatatcactagccttggaaaagatcaaaattcaaactttgaagtacagtttctagtaaatttttatctttttctgggctagcaaaacaggttaagaactctctcctcttcagtgctaggcactgctgtgtgctattttaattgttaaacaaccctgagtgataggtggtatttcccctatcttacaatgaagaaacttaaggtcagagaaataataaaagtcatttgctcaaggtcatataatgccattaatatctccttcagttatctgtttctgtgtaataagctattctttaattttatgacttaaagcaatgatttattatttttcatgtttcttacgcgtcgactaagctcagctaggaagttctaccttggggagtctcctttggttgcagtcagatagcagctaaaattaaagtactctgtaggttcaaccaggctgcacgtccaagatggcttctttatttgtctgtctatcatctcagctagaatggctggaagagataggggctgactggtcatccctttcaacagggtctcaccacatgatcaacttgggcttactcattaaattgcacagcagtcttgggcttgctgtatagtatctgacttaccctaggaggacttgtccaagacagccaggcagcaactgcaatgtttctgatgatttaggctcagaaatcacgtctggtcatttctgctgcatctgtgggttaaaagtaagtcacagggccaccccagattcaagaggaggcggctacgtaagggcatgactatccagaggccatcttggacactagcttctaccacatgctgtgctgtctttgggaattgctttcggacaggctggaaatagatgggtcttacaaatgcctggctgaaatgtgaagagggtgcaagaaaacatctggggaacgtgaatgtctgagagaagactcaaggaagaggagtcattgaaaaaaaataaatgactagagacaggaagaaaacttggagaaagtggtgccacagaagccaaatggggggagggagtcgctgccaccatagccataggttcttagatttgtttttcatgttacagtggccctgtggttttaaggtactcataatttacgattacccatttaaaaaactgacctttttccttcccattcactccactccacacacatgcacccagttgatgccttaagttccagttagaacctcattgatgtaatccaatgtgaaacatttatactttaagtcatttgtaaattgtgattatgtttggtctactttactgagagtaggcttgcctaggaatagaggaaatgtagtgccatggcttcctagagaggtggttggaaagatgagagttgtctctagaataatggcgatggggaaggtgagtataatggcacacttctgctggtcttgctaggatgttcttttgacttctgagaaagtataaagtgccatgcactgaattatgccatagatagaagggtgagatacagagtatattttttcctataattaatctttttttttccttttttgaaaaaaaatcactggtgttttctctatttcagagcacaaagttatcattgttgggctggataatgcagggaaaactaccattctttaccaattgtaagtattaactattttaaaaattattttatttctagttacttttttggcctgggtgatagtcgatcaatgaatgcagtaagaaattacatgaaacctaagttaccctgtaagaaagcaggttggctataaacctggagccagatctcagcaatagttagtagaaagcaagaaatttatatgatattgagcatatagttggcattgagttgtccacttgttttgtgctaaagctcttttgtttgtagaaagtagaaaaatatggccgggtgcggtgcctcatgcctttatcccaacactttgggtggcagaggtgggaggatcgcttaaagccaggactttgagaaaccgcttgggtcacatagtgagatgccatctctttataagatatatatgaatatatatatattttaaaattagctggatgtagtggtgcacacctgtagttccagctactcaggagactgaggtgggaagattgcttgatcctattcaggaggtcaaggctgcagtgaacctcatgccactgattatgtatgatcacaccactacactccggcctgggtaacattaaaaaaaagaaagtagaaaactataaagtagaaactataaagtttcctggaatgacctagtatatgccagatagcctacgacctagttccagccctgtttaaaccctcactcatgttgtaaactagtgggaaaaagatatttaggtataaattataaaaggaggtcatgctgatttgtccttgattaaaaaattgttcaagcaagttagcttccttgctaattgtaatgtatataaacttttttccccagttctatgaatgaagttgtacatacatctcctacaataggaagtaatgtagaagagatagtgattaataatacacgtttcctaatgtgggatattggtggccaagaatctcttcgttcttcctggaacacttactatactaacacagaggtaatgtttcttacaatatttaaaattctataaacagaatgcttggaaaacatctagatttgagtccttatagttaatctttttgaaatatcacagtatgttaatacatagagagtttaagcagagtaaaatctgatttcctattccaaggtcattgttcaatatgtccactatcattgaacctctatagggagaattggtggttaattatgttctgattgtgtattgatctcagaacttgtctttaatagttttttttaatgacttccatctcatagtttataatttcatttctctctatttatgtttgactgagtttagctcaccaaatgagagggttttgatggtttgaatcctagccagttttactattttcttttacaaaacacaattgcacattaaataattgtttttcttttgattataaggcattttagacatagtcatatctttttatttacacattatttcccaaaggaaatttcagacctttgacatttgagtgcttcattgcatagacctgtgaattaaaagactgaccgttgtttttgtagtgttcattattacaagttaataaagcatggtttataagtatataaagctgacttttaagtcattaagaaaccattaagtgtatctgacaacttgatttcctaacactgcattaggcatttaatcattttttaataagggaagttatgtatgattataaaggtatatatgctactgtatacatatgctataggtttcaaattcatgccaacagcctgaaaattaacagttttattaaaataccttggaataaaatgggccttacagtgataaagccacctatcagtaagctgtcaagtgagaggagaggtaaagtagcagttctctcatacatctgccttttggttgatgaagtctgaataattgaaaagatccagaaaatcataataatttatttaaaaattaagatctaggtcccaaaaataaatagtgcatgttactaataggcagtcagaaccaacttgggcatcataaatgttatcataaagtaagtaagttaaatctccatctgttcctgctgatctcttgcttttgggtgctcacggagttgaggaagagctggggtggagctcagtcctgcacaacaatcacaagtctttcatcgcaccttctgataccagtctcatcatcagtttatgaaggggttgtgcttgcaggtagcaggcgatacttatgtaaggaagagagcttgtttttagatagagatttattctttcagttggttgaatttttttttaattgatttctttatcttgtcacattactttactcccatacccgtgcccttttaggtgttcagattgatattaataaataatatctacctggaagtaataaattcaggatcatattgcatgtttttcttgttgatttgtagtgcaaatagatagatataggtccattagcattcaagatactagtttagaaaacagacatgcgttatatatattagttagaatgttaatatcatattctcttttctcttaaaaattagtaaatatattaaaatcgatcagaccttttggcttcacaatgtataggtagctctgattttccaacaataccataagattccaatttcttgatattaatagcctgtatgtcaaataaacacattataaattttacagataccaaattgtataatcactaataatttttttgtaattattttagtttgtaatagttgttgtggacagtacagacagagagaggatttctgtaactagagaagaactctataaaatgttagcgcatgaggtaagtaagtagtctttttacattagatatggggaagggtatgggaatcgatactttgttttctagtttctcatgagggtgctatcaatttcaaatttttaaaaataattagttatttgcgggccacactgctcaattactctgacatctcccagtttggaagtgtatccagaagcagcagaaagattatggagtaagttgcagaactttatttcacttatcctaggtacatttggtttcacaattttcctgggcaaaagtaatttctataagtggctttcattttgcattttgaatagattaattatacagaggattatcattggaaatgagattttaaagtacctgggtgcttagcaattcttgattgttactcagcagactaatatttaaatgtaattgctgttaggtttctctgatattgtccctttgactaaacaaaactagatgactagccacattttcttagtccttgaaaaataacctgccaggcacagtggctcactcctgtaatcacagcactttaggagactgaggtggggggatcgcttgagcccaagagttcaagaccagctgagcaacatggcaagaccctgtctctacgaaaaataaacaaaattagccaggtgtggtggcatgcacctgtagtcccagctactcgtgagactgaggcgagtagatcgcttgagcccaggaggtcaaggctacagtgagctgttcttgccactgcacttcagcctgagtgacagagtgagaccttgtctcaaaaaataaaattaaaaataaataagtagaaataaaaatagatttaaaaattaaaattttttaaatagaaaaatattacggtaacataaatttaaaaaactgaataatatagtcaacttgataactataacattatactgtttatatagtatttagtaaaattgattatttttggatatcttattgcagatgctactttctcaactcatttatagataggaatagaaaagttaatatttagatatatagagttttttatttcagtggaattttttgcaaagcttaggaaaacacggatatctttgtagtgaagttttatgttaattttgttattgatttgatgatttgcttttgagatttgctttaagaattttgtgtatttcaggcaacctttcagggctttagggaacctaagctagtaaagtagttttgtaaattgaggttcctcatttccttatgaccaccaagatgcaccttttcctattttggactctaattccagcagctgtgtttaaacctcctggagatttacagaaatacgtcttgccattctgtgttcattcgccagattcattgctagttgggatacaagcaataagccgtaaaagaggcagaagacaaaggcttttttttgtttgtttttttttcttttcaaattcctattttgcaaaaatgcagcatttttcagtttattccaaagggtggttttatgaagactttggaaaaagaaaaactgatacaaatgttatttgtctctggactatatcttttactttgttgacaggtagtctccctatctgatttttactctaattggccaatatgcagcaggatcactatatgaagagcccagtagtagggttcaaagtctttgatttttactagctgggggcattaacttacataggtcacttaacgttatctgttatgggtgactacactggggcccagaaaggttatgtgacttgactagctttttaagagccaggttttgaacttgagtattctcattcagactctttattagcagaagtaaaaagaagacctaagtagggcctagttggaaagtgaaaggagactgaatgaggagatgaccagagaagaaaggaattacagatgaagttgggagtttgagcaaggtactcagtagggtcaagaagagccaaacaggcaaaattctgcagagagacaaatggatcaaagagtgagaatgtgtgagtgaaaaataaatgtagacatgatgttagttggatgtttcttacatactacataaatcaacaaaatcttattgtcatcactgataatgactctttacattattacaaaatacaaaactgtaaaaattttaaaataattttcaaagttttatcataaatgaagtatacaactttagaactcattaattttaaaatggttccaaacaccaaagtctgaaattttattcagaatgactcaacttctaggagttaccttcacaaatgaagtttttttttttgttgttgttgttttgatacagagtcttactctgttgcccaggctggagtgcagtggcaccgtatcggctcactgcaacctccatcttctgggttcaagcaattctcctgcctcagcctccagagtagctgagattacaggcgcccaccaccacgccagctaatttttttatatttttagtagagacggggttttaccatgttggccaggctggtctcgaactcctgacctcaggtgatctgcccgcctcagcctcccaaagtgctgggattacaggcgtgagcgcccagtccccaaatgaagttttaagaaacaaattgacaactatatatggtatatagaagatgctaagtaaatgtgtcttgcaattgctgttattcatctccttgataaaactaaaatatatcttagactagaaatttgtagcagaagtggttttaaagtgtttgaaatggtttatgtacaaaagatcaccgttgttcaccttatactttgacctcttgttaagtcacgttgatgaacagccttaatttaatatatctattttctactgttctaatatatacatatttggttttgaggttatataataaaaagcaaatgaagattttcttctctttctaaatatgtaaaaattgataaaataacttcttagaagtcaagaactctaaattaaagtttgaaccttttagatctagaaaaactgatttaagatatttggagaccttttattaaatggctttgttttttgtgtttttcaattttcagttcaggggcttctacaaataatttcatcattaagagtgaatacagattacttataataatataaaccgtgtgtcctaacttgtgccaagtatttgtcagaaggttgttccttcaacatgtcaacattagcaaacttgacctatataagacttcagcacacactagcaagatgtactgaaactgagaagataggaagttaggaattaaatcccatggaaagtccatctacttattgactcagccacataacaactattgataatggtttctttgtgtttttttgagacagagtttcactctgttgcccaggctggagtgcagtggcgctatctttgctcgctgcaacctccacctcttgggttcaagctattctcatccctcagcctcccaagtagctgagagtacaggtgtgcaccactacaccttgctgatttttatattttcagttgaaacggggtttcgccctgttggccaggctggtttcaaactcctggcttcaagagatccacccacctcggccttccaaagtgctgggattacaggtgtgagccaccacacctggctgatgaatggtttcattttctgtttaggagaaaagaaaaaatatttactgtatatccttgataatgactatatgtatacaagttatactttatctcttcaagttttttgcctttgatataggcaggtgaactgaaatataggtgaaactagttgaacatgaaatcttaaaattgcaaacattgtagcagtattcctttctgaccatacttaatgagataactatataaactgtggtagcattaatagctgccatcctgcagagggcactgtaattaaagtcagtcttgattgttatataaatattttacataactcctttaaccaaataagaaatacaaatatactactaatgtttttatttgcatcagaaagaatcatcaaaactgtattctaacaaaagtcattttgtatctgctgaagattttatttattcaaacacatacattattgaaaccaaaatatctcagtaaaatccctaagaagacaaatgccattcaacagttgtgaaaacttgcaagtgtggcaccaaaaccttaattttatatctcttaatatgtaacaggcagaattttatgagggtttcacttgctaattgagtacatccttcatggattcttggcccagtatccatgtagggaatttaggctatttattaacaccctcaaattgtacataaacttaaaaaaattttgtgtatatgcatatgtgtgttttggggggaaagatctgtgattttgaacagattatcaaggaagtccctggctttaaaactggcaggtagagaggagtggggcaggaagagactaagaacttttggcctgtttagtgagtaaaacattataccagttatttggagtgtgcacaattacattcggaaaagggttaatgcagtaggtgtcttgctcagatcagatactcagtaaaagatatgaggaacaaattcagaaagcttaaagaacttgcctctgagtcatagcattgaagtgatagaacttctaattggggaaacttgataagtttaatgccactccaagatggctgtattacatattcaaatctaagaaatcttcatatacaatgacagaaattagggtgaataggattggtttaggatagaacttcaactgagaattaagccctaaggttttaaggcatacattgtaatgaattcatttatttcctatgcagctagaaggtactagctgtgtacattattgggagatttgcaatgtagtcactcatcgttttctttggagcttaattctcttgtggaatcctgattgggaaaggctggtttaggaggttggagggaaggaaatacatgcaagagaaatgatttgaacaacatagagatggcagtgcccaaaactgtttagagagcagtaggataggttgctaattacagcagagtacttatataggagtgatgtgaggtaaagcagaaaagtataggcaagataaaattttggagagctctcaagtattaggctaaaaggtagttcttagccatttaagcctaattttggatttagggggtgggtggtgtatatactgggaaacatgactgttaaatacagcacttaggaccataaaaaattgttgtctgagactataagaaatatgtaaacacatacaagtataaaaaatgtgttatcagcctaggcactgagatgcttttatgtcacatagttgagaaattcttgtttactaagattgtgaaaaagattctgttaatgaagttgaaaaatatgtggaaaatgtattggcctttacagttttatttgctttaataggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgaggggtaagacatcttcctcttaaatgttatcgaacatttattttgcttagtaacatgtatatcttctttaaactcctaaatatttaaggctattgtgtataaaacatcgtaagggacagacgtaagctgtagttcatgtctataatcagagactttttagggtggttctgtaaatagtaaaacaatataaacataatacacataaacctactgaacatggaagcatgtagctgttataattgctataggagctcagagaaatgggagtatcagtgagagctggagaagttaggaaatacattttacgatgatagtggaactgaagacctgacatgtgccgagcatgtcctatgtctggagtgttttccatatagtgcttcatttaatccccataacagtcctacagagtaattgtttttaagtgatattttctgcataaagaagctcaaatcaaagagaattcatgtctgagactactttgggtttatttactgttggaactgatgcacttaaacaaaagaaggattgggggaattggagagagtgtagcaatgatggtccttggttctggaatgatagatgttggaagagaagtgtgtgcctatagtagaagtttgccctgtctagcacccagagatgaaagtatttcaagaaggaagtggtgtggtcagcattgtcaaatctaaggtcaaggaccaggaagatggagaggatgccattcaattaacaacaaatgagtacattcaaccagtttgtcagaacaaattctgtgcattgagaaagtgggcatgaggtaagtgtagtttaaagaggaggtagattttaggaagcaaaaatagctttgtaaactctagagtgtggcaagaagaggaaggaaagataaaatagaggaggttggaaataggataaaaagctaaaaggaggaccaaactaaagtacaatttttgttgctgtttttccaaaatatggtgcatctgtatatatagtcatgcaccctataatgatgttttggtcagtgatagaccacatatatgacagtggtcctataaaattaaaatactatatgtttacaataactgttctatttttagatatgtttcagtacaaaagttcttactattgggttatggttacctacagaatttagtacagtaacatgctgtataggtgtgtagcctgggagcaacaggttgtatggcacagagcctaggtgcatactaggctataccatctaggtttgtgtaagtacactctgatgttcacacaatgatgaaatcacctgacacatttctcagaatgtatccctgtcattaaatgatgcatgattgcatttaaaagcagaggaaaagagaaataagcggtgaattctaaatagaagtcttaagtttggggttgaggttcttgaggtgttaggaaaggacaaaagcatggggtatagatgaattagctgaagtgggagaaattgttttcctttcaagaccacgatgaagggtgaaccaaatataacgaattattgaaggcaaatcttaatagaaggcactgttactgacatttggaagagcataattagaaccttaaaaaaggttttttaattaaaaaaaaactgttcattaaaaaaatcacagataataccaattatccatgtattcatttaagtaaaaatatgttaagtatttctttgtcaaatagtctaatatatatatctttgtcaagcaaaagcatggatttataatatttgtcaataaagacacgtcatctaggattgacataagatttaatttatatactttgataattgtatggaaaatgtatcattagtatagatattaactcaatttcattttaaaaagaggtaaagcaattttgttttaaaaataggaaaataatagatgagtttggttttgagagaaatgttctgtttttcttttatagttcagctaccttgatctaaattattggttttagtattgattagcgttttgattcagtggattggagatcacaaacttcagtgtgtggcttcatttgactcctacttttcccatttgctaacattgccaaccctgggtttcctctgtaacattggaaggattctgatctcagtgttgtaaagattaattaagagaatggatattaagttagtttctagtttgctattaggtaactactgttcatttatcagtttggagttaaacaatctcttcatctattatttttgtgtactgtttcctatcagtagtttaaaagtaatgaatctagtcacaggagaaaagtatgggacaaccaccccaaaacaaccatttatttacctcattgccatcttttttctatttgtgtcttcttttacgttattagactcatacttaacaaaactctgaattgaaaaaaatttaatattgtaacatagttttttatgtctgcaaaagcttgtcatagataatagttaatacttataacagttcttcattttattgcaacttaatgtgtacaaccatttctctcttgctcaacttttagtttcttttcccacagtgaacatcgttttctatattttgggttatgttcaattaccagttgttcagtgataactgatgttactgataagaaattttattgccttcaaaagttttacatacttacattttataatatttatgtaacatgtgtatactttgttttaataactacaatatatattttgttgaatatcctgccatttttcatttatatcatgagcattttatcctattataaaatggttttatttcctccatttcctggtgatgagaattatgaaatcattttttaaaggaaaattttaaatatttcatcatacaaatgtcttgtaatttatttttttctgtatttttagacaaaaattattttcctattaaaagtactttaatgaacagttttgtatgtaagtctatgtttatgtctgattttcttttttgggatacatttctagaagtagaaaaaaggatgcagagtattgatattttaaatatttttgatacgtattgccagatatatttttgacatatgttgctttctgtgggcactcattgcataattataaagcttttttaaagtgtcagacagcgttctgggtgctagagatataactgaaccaaaagagcacagatgtattagctgggtgtggtggcacacgcctgtagtccctgctgctggggaagctgaggtggggagatcgcttgagcccaggaggtcacggctgccattgattgtgccattgcactccagcctgggtgacagagtgagaccctgtctaaaaaagaggaaagacaaaaaaagcacagatgtattgtgtatgagaatatggcttcactgcagcagcccaagcactgaatattattgatttttaaatctttgttatttagctaaatgaaaaatgctctcttttagtttgctgttcatagtttgctgctcatagcttcttagttcagaatttaatcaaatgattttgttttctttatagattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagc

SEQ ID NO: 38300 - DNA, 2722 bp, Homo sapiens
cttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctgggtacgttttagccaatcctccccatctgcgctcctgcccggggctcccccagttcccctggtctcaccctgttctgactccggctctgcatcctatctgtttctctgtttctttcaagctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggtgagtgggagggaggtgcaggtgtgcccaagactcctgggctgcggtcagtgggatctgggtggagctacctgtggtggtcagagagcttccagagggtgagtgggaggaggtgcaggtgtgcccaggaaggtgggctttggcactcttcctcccttgggcatcatgaccctgacatggcctcctcccttccctgcaggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtacacaaggacccccagcccctgtgcgggtggaactcagggctgggagccaggtcctggcgcagtcagccctgacattctgctcgctcactgcaggtccttggcagggctgggcggcctctctctgctgggcgtgttctgtgggggctacctgatggcgctggcagtcctgagcccctgcccgcccctggtgggcacctcggcgggggtggtcctcgtggtgagcacagggggacatgaagtggggtgggggggcgttgccctggagcaggcacatctcacgctcagctggtgctgtgtccccctcaggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaatgagttggcattaa

SEQ ID NO: 38301 - DNA, 15759 bp, Homo sapiens
ggttgggcagggcaatacgcctgcgtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaggctatccggaggacaggcaagggagacatggggctgcggcttctcgggcctgggcctagccccccttgggctccgcggatcctgggacccgggcccccctccccagtcctccaacgcatatacaggtcgacccccggaggtcccctccgcagctttgggagtcgcctcccctctctaccccaccctgtcgcatcttgcagtggctctagaatcctccccctttcgccctccacagcgacctatttctccttccgtgaataatagtgatacattttattaagcaccaaccagtcattttacttagcttatgtcgcttaatcctcaaacttgcatgcgaggtgagtatacaaccctaggggctcacagtcgagggagacggtcatctaccttaaagtggtatcaccggtgcagagtgcatagagtggggtgacgaagccgcgggaaaatgagacaatattggagcgtgcatctactcacagccttgggaaggtgtttggtaacaggacccatttaaagcattcgtttattcaagagatatcatttcagtaattaacgtgtacacataacgctggaagagatatacttcgtgctttcatggactttacaatccagtagggagacagacacataaagaggcagtcacagtacaatgtagttagtgctgtgaggagtgaagtagaaacataccctactaattatagctaacatgatcaagtcctttctagataccaggcaggatgctaattactttccatgcattaattcattgaatcctcccagcaacactataaggtaggatatatatatatatacacacacatacacatatatatacacacacacaattggtgtgtatatatatataccatatatatatatacacaattggtgtatatatatatatgtatataccatatatatatacacacacacaattggtcatatatatatatatacacacacacacacaattggtcgtagcgttataaataaggaattagtccccgagagtagaaatgatttgcccaaggtcacggagctcgtaagtaatagagctggaagtgaacccaagtctgattttaaaaccaatgcttttccactatattatgggtgaaaactcacaagaatgagacggcctagcagaacttgtgtgtttagggagccaagtacagtttgatgtgaccctagtggtggtggtgggaagcagcaggtgctgagcctggagaggcaacttgggctgagataggacttggaagcagcttctacaaggccagaccaaacagtttggacttgatccagtaagggaggtggtgggaagagtggaaggttttaaggcagaggagtgtcatggcagggctggatagtagaacaggctatattaaaggagaggaaggccaagactagaaatgatgtaccagcaatgatatacccggcactatgttaagtgttttgtttgtttgttttgttgtttttgagagtctcgctctgttgcccaggctggagtgcagtggcgcgatattggcccactgcaacctccgcctcccgggttcaagcgattctgctgcctcagcctcccgagtaactgcgactacaggcgctcatcaccacacccggctaatattgtgtatttttagtagagacggggtttcaccgtgttagccaggatggtttcgatctcctgacctcgtaatctgcctgcctcggcctcccaaagtgctgggattacaggcgtgagccaccgcgcctggccgtatgttaagtcttctacctgcaatgcttcatttaatcttagatgcctgtgagagtggcaactgttattttcctcagaggaagaaattattagctatgttcagggactttattatattaaagtgacatttactctgaggtggcagaggggagctgccatgtggcccccactcttttgttccccccggcgaaccacccccctgcccccaccccatgtagctgggttaatcttgagttgctgtatttcttgttgcaatttttattaggttcaacaaacatctgaagttctacttcatacaactgatgtatctgaaatacatttgcctttagtcttcacacaattgaatgaacatacgaataattacataaataactaaaatacaagacaaggtgtgattaaatactatgaaagggggaagatgtggtttaggaaaagatttgaagttgtatctaaattctaggcctacctgccggtcaccttgattacttgattttagcatttgcagacatggttatttgtaagatgaggtgatcccagctataaaattctctgaaactataaagggaatagagaaagcactttttggacataatgtaagacatgactaaatggcatatgaagaatggcatttatgggcggagatgaagagaagacccctctaagtgagggtagggtctgagcaaaagtaaggagatgggaaaatgcagagagtcaaaaaggagttcagtgttttgagagaacagtaaatagtcagtccctttttgaaatgttgtggtgagaagggtggaaagatagtttgggtccagaagcctttcagtacccgttaagaagtttaggctttattctgctgttaaggctgaatgagagtttggttgctaatataatagcagagtaaaataagaattgtcatttagggagatcacggtagcagctgtgtgaagaatggattgaagaaagaaaaagaaaagcagggagactagtctcagtggctcttaaaattattgagaaagatgttaatgatcccagtgtaattggtgcttacagagactgtgcttacagagagcaaagaacaagtatatctagaattgatcagacttagcaatggattagatattggaggtagggaaggttgaagaatcaaagtcagatttgcagcgtggcaatagtactggtgaagccagaaaaaggagcccgtttggagagcgagttaaatacattttggacctcattggcttaggagttatgacacatccccattgaaaaagcagtcagaagctttggactggaaagtccttggacacatttgataattttgagtaaaaataaaaatagctaatatttatggtgtgctttcgatgtgataggcactgttcttattatttttatatatattaactcatttaatcttcataacagttctattaagtactattctctgttttacataaatttaggaaaactcaaggcatggtataaataaagtactataaaaagaggtacagacgtagtttaaggagacaaggacaggactagaaggttgattggctctagatggtgactttgtctcagtttccacacctgcagactgtgtagccctgctgtgcaatgaggctgttgtgagaataaatgagaaggatgttgaaattctgtgttgtttgagacaaagagatctgaatgaatttgagacggtattcatggtaaacagctgtgaaaggatgttgtttctgttggaattcatcagtctcagtgaagaagcaggtgaggggatatggtgacatctcaggctcatccacctcagtgatggtgatataatgggaagaagcctggttggaggtcacaatctctgtgttctagttctggggttgccactgactcactgtgttgtctctagcacatccctctttttcattaattacgaaacagactcaatgtcttcctttattttcctgtgacagggatggtgttttatatgctcagcaacatgtgtataccttcattttgataagatttccacatttgtagggaaataaataatgcgtcagtctttttgggccgtatagttttgggcctttgaataattgaatcagccagttaaagctcttttaaggcatatgacaagtaaatataactgacttaattattaaaatatattaagcttttaaaaaagtttgagtgttagtttttattctcctagctgtttataggtaataaaacaagcaaatgtgtgccagtttacctaaataaattcttttattttcaaaaactttaatatgaaaactttacagattttaaacataaatttattagagtcatcatggcagatttcacttatgtcataactttatctttgataattataacagttgcactattaatagacatagtcataactttattctcctttctatagtgtatagattaattactcttgtcatctttccttgccttttattaataacctagctgcataaagtgcataaaaaataaaattacagctgggcgtggtggcccacgcctataatcccagcactttgggaggctgaggcgggaggatcatctgaggtcaggagtttgagaccagcctgaccaacatggaggaaccccgtctctaccaaaaatacaaaattagccgggtgtggtggcgcatgcctgtaatcccagctactcaggaaggctgaggcaggagaatcacttgaacctgggaggcagaggttgcggtgagccgagattgcgccactgccctccagcctggacaagagcgaaactcggtctcaaaaaaataataataataaaataaaataaaattacagactgttctcacacaacaatttttaattttacaaatcaaattcagtagagtattaaagcataatacactgtgacagactagattttattctagaaatacattggatcagttttacaaaatctgttaatgctctatgttacatttataaattaatgaaaacgaagcctaaaaattttagtcttttctggtatagaaaacaacagtaaagcaaaactaattagaattagaaagaagctttcttaacaaggaatatccaaacaactatattccagataccaacagcaaatattataccaaacttgcttttaattttagaaaaagggaaggttgtctgctgtcattgctcttcgtctgtattgtcctgaaggggttggttaaagcaataaaataggaaatgagaataagaagaaaaaaataaagtagcagaagggaaagagacagtttttatttgtaaatggcagtttttctgttaatcttcttgagttttgtgtcagaactaacaagagttcagtaagatggctggagagaaaatacagtatacaagcaagcagtaaacagtttgaaagtctaatagaaaaactatcctatttagatagtatcaaaagtgctaaaatactgaggaataaacaagaaatgttcaaggtccctataatgaaggaaactagttttaaccaaaggacaagaatgacttgaatatgaataaatggagagaaatactgtgttgtggatgagaaggtgtgattgatgtattcatatctgttttctaattattgtatccccattttctagcaaagagtgggtgctcaacagctacttgtgctagacactattttgggtgcttggtgtgtaccgtagtcaacattatatttaattaccatagcttaatttggggagaattgatatctttacagtagtggatctctgttgaaaacaaaatcccttccctctgggagcttatgttctagtcacacacagaccactcaggggctcttaaaattattgagaaagatgttaatgaccccagtgtaattggtgcttaacacagaaactgtgcttacagagaggaaagaacaagtatgtctagaattgatcagacttagcacatgaatgctaagaccagaccacatgagtgaccactgatgatagcttatataagatgattagagagaggctctctgaggatgtgaagtttgagcaggcacccagtattataaaaactgcccattgttccctaatttaacatataactaaatttaatacaatttgaatgcaaattattgggggaaggtgttcatctgaaagaatagccaaaaaagttttgaaaaggaagaatgaggaggatggttctcccagataacaaaatgttatcttcagtgacagtaattaaaacattgtggtattggtataagaaaaggtagtacagaaaagggaccacaggtctcttgcttaagcagctgtttgtaggccctggacagtttgcagttctctctgagctggctatatctacactgtgtatcttctcaagaaaatatcactaaaatactattgagcaaaactggtgggcatagttaaaggggtggcaaccttggatacgctctgatttttaaaaaatttgcagattttagtactttattattagttattactagatggactattactagatggactattactagatggactagatgctctttgtgatctcttccagcctcatcttctgtgactccgtagtcctctgggagttttatttatcctttaatttaatttaatttaatttaattttttttttttttgagacagagtcttgctctgtcaccccggctggagtgcagtagcatgatcttggctcactgcaacctctgcctcctgggttcaagcaattctcatgcctcaacctccctagtagctgggattacaggtgtgcaccaccacgcccagatacatctctagtatctttactaaagacaagctttcaccatgttggccaggctgttcttgagttcctggcctcaagtgatctgcctgctttggcctcccaaagtgctgggattacctgtatgagccactgtgcccagccttatatatctattaattttattccagcagcagaaactcagcaaagctctccagagttggttcctctccctgcatcccagaagactccatccttctctacaccccttttctctctaccataaataaagattctattaggggtgccatttcttctgctctaaaatgggaatattaatctcttcatgagactattgtaaaagtgaagaaaataatatatgtgaaagagctttgcgttctctaaatcaccatagattttaaagaatcgctgggcgaggtggcttatgcctgtaatcccagctacttgggaggctgaggcagcagaatcgcttgagcctcggaggccgaagttgcagtaagccgagatcgcgccactgcactccagcctggggaatgggagtgaaaccctgtctcaaaaaaaaaaaaaaaaattattattatgacagtgtttaattttcttggtaaagtcagaacagtgctacttttgtgttctctattctgacccgcatgaggtaaagctgagaaagtggtattctggttcacagtctgtggcctttgtcccatctttcctttcctaggtgaaaattagttctgctgtgcttaaagctgcggcccatcactatggagctcaatgtgataagcccaacaaggagtttatgctctgccgctgggaagagaaagatccgaggcggtgtttagaggaaggcaaactggtcaacaagtgtgctttggacttctttaggtaaaaatctttggtatcagtgcctacttggttgaagcataaaggtttaaatgaataagtgaacagccagctaataatctggattttattaggaagtacataggctttgaaatcagaccaaggtaaaacattcaaaggatgataattatttttggttttgtttttattatctggcaagttcttttatctccatgaatctcagtttccaaattgtaaaataatacctatctaggtttgctaagcaagtgactggtgaccatttttgctacagcaaggggaaagtctttttgctgtgaaaaatttgaaaaggcacgtaaaacaacctatcacagtcctttttaagcaggcattcactaggttgttgtcattactacagaacacaggtatgatggaaagaaaactgtatgcggagttaggttttacgtaggtcattgtgcatgatacttaagtaaaaaaaaactaagctgtgtaattgtaggaaaatgttttaacaagcatattagcactctatttaaaaggagagaaagtcaactcaaaggaaattggctcttgtaactctgaagtccagaaataggcctggcatcaggcagggctggattcaagggcttaaataatttcacaactacttgatgtctttttgcctctcctcttttcacaatctcttagttctggttttctctgttgacctcattttggaaagactctcaccttgctgtaccaaaaatggccaccagccactcgagttgctgttctgttgatacttgcttagcaaacctagacaaagtgtgccctttatccagaagtgagcagaagctcctggactgagtctaattgtcctggctggcggacttcgtatacatatcattgcatcacttgtgcttcaggagataaaaagctctgattgctcaggcctgagatggggagtggacttagcttcatccaaaccacattgctgagagacagggaggggttgttcccaaaggaaaattagaaggatgttacggaagaatggggaatgactgctggctaggcagaaaccaccgatgtccactacaatgaagttagagaaaaaaaatagataccttagcacagtagctgctttcctcctttcttgcttctgctgtctctgtccctatgcaaagatatttttgtggttataatcatagtatgtatacattgagaaattcatttttcacttgatattattggaaacactcttcgaagttgctatatagtcttcatgatcatcttttttttttttttttttttttttgagacggagtctcactctgttgcccaggctggagtgcaatggtgtgatcttggctcactgcaacctctgcctcctggcttcaagcgagtcacatgtctcagcctcctgaatagctgggtctacaggcctgcgccactatgcctggctaatttttttgtatttttggtagagatggggtttcagcatgttggccaggctggtcttgaactcctgacctcaagtgatccgctctccttggcctcccaaagtgctgggattgcaggtgtgagccaccgcacctggccgtgatcatcattcttaatggttatatattattccatcagtggataaaccaaccataacgtacctgaccaattcctgttattgaacatcattgttgatttcagtttttgattattttggataaatctgcagtgattacctttgcgtatagatcattttcatcagttaataattccttggcataaatttcctaacagtgagtttactctataaagggctttgaacatcattatggctcttgaactgtattgctttttttttttttttttttttttttttgtgatggggtgtcactctgtcgcccaggctggagtgcagtagcacgatcttggcttactgcaagctccgcctcccgggttcgcgccattctcctgcctcagcctcccgagtagctaggactatagggcacccagtaccacgcccagctaattttttgtatttttagtagagacggggtttcaccatggtctcaatctcctgatctcgtgatccacctgccttggcctcccaaagtgctgggattacaagcgtgagccaccgtgcccagcaaatgcttttgttttttaaatgttggatcaatttatgctgtcctcagcgctggattctggtatgcatagtatttaaatatttgggaggtgcaaatatttttggatgtttcaatttgcattgatttgattgccagcgagattgagtctgtgtgtgtgtttatttaaacaatttttcttttttttttgagacagagtctcactctgtcacccaggctgtagtgctgtggcgtgatctttgttcgctgcaacctctgcctcctgggttcaagcgattctcgtgcctcagccacctgagtagctgggattacgggtgtgtgccacctgcctggctaatttttgtatgtttagtagagatggggtttcgccatgttggccaggctggtcttgaactcctggcctcaagtgatccgcctaccttggcctcccaaggtgctgggattacaggcatgagccacagcatccagcctaaacaatttttattttctaagagaacttttgcaaagcattttttccatggtccagtggtagtacattttaagcggggaatgtttggatttcacaaattcccaaggtgaatccatagaggaatttctcactgctgaagttgctggttgtaggcattagtagataattgttaggtatgggtaacagggtccagaacagggatccatgctactagagtagtggcttgcagcccgtctgctgctgctgcattttggaggaatataaaactcccattggaaatggttgctttctaccaaagtgattcttgagtagaagttatgtgggtgcaggttatgcttagtatacccggaagggaaacctaagaagctggtgacattggtggacctctaggagagcaactgagtggcttattgggcagggtggaaagcagatttttcactgtatacttccttaagccatctctgagatccttccttcctgatccatgttaaacaagattcatgtgagagtgtagctagatttctggagtatgacaggtaagcacttaaataataaaattattatttcattgggagaaagaggtgttctgaatttcactgcctcaagtatggcttttacataaaatgatgatattttattcttgcttgaacatgcatactagtagggttgaatgataagataaggaggattttgcaaaaaactgaaacttattctttttatacacagaagttaaattttctctagccatttttgatggccacagaatgaattatatgctaccctgcttcttagcagagaataccaaatataatataactttgttcttgatagcaaggattaatatctatttttgttcaatgcgtaaataaaatgaggaccttgagcttttgaggagtggagtacagtttgtctttatactgaatgatcccaggatcttctgcttgttagtttgtgtatttgctttttataattctgtctcttcctttgccattgtctgtcacgtttgacttctatcagcatgtccattatttaattatgcctcctcctcttctaaatttgctaagctgatacccttagaggaattggatctaaagaaaagaataaataggccccaagtaaggagttcctctctgagtaaaataggcgtgcattaggctacactcttttcttcttactatataaagaaattaggttttctacctcagaaatcttttttgtttactaacttgttctcaacttgaggatcctgaagttgtcttgtaagtgagataagaatatgtactcacatacctttcaaaaagcaaggctatgtatttgagatctgtacctatttttttctcacttttctgtttttcattgttttgcaaagagatgcccctaacccagctttcttttccaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtaaaaaggcttctgctggaggtctcactttctgattcaggggtgggataaaggcaggaggtggtcagcaaagggtctctgtaaatacagatatgatgtaagaacttaccagatttaccaaacatattaattaggcagtgattatacacaatccagaaaggaatttttaaaaatagaaatatttctggctgggcgtggtggctcacgcctgtaatcccatcactttgggaggccgaggtgggcaaatcatgaggtcaggagatcgagaccatcctcgctaacatggtaaaaccccgtctctactaaaaatacaaaaaattagccgggtgtggtggtgggcgcctgtagtcccagctacttgggaggctgaggcaggagaatggtgtgaacccgggaggtggagcttgcagtgaatggagattgtgccactacctccactccaacctgggcaacagagcgagactccgtctcaaaaaaaaaaaaaaaaaaaaaaatttctttaggccttctagcatgtgcaggtttgtttttagttaattagctaattaaagaacagaagggagtagagaaagataaagtattagtgaaacactgtcagttgaaaacattgtggaggttattgtggaattcactggggaaataggatcaggcttatgccacatttttcaggaacatatctaagattttttttttaaaactacattcttgtacttttaaaagtgtttctctttctcctatatttcctatcttagttttgacaccaccatctgttgaaacatcagagctagaaacctgaattcttcattccctactgattccatgcagtcatcacttcctttagattagcatcttctggaattttttttttaatcctctcattgttcctgctgctgttatcttattcttggacaggagttcttaacctggggtacatgaatttctgggagaggagggtggatcaatgtgggctttagatgaaattgaagaattgaggattaaattacacctccacaagaagagtgatctgtgtggaaaacaaatcttatgtcactgtgtttttaaaaactgtacggggactctccattgctggtgagataaagcatcttctccataacatggcatgcaggccctttatgatctgacccatccctgcttcttcagcctcagctccctctgttccctgtggagcagcacaggtagcaaggcatggaggaaaaaactcaggtcttactctctctcctaggctggaatgcagtggtgcgatcacagctcactgcagccttgacttcctgggcacaggtgattctcccacctcagcctcccaagtagctgggactacaggcacaggccaccatgcccaactaatttttgtattttagtagagacaggattttgctatattacccagtctggtcttgagatcctgagctcaagcagtcctcccaccttagcctcccagtgtgatgggattacaggtcaccatacccggtctagttcccttctctttgtgtatagcatctgtgaatggttggattataagcttggtgtcatgagtaataacttagcaatttttttgtcttttatatctggcttgattattttcagatactttttgatgtactgaacatattattttaaatagttgataattctagattggaaagtggtagaacttatacatgtaacaaataaaactaccttttctcatttctgacttatgaaagaagaaataacaagtcatgctagtaagaaagcatatttattcttgaatctttgtattaacattttttaaaactctgtgagataaaaaaaaaattctcttaactcttttcaaaagtgtatttctcgatcaggtgccatggctcacacctgcaattctagcactttgggaggctgaggcaggaggatcgcttgagctcacgagttcaggactagcctgggcaacattttttttgtttttctttttgaagtggagtctcactctgtcacccaggctggagtacagtgccacgatctctgctcactgcaaccagtgccttccgggttcaagcaattctgcctcagcctcttgagtagctgggattacaggcacccgccaccatggccagctaaattttgtatttttagtagagaaggggtttcaccatgttgcctgggctggtcttgaactctgacctcaagtgatccacctgcctcagcctcccagagtgcggggattacaggcatgagccactgtgcccagccaatttcataaatgtctttaattccttaaaggagctgcaaataccaaggaaccactagtggatcattaggaaccatctgtacttatgacagggcggtgggataactttcaaaagcaaacaaacgaaactagtagacttgaagacttaggttccagctttagctctgacattagtgtgtatcttatcttaggcatgccaacctccctggtcttcatctgtgcactagagataataatgcctcataaggtggttataataataattgggtgattgtatacacaaaagctctgttcccaataaaaggtttctgaatttatacatctaggaagatgaatctggtcattttacatgaggtgacttaagagttcagcccagtagaagaataatcagaagactgctgacagctgtggccttatgtcttcttacttctctgggcctatttctttatctttaaaatgacagcagtttctgctggctttccagttgagatttttgtgaccatcaggggatactgtgagtgtaaattatctctctccctgttgcagtttagtacttcaccactctcctggcttattggctcagctccccaatttgggtcttgcctctctccactttagctttcacacttcccagcctacagagatgggatttagttactgccgtgcttcagtggcacctgttaaccgtcaggttaaaacgcaaacacctttgcatatcatttaataccctttatcatctggcctgtccaccactgtagtgtggtattaagaagcacaagctttggagtaggcatatctggctttgtgtacaatttcttccactattagctaggtggcctcagtgagcccctgcagaatgacctcctaagagtgaaaatggaatggaatcatgtgctcagcatcatttctagcaataagttcttggtgagatgcttcatctccctccattcttcatgcagcctttgattcagccattctgaagacatgcctgcctatcttcatatgtagtctttccttggaatgtcttttcctcccttgcctttctgactggctcctgctcagactttaagctaagtcttacctccttaaaaatattccagacccccagccttcaggatgggttagatgtgcacagtccttgctcctatagaggcagttcctgtctccatcattgccattagccatcagggtgatttggaaatcttggttgttattcctggctttctccctcactagactgtgatccccttgaggacagtatcttgttcccttctgtatccctagtttctaccacatggaatgacataaagtaggctttcctgagtgtttgttcaatgattaaatacgtctgaatgtgatttgctgggaatttaagtcggggagcagttgtagcagcgggagcaatgaggagacaccaggaggcgcattgatggttacagattcctccaccctagctttcaactttgcttttgccctcttcacccttcccaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaagg

SEQ ID NO: 38302 - DNA, 2846 bp, Homo sapiens
caggagagaaggcaccgcccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggtgagggacccctttctcttctagccccgcctagaaggattccagggctattggttcaaccagtttgttagggatctggggataacaagaaagggctctgttagagtctacagaaaattctctcttaataagaggaccttcggaatgacaagccctcctcttaccccacatagaacaattccaaagcaaatcgacttttgcgttttacctctgggattagatagaataagggggcagagtggaaacgagagccaaaattgtggggctgcatctccagagaaggtgatgattctgttgaagttggaggttcccggggaatctataacttcctgtctttttaacaggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggtaggggcctaggtgaatctcagctaggctctttgcacatttagcacctctgcacatctggtttccttttctgcaggagtggaaggggatattgaagcctggctgagtttgctctttttttcccattcctgactcccgagttgggcctctccctgcctgggagttgtaaccctgcagcctccctcctgatcccccatcccttcaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacaggtaaataatctgaaagcaggcccctaactcttctcagaaccgatattcttccttccttgcttcttactctttttttcgctttgtcccagtccattgtggctctgtcttctggaatctgttttagggaaacctctgtaatgccaggtctattaaggagaggttctggggatccaggccgctgtggtacccgctctttctcaattctccctaagattggaggcaaccactgggcaaatgctcactattctccagatcacccaccctgggggagttcctgctggaggcatctaattcttgcctctatttccttttcctgtgcttttctcatcagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgct

SEQ ID NO: 38303 - DNA, 8692 bp, Homo sapiens
ctgacttcccttcctgtcctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccaccccacctccggtctgctcctgagacctggctctggctgtaaggccctcctcccctcctctcccgtcctcatcccttccctcctctccccttccttccagtgcagtgccagctcctcagggactgttctgacactgcttccaggaagccttccttgcaccccagtgctggatgctgggtcaagggcctttctccaatagtaccctgtgccctgtcacagtcctttattgctgcatggacctttcgttatttaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggcctggggaggggtaagaatggagccccaagaaccattctgcccattgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggtgggttgggctgggagcaggggtcctactggggtgctgagtgaaatggagcaggtgctggggggcctgggagaaggtgggtggaggcccctggcttgcctgatgcaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtgagcacctctcctggggccctgcctggaatcgctggggtcctgggcccctcccagaccccctgggctactgagtgatgccccaccctgctgggtctaggtacccctggggacaggaagccttcgacaaggccaggaaggaaaacaagccgattttcctctcaggtaatgctcccaccttccctgatgtgggggtgtgggcagggagtggcagtggatgggggagggtcctctcggcctggcgggtcttccaggagactagaggccaggacgtcttccatgtagccagggccacttggccagcctccctctgacccgttgctggccccctgacctctccccatggccctgttcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggtgagcagccctcctcgggagtgtatgcgccacatgggctcagagcagctcccctcaccctcgccctctctccgccaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacaggtgggtgtgcctccgggagttgggggaccagggtgggggactaggaaacaagagcccctccccctagctgacctccaggtgtgcccccacctcccgcagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccgggtcagtgccccacgcccgccttagcccaggctttggccttctgattcctatgctggtcagggacctactggctcctggcctcacccatagcttcctgtcctcctgactggcagtgacctccttgcccctagcctgtcggtagctatcggtgaagacccgactgctggtgtcagcagtgaccctctcaccttaacctagatgatgaccttctgtcccctgacttggtcagtgacccagtgaccctgacttggctaatgacattctgggctctagggggacaagtaacttactggtcctctgtgaaccaatgatattctgacctctggcttaggctattaccttctgtcctgtgggttgactcttgacctcacagcctgtccagagactgcctgttgagtgaactcccagcctctgcctggcccaaggcctcctgaccaccccgatctctgtccccactttcccattctctcacctgcatgttcttggtgcccccacagtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccaggtgacccctgaccccagcccagagaacaggcatctcactctggctgcccctcccaaggccttcctggtgactgtggcttctcttaatctgaatcccctgttccctcccatgtacccactacccaggcttccctcccccgcctgcctcagagaatgttgccaccttccacctgggcctccccagtgacctctctgttcacagtctcctttcttccctttcttagctctctggtgatgaattctactctgacgtggccaaaggcatcctgcagtacgtggctcggagcctgagccaccgggtgtgtgtccatggtggcaggcaggcctggctgtgggaggggttggggcctccactgccctgtgggccggggccagccaactctcccctccccacagtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggtgaggacttctggggtcacctgacgggccctggtgcctgccaggcgtgtgagctcgcagacaaaggccattctcctcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacggtcagtgggggtgcagggctagtctggggtcctgggaggtgtaagtgcagcgtgggtgaagagctggtgtgggcaggagccctcctggctttgtgtctctgctacttattaatggcgtgatttttggctgctgtaatatttctgtgtctcaatttcttttttttaaatagagacagagtcttgctatgttgcccaggctgatcttgaaatcctgggctcaagtgatcctcccacctcggcctcccaaagtgctgggattacaggcatgaaccactacactcagcgtgttttgtttcgttcctttcttttctttttatttcctttctctttctttctttctctttcctttcttcctttctttcttttctttctctctttctttctcttttttttttttttttgagacagggtctcactgtcacccaggctggaatgcagtggcatgatcttggctcacagcaacctctgcctccggggctgaatcaattctcccacctcagcctcctgagtagctaggactataggcatgcaccaccatgcctggctaattttttgtagagatgggatttctccatgttgcccaggctggtctgaaactactgggctcaagtgatctgcccacctcggcctcccaaagtgctgggattacaggcgagagccaccatgcctggcctgtttcttaataagtaaaatggagctaacattggtactaccttacagggttgatgtaaagatgaatgtagctgttctgtaaacatgcttagcacagtaactgacacccatggattcagatattgaccaaggctcacttggtctctgccctcatgaagcttacagtatggtaggggagacagcgaaaatgcagtaatgatgcaaaaacacatgcacaaatgtgcagttaaaattgtggtgagtgccatgaagaagtaggacgctctatgtgtgcctgctccctatcacccatgtgccttgtctgtggttaaaggtttctttcccaaaactcaaattttagctcctcaaagatcaggactttctgccactgttgtatccccagggtctagtgtggttctggcacattgtaagtgcttaataaatgttaactgagtgaatgaaagggccttgggagagaaccacagaggaggaccaactcagcctagggagagattagaggacacctgtgacaggtgtcatttaaccaaggcctggagggaaagaggggccatgtggccatggagaagctgtggagagagttcaggcatagggagcagtgcatgacaggcctggtgcaggcagcctgtatcctggaggacaggcagggcccgcgtgttccaggagggcaccgaggagaatgctgaggccggcagggcacggaagccgtcttttttttttttttttcctaagaaaagaaggctggtctcaaactcctgggctcaggtgatcctcccgcctcggcttcccaggtgctgggactacaggtgtgagccaccatgcccggctggcaaggaggttttaagtggattgtgatctgctctggtatggttttaaggaggtcactctgaccactgatggagagaagtgggggtgggggaaacaggcgaccagttaggaggccattactcgtgttcagtccaggcaggcattggtgaaggctcagaggatgtggaagtatgagatggggagacatggtgagatttggatctcttctggccacagccctggcaagactcacagatggattagaagcggagggagagggagaggaaggggacaggatgatgccgctctagcttgagcagctgagtggctggacagaggcatcagcagcgaggagggagcctggagaccaacagttgaggctaggacaggtagagtggagggtgccataaaaaagacagcaaagtactgataactgctggagtggcatccacacccagagcggggaaggggcaggatgggcagggccttttctctgtcccgtcccccaagtggccctggatacagtcctgggcagggtcctgggactcagtgacctgcccttacccccaccccctgcctccctatgtgctgtagaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcaggtggggggtgagggcatctgggctgggacctcgggtaggagggaagttggggctgcgatggcagatgggaacagggggtggggttcctgggctgtccccagagctcaggtctgtgtgtgtgcaggcacgtggcctgtcagacagggaggcagaagttaatatgagtccgtggtggctgatgaagtgtttctctgtacgtcttggtgtcagtgtaattgcttctgtccatactgtgttactggtgtgtgtgtacttccgggtgtgtgtgaccctggaggtgtgtgtctgtgcacctacctttgagggggatgctggtgtgagtgtttgtctgtctgcatgtggatgccccatctgcaggtttgcctctgtgtctgcctgcatgcgtgtgtgtctggtgtttgtgtgtgtggtatctgcctctgtgtgggcatctactgtgtgtgtgtgtgtgtgtgtgtgtgtgtgtgtgtgtgtgtgtgactactctgtgtctgtctgaatgggtctctgtgtgctctgggtcttctgggtgtgtgtctccccatgtttgtatctgtaccattgtgtatatgtatgacatttccacttcggtattctcatgtgtgagtgtgtgtgtgtgttcccacttgccaagcattaactcatcctggcagctgagatgagtccctgttccttcttagagatatacggtggggcggaaggaggatggggaagccctggtggtctagggctcagccctccctcccctgacacaccggagtgacctttctattccggtcagatcgtgatctgtggagaccgtcaggccaaggacaccaaggccctggtgcagtgcgtccactctgtctacattcctaacaaggtacccatccctgtgagcccaatctgccacctccccagagctgccccctcccatcctcagctcctcaacatctccttcccctcagaatgttgggaagagggaacttcccagtgggcctttctaatgggcaggtgaccccaccccggcaggtgactctccctgctctgctgctgccctaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 38304 - DNA, 36209 bp, Homo sapiens
atgggccacgggcccccaccgccgcccgccgggaggaccgagcctaagagggcagccgcctgaaggaacgcgacggcggcgcccgcaggtgaggcggggcccggggtgtgtcgagtccggccccgctcacctggcagcgccggcgggggcggaggggccgggcaggggcggaggggccgggcagggacgggagttcgtggcgaagactttaaaaaccctccccgccgggagacgggggacggggtcctcctgccccacctccggggcttgggagccacgttagctcccccaggggcaggggtggccccgggcgaaggcaactcgggagacggcggagtcggggaaagagggtccctgaggctcggcgacccccgcgcccgcccccgcggggtctgccggccctttctggggagggggctccccggcccgggctccagtccagggtgcggaccggccgcggcgcgcgcccaccccagtgccaagggggaggagaggccggtcccggggcgctcctgtctgccccggggtgggatcgcagggcgagggatccgcattgcaggtgcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccgtaagtacactaccttgccagccccttcctgaagctttgatgcggctttagtttactctgagtaacgatttgcctgtgattcgtgaaacggagcagaatgcacaaacgcagcagagctccaggcttggctactgggctgccgtctgctacggcgagtgagtttctctaacttaggttttcatgctgacctgtattgtttcatttcaagttttggtatttagcagtacgatctagtccactaaggaaaattaggctgccagagagaaaatataaccgcgctctgtagcttaggttgcagtagtcggttttataacaaaatgcaagctaccacgctgtaatactttaacatattacgcagttccagaaacctgtaagagtattaaaactaggattgccattttaaaacttttacgtttgaaatttatttaaagagcattggtattgataaaacgacttttctttttttttttttttgctcatcaagaattcccatgcattttctcgctattgcattgtaaggaaaaagatgctaacgtttaaagtggcttttacctccaaagatgttttgaaatgtatgtaattcttttggctaactgttcatcttatgtgaaatatgcttggaagaaggctttaaaactcgtgattatatatacgggtatgcgtacatatccatacacaccactgaaaaatcttaaaatagttttgttactcctctgcgtattataattactcagtaaatttagtttaggtacatttaagatctaaagtacaggacaattatttgtgtgagatttttactgtgacacattttaaatacatcggtctaacaaatagggtttttttgaaattagatatttttattaactctttaaaaaacgaatcattcatcttgggtttataactctttcatctgccatgttggataaattgcaaaattggataaattgatctcaacttatccaattatctttggataaattgatctcaacataattacctaattggtaggatgcctttgcaacgatactaacgttaataaaatgttgatgcttttaaaaaatacttatgttaaaaaagcattttctcgtatttctggcaagaaaagtcatggaacttttttccttctatctggaacaaggtcagccataaatagtttctaatacatagtgggcacacatttggtaactaagattaattatatctactgaatttactgaattccatgtccttcaagggcagtgactaggtgactttgtatcttcacacaccaatgttgcagtaaatgtttgagtcagattgaagtttcatcccggctaggtaggtgctaacttaatgacaccagtttccacatcttcagctttgatgtttcaacctgcagaaggatttgggcacggaagtggctgtgtcctaattgtcttcaaatatttgaaggtctgtcatgcagcaagggatttcatttattttgagtaattattgagtacagaaaaacagatttcacttctatatgaaggcaaaagttgtttatggtgagaactagcggtggaaagaaggggctgctccttccctaggggcttttgggatcagctggttccccacttggcgtgaatggctattaggaggtatcacagaggtataggagggtctttctgagagggactcctgggtattccgatggcaactatattcgaggacttctgtacttcccttttagcactgtggcttttgttttttgttttcttatgctggcttctagagttgtggacgtagcaacatccgcagacacctacatgaaccctaggaagattttttagtagattaaagacccacctgctatcgaagatgattcttagtcgtgctttgcatttgtatggcacattacagggaataaagcactctcgaattcaatgtgttttaaaagactctttttaattatacatgatttgtatttctttctttaactttattttctacaataaacattgaatcaagaggaaaattacccttttctaggaaggcaagcagaaaagactttttttaaagctgtttttaaaaaatgggatggtgccagtcatcctttggagagccagcaaattatgaaggtgaatcgttcttttacttggctgaaaacatgttttaaaagatactgaataaggccgggggcagtggctcactcctgaggccgaggcgggcagatcacgaggtcaagagatcaagaccatcctgagcaacatggtgaaaccccatctctactaaaaatacaaaaattagctggtcgtggtggcgcagtagtcccagctactcgggaggctgaggcaggagaatcgcttgaacccaggaggcagaggttgcagtgagcccagatcacgccactgcactccagcctggcaacagatggagactccgtctcaaaaaaaaaaaaaaaaaaaaaaaaaactgaataagagatgatataagagatgattcttgtgcttgctccgcattttagtttgtttatttcattactcaaacatgactcaagtttcacagcaaaaagtccagtcatatccacctacattaagttgcattggatgttttttcagtatgtctgcatggtttttaaaatatgctggcagctgaaggtaaaacaaagccaagaagtagaattacagcaagccgaaaagcttaggggaattggagctttgtgtttgaagaagaaagacatgtgccctatttgtatgaaaccaatcttgagaatgatggttttatcagcaatgggaataaggatttatctattataataaagattcggctactgagtgtcaatctaatacatgtattaagtgggtcaatgaggtggggactccagtctgtggctaagaagcagagcagagttgcctgtgaacaccagagtgcccaatacacaaggattgaagtgcagcaagtcagtaatgaggccgattgagttaaaccaagatctgacctctccattttaggaagaagaggaaaaaacaattctgaattaatgtttgcatggacttaactttttaaatgtcttttaaagtagttactctctcgttctctagcagatgagtttgtttcatgcttttaactttttaaacgtcttttaaaatagttactctgtcttgttctctagcagatgagtttgtctcatgcttttcactttttaaatgtcttttaaaatagttactctctctcattctgtagcagatgagtttgtgtcatgcttttgtgtctcttacccattagctgactttgggtgtgataagtgactaagactcctcaaactttgaacaaggaatataccatttatttatgctgtatgcatgaagggaaaagagacgaatatcaagtttttctggccaaccaagaaataaaactttaaaagtgtttattttttcaggaaaaaaaatcacagatactacttaaatattattaccaggacaacaaattagcaaataaggcaagttagaaagcagcattttcaaggttaaaggttgcactttaaagctttaaccatgacttctgaagggatcacacaaacatctttaaagacttctttgttaatcagaaaacagtttacatgcaaatttccacactggagagccgaccgagatcaatactttcatgattattcccaatttactgctttatcagaaagaactttactacgaagcaagaagtgtctactcttctgtgaaggagtaagttttctccttgtttctgaaattctttattctagctgaattctcaagactgagcagtgaacttccattggttagcaccaaatagagcaagcctgagtaagctgcttataaaaaggggaaaaaaacgacagaagaaaacttttaataaatggaatatgaggcacataatactctgcttctacaaattttctttttgttgcctctttggcaacacttaagatactaaatttaggtctgcataaaatccattatcctttgctcttcagatttcctccccagtccatttctaaatgcatcctgtgcccttctcatttactatgcaggtaagagagtttatgagaagtcattaaagcccatgttcttaggtaacattgtttaagcattaaacactacatgtaaattgtcattctcaatattattacaatactgtctttcttaaagttgcacattttacctagaaatccgtggcatcatactctgaaaagatcatcttcgatataatgcagaggacacgtaaaaacactgggttcccaagagaaagttccatctctgtcatacatagcataattatcttaggctctccatatttttctaatgataagtgaacgtaagaggttaggctcgtgccataccttaaacattgaaggaggctttttgtaactcctttctcttcggctgtcacacacatcaacccagatgaaaggcactgctagtgtttctgcctcggtggctagtagcgtgggagagcagatacactttttaaaaatagccaaatcttgcacattgataagaaagatggagaaaggttggagtttttcgctcagttttgtgttcccatagataagaacatagcagaagttattaggtttggcctgtcattttcaaggaaggtcagtatctgatactgagtcatctttatcttctggttgagtccctatgacaagaccagaacgttctagtagaatagagcagcagctttctggcattaaggtacttgctcattgacatgccctattgctctcgggggaggaaggatgtgtaatcctcctcagcctctgcaatgtgatttcaagtgaggaattgctttccatcaataaagcggtcaagtcagtttttgacaagtttattagtacagtaagactgtggtatcaggacccagttcagaggtgaacaaagccaaaccatattgtttgagggcaaaggcaggtttttaggggagagacaaaataaatatccaagtagaaacaaagctagacttgagaccttggagataggttgacagctgtctatttggaggttcttgtgtctcatccctttttgcaggatggaactcagagctttggatgacgactggctaattctagaacactgcactgaatgttactcattagcaggctgtggttagagcagagtgcctttccaagtagtctcaggatgccagcgggacctgcctgtgcagtgaccatcttgagtctgaaatttaagtggaaagcagcaaattagccattcctgtgtttagaggaaaactgagtttagttagaaggtgtgaagtcgttggggccagcatgttcctactgaagaaactgggaatcctcggcaggttagtagcaagcagaactttagagtcccttgaaggaaggttgaagtgatgtttggactgctgaactgcagagtgaacctgggaatgagatgcactgacaccctcatcagtgctttccatcagtgtgcaagacttagctatttctcaaaagaacacagcttcctctcacatggaatgtcctaccattggggatgtaaccagaagcctctgaagcctactcagttttttaggtgaagatcccagatttttgtttgtcacaactctcatggttacatttataggtagggaatccagccacttcagtccagtttctgaaaattcctggctaggttatttttcagagttccatttggacattttaccacctcttctgattgtggacaagacagtgaaggcattgatgaatgtgtagggctttacagctttatttacaatccaatctggaaatgatggactcctgttacaaatagacacacttaatgtaccaaatctggaaataaaatatttcagaagtctttttgacagtcattgtgttagcctttgcatgcatcttctatacccagtgaaattactaaagcattcacatgaaaacccattttttctcatttgaataaaactaatgtgaatatgcttataaatgcctgcctcccaccctacagccccatccgtagataagctgctctcgttgtctttatggctacttcccacaacatgaatggacgggtcaaacaactcacacagtgctgatgagctacactggtaaatttggagcatgccacccacatatgattttccctggcatcccttcttgttggtgtgtaccaggccatgggacactggagcaagatgaaggcactttggagctaccaagaggctctctgaaaccctgacagtctttagagtcccttctacgatgtggggcctgatctaggacagggacagtgtgggaaagagccaccataagggactgttcagtctgagaaagatgactgaccatagataaccttgaccgtgttattcaccaaaggaagtatatttccaaaacagcccaacatgggttacatgagggccgtgagaaatgtaagctcctccaagagcgtgcagccctcactgttttcacaattgtccatagtcaagacaggaaaaagtgagaaagaaaagcaggacttcatactccagtgagagcgataaactttgacttctggacagaatatacagaggtcaagatgaatcaagattcctctttattgagaagagattgcatcccaaagatcaatttgcttttctgtgagtggttagtcttgtctcctcagttatacacaagtgtttattgatagacctcactatatctcgatgcacacgtacaagcacacacgtcattccaaacagtatatttaactggcaatatatttagcgatttaaaattgtagttttcaaatgttatcaaacatatcaggtgtcctaatacgtcaattgattttaccatcataatttgagctttaagaacaagtatttaaaaaaaagacccagtattcaaaaaaagacccagcagctcatccgtggggattgtcaggtgacgagatgttttttccatttgaattttaatttctttatcagtttttaggtaaatataaattattaactaattgcctcactattctgctggtacaaagggaattaggaactttagaaaacaaaatttacattaaaaaataatgcaattgttatttaaaattggcagaaatgtgatatcttgaaacattattcagctaatggaagtagagtgactcttggttgtcataatattgtctggaatttttaaaaagcaatttataaagatactagtttcttaaattacagctccctgtaatttgtatactcaggtttagattcacctactctgaaatcatggtggtaggtagtcattgagctgttctgtaaggcaagtgtcaagaatttaggaagttccatttaatttagcctttgtgaaaaaattctactttttgtatgaattgtgtgccccacccccactcccaaatattagctccacaaaggcagaatttttatctcttctatttgttggtgtgttctgagtgtcctccacagtgtctggctcaaagctgcttaaagatgcttcctttatggaaagaatgaactgtaataatttatatcacccccccatatagaagacataaccttctcttatacccccaaattcacaaaaatagatatgaaaggattttctttaaaagtactaagaacttgaataatttatgtagtcttctgtgttatattggaatagcctccttgttgttaatacagacactttttttaaaaaaaagataaataacttttcagtttgtacctgttacgtttaaactttatttttaaactgcttttataacctgagcaattgtttttattttgggagagaccttttccaagtagaaaaccattttaagatttaccagcgcagcactaattacttcaatttctgtagtatatttctgcaaattacaaagttcaaattatggctcttgtaaacagggtttcctggtgaccatggaacctgtactttcatttctcccgcctggaaagctttcttaaagtgctagtatatataaaatattaggagttttgacatgatttcataaatttattgggagtctaaaattcttgtaaagtttacgtatttagtgaagtccttaaaaacaaagctctttgcattgaagaaatattaaagcctttaaacatcaaagtttcctggagatttcctgcctgcattagatagagtactcctgtggaaactgcacacctagctcagctgcaatgtgtccacttaatttctgtggaaatacgcagctttataaccataacactggagtccctattgcattccagatttatcttgcactcaccctcttcacttctcaggtcactttagcgttcatagaagaaaagcaaaatctcacattatcaagaaacaggaagaaaattactacattcttaggcaatttggagtttatttgcaatcctttttcttccaagcaaaagaaagcaaggaaatgctgatccagtgttccagtcattttagctaaacaggttaagtagtccctttctgcactcctgcctcgctgagcgtgtaagatacaaggaagaaactcactcagataggctcctattgtcccctcacctgctggttgcctttttctccagagttagcagctgtctggtacgggagggatgctgcatgtggtgagagtttgccctcccaaaagtgccatacgctgcgtttactagccatcccagaaacccagagagagcaggataaacctcaagtccaaagaggagaaaaggcctgccttaaattagattgaccctaaccctgggggtttctcagccaaaactctcttgacctttggggccagattgcccttgttgtggggctgtcctgtgcgttatggtctgtttagcagcacccctggccctgcccactagatgctggtggcacccacccacacgctcatgacagcccaaagcatctccagacatcgccagatgccccctgggggcacagctgtcccagctgagaaccactgctccaacttgatcaaactcaagattcatcaggagaatgagaaccccgtgttctttcattaattccgactgcttacagtttgcctcatatcagaaaacttacacgctaattccatctgttctttagattttttaaaaaaaaacctatatcttgcatcagccataaaacaatgactgtagattctctgagggaaaaaaaaaacaccgtgtagatggtgttctcagcaggtgagagtcagactgcagaagcaggccagctcctctgtaagacccacatgaagattactgttgccactgccagattatgttatgtctcacacagagtcgccaccttcctctctctactccccatcctgttccgccttctgaatcgcagcatcaattgttgacttaagcaggcaaaaactcaaactacatttgaataaagaatttgtcagtatctgcatttgttttagtcttctgtatcaagagaggaaccccaagccccttatccagctaaccagaacaccttaaaagtgtttgtcttcaaaaaagatatcacatgaaattgtattattaataaattagtaaataaggcaaccaatttaaaaagcaaacatttagaagttcaaagctgtattttaaaggattcagcaacaatctataaagcccaggtgtcttaaaatacttgtttggtaataaaaacacaattgtacatttttacatgtttccacacagaatagcagagtaagcttgtagctctttaagagaactagctttttaacccagaatagtatctgtttttctgcagctttaggagagaggaagcattttctcttattctgattttttttttccacaagcagcagcatcaagaataagcactggaattatattagcatctggcacgaaagagtagacctgagaagcttacagcttaaaatacggggaaagaaaagggcaaaagagaatgtttagcaaatggaatattggccaaacggtgttcaggctgtgcgggatatgcacttttatattttagagggctgcagcatttcgtcttcttttagggacagtatattatctagttgagagcataggctttggagtcagactggtttgggatgaccccacctctgccacttactaggtgtgactttaaggaagtcatttaaccctccaagcttatttgccaacgtgtgaactgaggataagaatatctgctccttagagtgttgatcaagtacgtagcatggcgcctggcactgagccctcagtaaaaggtgattccatgttgattcttctcctctgaagctaaaggctgtgtcgctactgcagtttctgtctgcttcaccctgcatcgtccctgccggactaaactcccttaagtggcgattttgcctctattgagtaaaaacttagcttttccccattgcttatcttttccatctcgacttttctgagcaacttttaatatacaacttaaatctgacactagcttttctatctaaccttattttccaccattccccagaatcatctttccatatcagatagtttaatggtctcatgttccttctaaaacttaattcatatttacttcaccagaaatgcttcctcctgtcccaactctgcccatcctttgaggctcagtttaattccaacctcttcagagtaaaacctttttcactccagtccttattcactcatttattaggtacctccatgtgtctggcaacagataggtaccaggaatgctacaataattgaggccggcccctgtcttccaggatttatgcagcctgatgcaggagagacaggtagataagagaagagctgccagtgctaggatgggcagcccttcacccttcatggacagccttcccctggctcctgtacttggcggatgcctcatgaggatttaattatacattgttttctttgtactttagttgctgagtctcatatccccaagtaaattgtaagcataggactgagtacacagtgagcactttagaaacatatgctggcttgatctttcacctccagatgcatatttaaaaggagaatcgattgcctggcctattgtaaaggccttgtaaactttaaaaagcaaattaaaaaacaaaatcaatgatgacgttaagctcttggggatccccataacgtcctggtgattagagtggctaggcgactaggctttggaattcatgggacagtgcacttttaaatttggcagttctaaaatgaaaataaagaattgtcctttgactctaataaagttagcttaatggaaaactcactgcattgtcctcgtttttctcactgtgtcacagaccaagaaaagcgtcatccaagctcatgacaggtgttccctgaatttctgagctgctgagtgccactgaggagctcagaaagcatgatctgaatcgtgagcttacatgcgacacggccacatctcagcttcaatgccatgtcacaggctcagcattgacagttcacatacttggctcataagataaatttccaggtgtcagtaagctgcaccagagaagatactgtatgtcacaaactccaggaagtcctgagcaagcccacattttcctttccacagaaatgaacatttttaggtggcttgataattttttactctttttatttgcgagctttcccattacggcaatcagagacatttttccaagccctctgatgctcactaatacaagatacagcatagtacctaatgatggggttggggagggtgctgagtgagatcaccactaatgtgcaactcctagaaagaagcctttcttaaagggccagcccaggtttccagaagcaccattattgtaggtggctgggaaatagcagggaacaagacagaaaagtccttgttctcctggagtttacatgctagtaaggtaagaaagataaataagcgacctacctttagatagtgataaatgctacgaagacataaaatggcatgatgatgatggcagttgaaaaaaattgttaaattattccagcagtacaaggtgagcactggccacggcaggtcccatgacagtttatctgggagcaaatgaaacctgtttggatgactctccatattgaagcaatgatagtaaacacatagctctagccatggttctaaatgctttagatctgtgctgcccaacatggtagacactagcctcatggggacagtacattttaattccaacaaaaaatgaaaaatttctcagacacatgagccacatttcaggtgttcaatagctacatgtggccgcaacagctacagaagagtgtggtcacatctctgagcctcagttctttaaaaacagcataatcatacctatcttgctgattgtttcaagaattaagtgatcatctataagcctggcacctaaggccgcatgcggtggctcacacctgtaatcccagcactttgagaggccaaggcgggcagatcagttgaggtcaggagtttgaaaccagcctggccaacatggtgaaaccttgtctctactaaaaatacaaaaatgagccgggcgtggtggtgcacactggtagtcccagctactcaggagactgaggcaggagaatcgcttaaacccaggaggtcgaggttgcgattgcaccactgcactccagcctggtcaacaaagtgagactccatctcaaaaaaaaaagcaagcctggcagtcagacatttggtgtggctgctttattggacaacagagaatagaatatttacatcatcacagaaagttccattggacagcatctgttcagataaactcaatcttcccccacatcctaatgaggtgtagatactgcttttccattttgcagatgaggaagtaaggcacgggagttacgtgtgacttgcccaaggctgcatccttaacgaagggcagaactggaatgcaaaccgtggaggtctggatccagagcctgggggttaatcctaccctgctatgccgctatagctcgcggatccagtacagctcatctgtgtgatccactttcaaccagagtgcaaccgagggagagaacattacctcttcagaaaatcttgtcattgaatgcttttaaagtcagctaacatgaattctgacgagaggatcaggaaaaatgtaggcctgtcataggcacaatttccccctccttgaaaagggcagaggaaactacaaagcaccaaaaaaataccaagtttatgtatgatctcaataaggcagattaagctctctacgcctcagttcccctatcctagagcggtgtgaggatgtaatgaggcaaggcctggaaagcctcagcgggacctgccacagtcagtgacgccagggaggtcagcagcagcattaccactgcactcaagcggccacacttgggccaaacgttccagaatgcacaggacacagcagaacagaccacttatgtgaggaggcagctcgtccttctctcccagagctgccatgagagtctgtggttccaaacagcctgagtttgaaattggagagcacttcaggaaggcacgaggcagaggaggtggcagcctttggaaagaatctgcatttggctcatgcatttaggatttgcaagtttagttaagtgtcttcactcatctgagcctccattctttaaaaaatgggtttaattggccgggcgtggtggctcatgcctgtaatcccagcactttgggaggccgaggcaggaggatcacctgaggtcgggagtttgaaaccagcctgaccaacatggagaaaccccgtctctactaaaaatacaaaattagccgggcatggtattgcatgcctgtcatccctgctactctggaggctgaagcaggagaatcgcttgaactcgagaggcagaggttgtggtgagctgagatcacgccgttgcactccagcctgggcaacaagagtgaaactctgtctctaaaataaaataaaataaaaaatgagtataatcatacctaccttgcatgattgttttcagaattaagtaataggccgagagtggtggttcacatctgtaatcccagcactttcagaggccgaggtgggcagatcacttgaggtcaggaattcgagaccagccatggcgaaactccgtgtctactaaaaatacaaaaattagccaggtgtggtggtgcatgcctgtaatcccagctactcggggctgaggcacaagaatcacttgaacgtgggaggtggaggttgcagtgagccaagatcacaccattgcactccagcctgggcgacaaagcgagacccccccatctcaaaaaaaaaaaaaaaaaaaaaaaagaaggaaaaaaaaagaattaagtgatcatccgtaagcctggtgcatagaaatttggtaaataatggtcataattactattttgattaatgattttcagcttctcattaacaaatgtccttgagtattttcttgcccagatgccttagacccagggaatgtgttaggacagttatcctcaaacatgattgctgttaccaccctttacagtgcagtgatcacacccttgagaagccaggcagaaccaactgaaaggcatcgtggggcgtgcacatagcagctgcttgcaaagatggaagctgcctcacactcccccacaaccagcaagggcagtggctgccaggtatgacctcaggtgaccatcctgtgcattctgaaaactgggaagtcaaactctccaggctcctgactggccagtaggcttcaccagagctggatcaaccagaagaagctgaaacatccaacctaagaatttcgaacttcaaatggaaaatctgggcactctaaaccaaaattgctaagttccaaaaatgttggatacatcgggtgcttatttgtaaaagtatctaaatgaaagtgggcccttaaagagtgtgtcatgaaccaaggattataattaaccccattatgggggcacaaggtcaaatataagaggaaaaaacaaagtcagttgtacaaatggaaaaagtgcaaatgaaaaatgatgacctttaacaaggcaaggacagtaagaataagaaaatactggattgcctctcattctctgaaaaatcctaatgaatatcagatgtagtgattttctaccttccccaatttatttcactctcctcccacagctgataaataatctatgaaatacagttgtcctgccccttattttacttgtcattatttgttttcatttattttgactgggttaatgcactaatggctcatttatctacgatgatcaaaatttggttgcaaagacagccctaaagtaacacctatttgccttctaccgttctctcactggtctctggatgttagaattgctggtgcattttaaacaacagacattcttaatggatagctgttttgtgggaagcttttcccttcccctggaacttaatgcgtgatttcccagagagctgaaacatacgattctgggaattctcttgttccctgacataataaagagtgattgtgagtgggaagaactttatgggggtcagtcataaatgccgtcagtaagcgtgcctcacctattctacgcagcacaggaagtttgcggagaggacgcttgaactgaataatccacgctggagctctcagatcactagatggaaagtcagaggtcaaacacccttacatggacgtgctgaagccatcaaaaaacaaaacagaaaaaaacctctaggaaatgatctaggaaaatggtaaatgccctcttaaaaatataagtttatcttttaaaaatattggtacttaggctgtgttattccaaataaataaatgttcaataacaacaaatatctgattattgatcaccagaaggtatgtaagtactaaaattaaatgcctggtcatggtgactttatttactgaagtgactgttgttggactattttaataatttcaaagatctctaatgtcctccctgtctcaactcattggaaggaatcagtgtgggcccctttcatagacgggcaagttggaagagttggcttgcttttgcttgatgcatagctaaattcttacactgtccaagatgacatggctgggactgggcagagctctttctaccacatcacaaggataacgtctctttataagtggcagtcatcttctctgatgcctgttataggtaatgaaaccatggactcttttactttttgtaagtaataaaggaaaaatatggctaaattaaagtggatagagccaggtaaggggtctggcatttataatcccagctacataggaggctgaagcaggaggatcacttgaggccaggagtttgagtcaagcctgggcaacatagagaaaccctgtctcccccccaccaaaaaaaaaggtgtatagagcttcaattactaaatacctttctttccttaaaacctgtactataattaggcagacccacaaatggataaaagaaggcctatcagttaagtcaggtgaattggtccatctgtttggcaaaccatagagactgagatttttaaagcaagggaacacatctccttggcctaggaccttggtttagattgtggtcatcaagcgctaagattaagtatttcctatttcattaggatgaatgatgatttggcatttgggatcactgtatcttttagttatcaactagtagacaattaaaattggcagtaatctcaatctgaggtggaaatggaaagaccagttggatatgaactgcttacttccccttccattaaaggaaagtatcactagctagaactgtttgtgtagtaacttaggagatatttgtgtccttaaattgttggctcaggatcatcttggtaaatgacaagcttgttagaagtgtaccagtgacatttctactaagttgaaaatgatactagctctagctcttgaaacaaggctatttgggtgatccccagagggcagtcatactgggggctgctgagaaagggcaggaggaggatgcacggagggcaggaagggcctgagcagcacctccatggccccatcggtcacctcctcccccagaagcaacttctccctgagcctgtgtctttggaatagaaagtgcagagttgacactgtatgggcatcgcccctccagctctgagggtccggagatggaatgctggtgctccctcctcctggggtggggtctgccgcccgctggcctcctggcggttaggaacccaaacttccatgaggcccaggacactcccagaaggcaccacacgacacagatggtaggagcacatgtatttgcctatcttggcctgcacaggccagttaaaagacacccgtgggcaaccggaaatatagacttgctttcttcatgaggcattttcacacagaaaagccaagccctcatcagtgtacagacccgtgacatggtttttaaatagaagccaaatagaaactcttaaagtatgagataatcggagtgcagagaaacccagttaataagtccatcatgtaggcctccagtgactgcagccttcccagacaggctgcgtaccctctttccatgtgtaattgtcaggctctctaatcacatccattacgactttaatgttaggctgcacgttctttcagaaggaaatggctgtcaatgtctaaagaattgtcgatgagccttaataaaataaaatacatatgaaggataatgtcagagaatgacaggaatgtataatgcatggtgggaggcacctaagttctcatcattgtcattttctgcatatctttgggacacgaaattgttacatttgtaacaactaccttcccattaattattcttggtgatggtaaaccaatcacaattttagcaatccaagattaccctggaacaatattattaaaacatatgatactactttgttagtggatatttagtgattatcttttttaagagaaaactttattttttctgactatatgttcatcattaaagaagctttagatagtactaaaatagaacttttaaaaggtaaaaatcaccgagtccaccatctagagacaaatgtttatttgtttgtttgtttgtttatttgagatggagtttccctcttgttgcccaggctggagtgcagtggcgagatctcggctcactgcaacctccgcctcctgggttcaagcgattctcttgcctcagtcaccctagtagctgggattacaggcggatgccacgacacctggctaatttttgtttttgtttttgtttttgtttttgagacggagtcttgctctgtcgcccaggccggagtgcagtggcatgatctcagctcactgcaacctcctcctctcaggttcaagcaagtctcctgcctcagcctcccgagtagctaggaccgcaggcgtgtgccaccacgcccagctaattttttgtatttttagtatagacagagtttcaccatgttagccaggatggtttccatctcctgacctcgtgatctaccagccttggcctcccaaagtgctgggattacaggcatgagccactgtgcctggctgagacaaatgttttaacactttggtgtatatccttctacacatatcaaaaatgtgataatatacatacaatttttaacatactgtttacaaacttaacctatcatagacatattaccttgtcggtaaatatagatctacactattttaaattattgcatactttagatgtgccatgctagccccttgacagacgttgagattattttgtgtggtgattatcttgcaaaaaatgacttttttttttttttttggttgctactggagttttctttcctcttctagcttttagagatgtgcctattaaaagatgtctgctgcttagccaggaataggggaacccacaaaacatccccatccaaagtttccgcatttggatgagtccaaatttagttcagttaccactttatcacaataagccagacacactgcaaaatgttttatacaaaaaatctcattttaccctcccagtcactgtatcatgtaggtttgattatttctcatgttgtagaagagaaaggtgaggactcagagaggttgcaactcggatatggcagggtcagaattggaacccacgattctgactcttgtgctaagctctcaacctcacctgtttttgctagattaaaaaagcctaattctttaagaatgactaaccaacaagatgttttatctttttaaaacataattgcacctttgccttctactttttgcttccactttgtaatcgtgtttactctttttaccaaaatattcctggagtcattgttgagtacttacctttccttgaaatgttgtccgtttttattgctactttaacttttagagattttcagctcacttactaattgaatttcttagatacatgtacaagtaggaataatagggtcctaccatgcaaaactatttatccagttcattgtgaattcagagtaacatcagtattcattttcagagatggtgagtgtcctttcttaaaagcaggtatttggaattgagagttgatggcctaattagccatggaccattttttagcctcgtgaagtactatagatggtttcaaagggagaagcaggctttcctgtccctcagggctccttgctctgcctgcctctctagttgcctcccccagtggctcttctccagtgaaaatggaggatagaggtcccagaaaatgcttctatttgcttttatccttccctctttggaagtaattggaatttctttgctagctcatttccgtacttagataatattcaggaaatgccctagttggctaagtaaataatcttgaggtatatttatagaagtattgaccaatgtttacataaaaataatatagctaacattcattgagcactactctatgccaggcccgtcctggttgcttttagcacttaaagccaccccatgagttagacatcacaatgacttaggtgacaagatagggttcagatacagccccaagtacggtctgatatctcaagagtttgtccactccagtctcttttgtcccattgtgttaagcagatcttctttgggccttagtttcttaatcttgaaacaaaggggtgttggatgcctgatgttgaagatttcttctaccctcaatgttttctgactccatgaatctacttagaaaaccacctcactgctaggaatcattttatcctcctgttacatttaatcactgcaattgctgcctttgttctctggccagccttcattttcttgatggcaacgcttaagctatagtacaccagagcggtacagaaagtgcccacagaaaagcccccagaggtccttgtgcacaaacgtggagacactgtgccctgttaagggccaggcagtgctgccaggtcagggcctttcaaaagtgcacagagagggcagcagggctcccgttgttcatggtaggagagaaccaaatgtgaatgggtcataacttattcatgactagaatctaaaagagcttgttataactcattcacagctaccacctgagtgctagtgtgctattttttttagattctaaaattattaccctgtttccacaggctttgtgttcaactaaaagataacgtttgttcttgattgctcagaaacaatctcccatttttaaatggtgagaccctttcctaccgaagatattccatttctttttgtccaagaaattggtctcaggaatacgttggaatattgcttctggaatattgagaaatgatggggtgaggtcatgttcagattcatgctgctgaggtgctttttgacgaacgcagtgtagttctggtttagatctccactcggtgccattatgaagcggtaggaaatgatctgcagcacgtatgtaatgcgtgagttcagatgtgcaggaagaatggaagttaatgaggcgggggcaggggatggtttgccatgggagttctagacagagggaacaaggtgtgcaaaggccccgtgttggaggggtctgggccatgccaggggctagaggacccgagtgttgacaagcacaccagccccgaggggacccagggggatgccgctggggagggcaggctgaccaagcagggcctctggagcagtggggcttggtcccaagaaagtcagagagatgcaaggtgatcagaaatgtgcttgaccatgaaaacttgtgccaaggaggatgtgcacacaggagagacactaaaggaaaaggcatatttttaaaagggggaagataagtctggccttggttcctcccacgggtaacatcagagctgtttttggcagccaagtgctgctttttcccaggaatagcctattgctaacttggcccccagaggactcctatcagcctggccttgcaggggaagagagtgagtctgcccctggccctgggaccgagcacctgctgggatcccagggaccaggacgcacatgctacatagtggaataccttgtgctttcttcctaagctagtcttgctgctttgttaaggccccagaaagccccaccctcacccagcttcctaggaacctttgctggtattacgagcaagagtcattagtgagtctttttgccgtattgggtggtcggcagtgcctttacagctgtgtgattttctaacgtggaccctcgagagccagtggatccagcctccgtgcgagcagtgctgttctgacggcctggccctgtgctctggactctggaggaacgctgctttcccttccgggccaaaaggctacttcagtgggctgtgtttgcgtttcctctgcagtttcaaagtattagagacttgatgtgcacaacttggaaaacatctgaatttctgcatgaaattaaatctgccccagacgtcaggattgtcaccacatcacctgcgggctaggagaagcggcaaggcttagatgcatttattggtttatgttctctcttttcatgggatagtgtcctcttttccccagaggcgggttgcaagagcaaatgatgtaagtaacgtgaaagaacactgtgctcgggcaagtcaggtggtccatggatagaattatgtcgtcatgttacattaatgccctgagaggaagggatagcactttggaatgaagatggaattcggcttgagctgttgatagggccccttgtcttcacgctgctggagagcatactcggcgaggccgggccttcctcagacacgttgacactaggaaatgacggcagtgcgcttccccatccaggaagctgtcttgccacgtcttcagagcctatctctataggatttggaatgaaaagccttttttgagtattaactttctgaacaagtagagtgaacagtaaattaatttacctagtggatttgccataggaaaaactgtacgtgtggcttaacctttgagccctgatcaaggtaacctattcagcaggactttgaccctcgaggtacccatttgcattgcttctgctggcgttctgtggggagaaaaactagcagagctgtgcaaagtcacctgggtggggctggccctctggcagccgtgaccaggccctgaagtgatagtcagttggagccccattttctgcagctgtgggcagcatctccaaggagggaagaagaccaatgtcctggccttgccgcctttggttgagcaaatactgtaagattgcggatggctctcagcaacgcttaggaacaaaattggatttgcctcaggacggactgctgcagtacaaagagcacacaatttgtagcgtatgcccttttgacacagaaagtgcaagcgttttgccaaacgggctggatgagctgccctccattcctggctgacacacagctaagatggggtgagtgcccttactcagcaggcggcgttattcatctgcagcagacgccctgcctttctcctttcatctgccacgctgacccttttagggatctgtcttgaatgctccttcatgtttctaaagcatctctgatactgaattaagcctcttgggaccaactccatttctccctctgaattatgtgcatctcccggctgggtctcctcagcctaaacaggatgcctcggtggcttcagtcatgtcacagtactgggagcatgacatcatcacaatgattacctctcttcagtagtgaaggatcgcaatggaaaacaccactgtcttttcagccgtgaaaactcttttgccctcagaaagccagtgatattgttactcttttgagctgatgagaaaataattgagtaatctggatgccatttggagatgtgttttgtttccctggccccaagtggacctgccttattcaggaatatcctaacagctgtagaatgccctgcacagatggcgtctccatgtcagggccttttcagtcagcacagagtgtggaagaaggggagagcgacagtcagtgaaatgccccaggccaggagacccttgtcccccactgtgagggctccgagtggctcaccagcgctcactgtggagctctgcgcgttacatggtcacactctccctgctcgcctgccgtttcttctccaggctgtctgcccattataatgggacgctttaaggacgcttttgtatttctgcagttaacagagtggattaatgacacacagcgttgttataattcaaagttgctgattgaccaaggcagttagagtatgaatacttactaaatcatatttaaatttgttacaaatgaaatgtaataccacactatgatagagatggctgctgataacatttgtactccattcccctctgcccccgtgggagagcgtagaagaaaatactgacatctacatataggcacatcccattttgtgccatcatggcgggtgaggtggtcatctcatttcgggatgttttagtatatcccgttttctttgagcaaggtgtgcctgtaaaggaagtgtgtccggaattggtgggttcttggtctcactgacttcaagaatgaagccgcagaccctcgccgtgagtgttacagctcttaaggtggcgcatctggagtttgttccttctgatgttcggatgtgttcggagtttcttccttctggtgggttcgcggtctcactggctcaggagtgaagctgcagaccttcgcagtgagtgttacagctcataaaagcagcgtggacacaaagagtgagcagtagcaagatttattgcaaagagcgaaagaacaaagcttccacagtgtggaaggggacccgagcgggttgccactgctggctcgggcagcctgcttttattttcttatctggccccacccacatcctgctaattggtagagcccagtggcctgttttgacagggtgctgattggtgtgtttacaatccctgagctagacacaaaggttcaccacctccccatcagattagttagatacagagtatccacacaaaggttctccaaggccccaccagagtagctagatacagagtgtcgattggtgcattcacaaaccctgagctagacacagggtgctgattggtgtgtttacaaaccttgagctagatacagagtgccaattggtgtatttacaatccctgagctagacataaaggttccccacgtccccaccagactcaggagcccggctggcttcacccagtggatcccacaccggggctgcaggtggagctgcctgccagtcccgcgccgtacgtttgcactcctcagcccttgggtggtcgatgggattgggcaccatggagcagggagcggcactggtcggggaggctcgggcagcacaggagcccatggagtgggtgggaggctcaggcatggcaggctgcaggtcccgagccctgccctgcgggaaggcagctaaggcctggtgagaaattgagtgcagcgctggtgggctggcactgctaggggacccagtacaccctctgcagctgctggcctgggtgctaagcccctcattgcccggggccggcagggctggcagggccggcccgctggctgctctgagtgcggggcccgccaagcccacgcccacccagaactccagctggcctgcaagcgccgccgcacgcagccccggttctgcttgcgcctctccctccacacctccctgcaagctgagggagcgggctccggccttggccagcccagaaaggggctcccacagtgcagcggtgggctgaagggctcctcaagtgccgccaaagtgggagcccaggcagaggaggtgctgagagcaagcgagggctgtgaggactgccagcaggctgtcacttctcagaagcacctaaataggaagcccatggaaacaaaagcttttcaaccctgaagcccttacattcctctggcaccacagctgcactcaacagactggcaccaggcccattcgtgggcctccagggtgccaggcactgtgctagggcttagggtgcagcagtgaacaatctggagtctgtgcgaggaggcgggaaacagacccacacttacagaccctcacagagacacaaagactagaactggggacagggtggtaatgcacccgagtctgggggccagggcttccgggaggaagtaaacttgtactgagacctaaaggataagtagacagtggagacccaggagaggtgggtgggagagaggcctaagaagagtgttctgggcagaggaggagccatgagagggcaccagggtgggagaagcacagcccagcagggcacccggaggaaagctcgtgccacctggagccctgggggtaggagaagggccagcgagggtggcggggccagttgcagggccgggcagaccagtctgattctcagagcagtgggaaccattggaggtttttaagtagtctcaatttaaaaacaagatcactctgctgccacgtggagagcagaatggagcaggtaggagaggacagagggaggctttctggcagggatttgggtgagggtgaggacggcctcagcagcggagacggggagagttgaacggatctgagagctgctttcaaagcaggatgccagcaagatcatcatggactggaaatggatggcgggggatgccagcgtcaaggccacccccaggttgtgcagctggggacagtgcttgtgaggggtaggacactaggcctagggcagctctcctgtcatccaagacccactaaattctggatcacatttaaatggttctttctctttgacagcaagccactaacatatgggctctgcttcttccatcagccaacagaatcctggatttgagtctgtcctttgaaagcatctctgctagagttcccacttccaaacccctttcagctcttcgggattcagcctccaggtgaggtgctggaattgatgccagagtgaacgactccggattgctgagtggaaggaaaacgtaggcaccgctactgacagctctcaggcgctcctgggattttccttcctttgacgctgaggctgttccgctttcaagcgttctgctttgtgagggaagggcaaggtcagaaggtgctcaccctttccacagcaagcacgcggcacacgtgtgccacacgctgaacctgccttggttgtagctggctcctttgttaaggtcagcgccccccaagaccacgtgctgtgcagacagtgttgggatctcgggaactgtggggttccacttagaaactagtgtctggcccagcagcctacacaggagagtttgcggttacagcacagagacggtttcggggacagaaacatcctttctcactcctgccggaatgctgctcacggctccactgaggaaagccctgcttgatggaaactcaactctgccatcatctgcagcccagtgcgacggcagtcaaaggccagggagagctatgctttgttttatagaaacatgcctagaaatggtcgccttaagttatttaacccactccctattgtcgggttttgagtttgtttctagtcttttccaactgcaaactgcactgtagtgaccattctcacagctacctcttttcacacaaaagtaataatttccctttggtagatttctaaaaataaattgctagttcagagagatgaccaattccaaggcttctgatcagctctgcccaatcactgcccgtggtgaggtgccccccgagactgtacttgccgtgtcctggggccactgccctctcctgccagtttttgtccccaactgaaagggcctcttgtttctctttttcttggtcctttttaggatgtatcattgttcattccccttcgtgagctccgtcgtgttttatttccttctctgcgttctcaggttgccctcggagtggagtctgtggctttccaccggagcagcgcccaggaagtgttttcgtgtgatgaaagtgtatgtctgaagttcgttatgaactcgtcctagctccagagctagtgtgcatgcatgtcactggtcgtacagataattgatgagcaattggtgtcgtctgaagcagtgacagcctgggtgtgtcagtgtctccaaaacggttccactgtggcatcctacaaatgggctgcgtcctgggagccattgagaagttgtacctcctttacggagggttctctggaatagcaaattagggaaaatgcattctgaggttctgtatttacaataataatttataagcaaataactcacatttcatcctcagtatttttcagtgctgtacaagcgtcttgaattactctggtagcttttccagaaagacccatgacttcaccacatttctcgagttacgatgaaggtagagtctggggccctgagtgagcatcagatgctggaagctggggctgggaggggccaagcattggggacagactccagacacctgcaccaccccctggccccatgagatacgttctcagaccttcccaagaaggatctgtggctcctctcagtgctgtgaagtgcagggggcttccctctggaattcagcccatctctccctcctactttggctggctccagatgccatttagaggaaatgtttggcccatttcccaggtgccagcttttcccatgaggaagctgtcagtgcttcctggtcagggaaatcttttgggcgtgatttggtcagtcacagtctgttggggtgaggtggtgcgtggagaggacaggatttggaaccaagggtccctggattagaatccctgctccatacctcactggctgtgtgaccccaggctcgcgaatctgcctctcttgatctgtttcctcatgagtaaagggaaatgactttgtactctggagtgggcctcactcattcatgtgccaggcatcgtgctaggtgctagggcacaccccaaggcgttcgggaagcagaggctgccgtccctggcctggggcctccctgcagtgatgggaatgtagccctggtgcccccacaccctgcccttcaggagccgtggtttccttctgctctctcctgggaggcgcacacccctctgcacccagagccaaggagggcaggcagccctgggaccctcttcaggcaccgcagccagggtctgtgttacccacaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacaggtacatcggggagcaggcccgggcaggcggggggcggctatggggcacggcagagcccagcgtcagaatgtgctaggcctgccctgcccccagctcccatcatcgttgcaggagtccatctgaatgccttatatcatcctcattgcataatcaagatgcactaagcataaagctgcaaagccttttcttggcatactgaggacttaagagattaaaatacaatggttagaatctccaatgtgttttggaactgataaccaagatatagcctgtgtgatacatagagccagctgctggattgtttggtttggatggttgggatatgctgtgggggaatggggaagggagtttgggggaacagagggtgccctctgaccccagggagcacagtggccgcagatgttttctgctgctctcatgctcacctctcctgctgccaaaccctgctctgtctgggtaggactcgctggctaatcgtgggaatcggttttgcattttcaaagctgatgaagattttgaaatgtacagtaaaagaattaatgtgtaacatttcccttttagatttaacatatgagctgacagtcaaaagttcggaacagacaggtaagaactcctccccagaagtaaatgacagtaggtttccctttgtggtacgtgttggtgccgttttcactagtcacacacttaggagaaaatgctcttgctgggaagagttatgcgtgtggcctgagctctctaagagaagatgagaaggatgtttggatccctccgtgttgcaagtggttattagtgggcagggggatgagtgattttgttttcttttgaatgacacatatatttggaatgcctattatatgtttttctgattttcctacaatgaacatgtgttccttgtgtaatcaggacataaaaatagacgtgagttaaacccaaaaggaggagtaacagcagcagcagcattgggcagaaccgcccccgctcctccgtgtcgctgccgcctagcatgggcctggcacagagcagcagcttgctaaatgctggcgggcgagtggtcacattactagacagctccctgaggatctggggctttctctggactacagccccagaaccctccccaaaccagaatcctccaggacctcaggaaaccccaaagggcagctgcctgctggccgccagagaagagacagaaacccaggccttcccagggccctctgtgcctgctgcaaagagcctgctccctaaaacagggtgggtgtttggaaagtgctgaatccatgtttgtgcagagacacctgttggaaacgggtttatcacgtcgggaaggcaatggatggctcagcaaggctagtttactttctgcagaaagggtgcaactcgccagcagtcttaccacgagagcacactcaaacaaaggagacgaggacatttataatcttcataacctgatgcaattgccctatgactgtgtccagtttccattgactggaatgggacctcacattctaagcttgacccgattggctaacagcttgaaactttcctaaataggcaaaagggaaagaggacaaagaaaagaggaagctagtcatgagagggtcaggagagtttccaaataaggaagagcatgcactatggtccagggctcgctcagccctgcgcaggcgtgccggggcaaggcggagcagctacactggaacatatatagagatatacatagagcaaggaaatgacaagctctttatggtttcaagaaactttgaagaacttctccattccccacaatgcctttttctaaacaggcctcacaatggcagttactattcatgagagtgtccagttccttgtaaaagacacagaccatttccaccaagccttagtggattaccgagcactgatttttttccatttgcattgctcatattacagcctcctgagtgcgccacccaggagcccagacatctttttgtctgcgtgtggtagggaaggcgccgtgggcttcttggggtggtggaatgggagcctgtcctcagaagtctccctgtggagggataccagggacctcccccgaagccctgggactgggagctgggcctgtgggaatgcagaggaacaggatttcagcctgacactagggacctccagcgtccacacctgccagcactgaagccttgggaaaggagctacccgtgtcatggaagccagggcgtcctcgctccctgtcctctcctggcccaggctaatctgaagcagcatagttttgccctgtggcctctccagtcacggttctcaacctgaggtcccaaggccacctgcccacccacccacccacctgatgtagtactcccagcagcagcagggtctcacagcaagggctgtgtcttaggggaggcagtttcaaaagcctctcaggtggttccagtcggggcgtctcccctcccagtggtgaaaatcattgttttacattagtgcacccaaaactgcccaattccaagcagtttcgggacccagggtacagcatagactcttggcttccctcccctgggggctgtgaccccagaagtctgggcgggcccagggagtgcgcaggtttagaagcgttgcagtgccctgacgctcgggcaggctcagcagtgcagcgtttggagaccagcagcagttggctgctgtcagctcagtgtgcaccaagctttcatgggaagactgaaatttccagaaagggggtacgtacagaggaggaggtggagtggagctttctataaagagcaagaaattggcaaaacaggaggtgctgattcctgggaaggacagtcactgaagcagctctccagagctggggatggaggagcagtcgtaccagctccttcccacaggacggcccactcaagtcggggccggtaaacatcagcccggagccaaggctgcaccctggaggaggaggcagcacagctagatgactctcaaggaaggatgatgaggaggatgtctatccaggaggagcttctctcaggatgctgtggcgaaaagaaccagagtgatgcttaatgagccccagatttgggcctctgctctgactcggaggggctgtgtggccttgggcaggttctttgacatctctgaacctgcatcttcatctgacaggtgccccacaaatccaagtccccagtccgaccaccagggccctctgcctttgtgggctgcccctcacaggacatgagcaaagcccagggacagccttgttcctgaatgttccaaacgtccatcagccttttgcagcactgcctgggggaagaaaaatcccaggatgctcacagcaggccagggatgtggttgaaggtctgaggttgcagcccttcctcggaaggagcccaaggcccactgtccacccgagtgtgggctgaaagcaaaggccctgcgacaggcatgggttgttgtcccacaggccctgggggaaggacagcgggtaccaggcccaatgccgtgcccaggtcagcatttcaggttgcaggggttcagcccaggtggctgggctcctgggtcttacagtgtctacagagtcgtgtgtgtgtctctgtccctctctctacctctgaaactgtgttttaggatctattttccttttggcaaaagaagaaacctcatgaaaggtagtactgcatgcatcctttttagggaggtcatttgctgacattatacctgcacatacacacacagacacatggtttttaaaactagaaacttgcaatggttcaacttaaaatttttcaactgcatggggcaatacccattcagtacactcctcgacttaccatggatatgtccagataaacccatggtaagctgaaaatatcgaaaacacacttttgacttacggtattttcaacttacattggatttttcgggacatgaccccatgctaagtcgaggagcgcccatcacctgcagcgagcttgtaacatgcaagtgtcctgcacaagaccagtccagtcagctgtgggccctcaaaagctcagagtctggcggcgggacatgctgcagagctgctgctagctcaggcaggtgggaaaattcaaagcaagacagacagaagcccgggaaagacgtccagtggcgtccagtgcctaggcaggccctgggtggtggagttggtacagggaaactgggcgtgcaggtctggagttagggcaaggacagagggtacaatagagacagaacaagaggtggtggcttggggagagtgatggaagctttgatttatgtgggagcagataacattcaggacagattgaggaactggaaggcatctggcagtttgggttttattaggcagtgaggaaccattttgaacagaggacaagaatatttagggggtgaccaagcttcctaaatacaggatgggctgaaacgaagaccagagaggaggtgggaccaaggccggctggaggagcagggagggggcagcactgagcagccagcagaaaggcacagtcagggaggggaggccagggatggcgactgcatccagtttccctgggagagtcaagatgtgggaagcagagcagctatctggacttgagggtgtgtctgacggacactcacttggagaagtggtgctcaggagacactgaatcgggagctgatgctcaagttgaattccagaccagcaaggaagagtctagaaagaacttcccaggggccaggcaaggaggatggccagccagccagcgttaggaggagtaggatggtgacccagggtttagagccaagggtgctatgtgaggtgaccagggactgcaggtcaccagaagagcaggagaaggaggtggctggtgtttgctgaaggactgggtgagggcaggcacccagggacagcaaaaggaggcagaggcccgaagtgttagggcaggggcagggagggaccaagggtaagagccacagaggcgagacagctcactctctgagcaggaagtgggaaagagtctgtgtgtgtgtgtgtgtgagagagacgggggtaggggggtgagagaggcggccagcggcagagcaaaggtgacagccccacacctcttctcctctaaacatcagaattttaattcaatagacatggataattctttttacatttgagtttcaaaacagtactttgaatgtagcaggcattccataaatgccatctgagcagacagagggatttgcggccagttgaatcctaagtgtttgctgaggtctgatactctgcaattgcctgttttaagttcagcatctttaaggttcagagacattcttttatgcagtaggccagagaactaagagccggaaagggcctctgagatgccccgatctccccacctcggggaggggaggggtctttccagagcccccacagccctgccttctgcatggcccccacagcctagacagggcccccaccagacaggtccgcctgccccataggcctcaccactcggcctcagtctaatgagttcttcacctgcttcctcggcttattcttgtaggagacgggacttctaaaagcagtgaattaaagaaaagatgtgaagagctggaagcccaactgaaagtgaaagagaacgaaaatgctgagttgttgaaagaactggagcagaaaaacgcgatgatcacagtgctggagaacaccatcaaggagcgagagaagaagtacctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcagggagccccgtgctggccagctacaagccagcgccccccaaagacaagctacccgaaacgcctcgccgccgcatgaaaaagagcctctcagcccccttgcacccggaatttgaagaggtctacagattcggggcagagagcaggaaactccttttgcgggaaccagtggatgctatgcccgaccccaccccatttctgctggctagggagtccgccgaggtccacctcatcaaagagaggcccctcgtcatcccccccatcgcctccgaccgaagcggcgagcagcacagcccggcccgcgaaaagccgcacaaggcccacgtcggggtggcacatcggatccaccacgccaccccgccgcaggcccagcccgaggtgaagaccctggcggtcgaccaggtgaacggaggcaaggtggtgaggaagcactcagggacggacagaactgtgtgaagcccgccgtgccccaccccgcgctgtccatgcactgtgagcaccactgggaaatctcagccacaccttttctgtttaatcccatgcatgccaaacacttttcacacctaccgacccattctccttctgcttctcttgccctcttcttcacaccaaaatatgatcgtgtccctgccgcagaatatgtatttcctaattgctgtggccaaacgcctgtgtgccgaatcgcttgcttctgatcccgctccgtgtaacctaagtgcgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccacaacctgaatgtgtgttcatatttttttgttagttttatccaaaatgtttaagatcccaacaaactttattttctaaacctgcc

SEQ ID NO: 38305 - DNA, 28034 bp, Homo sapiens
agaagtgcgactgccagctgccgaggcgttcggtcctgctgttgcggccgctgccccagggctgcggggacggtgagtcgactggacgcattcggagacggcttcgcgcgggagccctcctccccgggggaagggtctgggcgccagctctcctcaggtcggggcgtgacctcggaccgtggcgccccctccccgcccccgcccgcggcgcctgggcggtgcatgccgggcaccgtagtccccagcctctcagagcgggttgtggtggggggggtgaccgggcggactacaagtcctagaagcctctgggcggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggaggtaaagcggggccggcggttggggcgcggcatggcggggcccgtcctcccctcagggcgctgccgagacctagcgcggccctggggatgtcgaagccgctgcggtggcggggcccgggcgggcgccccgctgtgtgccgcggggttgtgcgcccggaatggcagcctgctcgcccgcacgtttttccgtcagggaaggttgtggaaattgccatctccgtcttgcagggcgagacggggaggggaggggtgggagttgttttctcaaggaaagggggtcgaggaggagccccgtggccgagccagcccctgccgagccccgcgggtgaccttggccgtcccggagcccagcagtgtcctgcacccgcgcccggctcgccgacgtgtggagtcgggatgtggcgctcggccgcgcatccccggcggagatggcgacggcctggcctagcttggggctaggagtcgcgccttcgaggaccttggcttagcgagttccttggggggcttctcaacaggtgttagatgaggtggggcgagtggctgtgagttcctccaaaggtgggctcaagatcctctgcgtcagaaccacctggggctcttgggaaacgggcagattcctggggcccaccccaggtgttgggatgctgtagttccgtcgcgctgcccaggaatctgcatttagtaggctccccagatcattcccgggcgcagctggggctgagaacctgtcccagtgagggggttggcgggcccgggggcagggacgttccatagtgtttctgccagtttcttctgtattctggggcctgatgctgggcggggcggtgcccgggcaagttactgctctcctgggttctttgctgcttcccttggggccgatctaggtagaactgggtggagggaggcgtgccagctctgccttgccctctgcccttaatcggaaaggttatgcccagtcacttgccagtctcagaagactccccctctacacattcagttacgaaaaacgtgaaacatacaaaagttgaaggaattttacagtgaacacccacagaccaccacctagaatgtagagttaacactttattgtatttcatcacatatttgtccaaccagcagtccctcttgttttttgtgtcaaagtaagttgcagatatcagtgcctttccctcccaaataagcatgcatgtcattaattagagtcttagaattgttgtttattgggtttgacttttttatcttcttaatggtttttaccttaatggaagccctgggtatttagaaatccgtctctcacccttgagaatttgaaggagttcggaggttttccacaggatgggagaaccagggaagagctttacaggttctcttacaaaggttcatttatttatttagagccagggtcttgctctgtggcccaggctggagtgcagcggtgccgtcacgacgttcactgcagccttgaactccttgtctccagcgatcctcctgagtacctggaactacaggcatgccccaccatgcccggctaatttttttttttttttttttttgtagagatggcatgtcattattttgcccagctggtctctaactcctgggctcaagtgatcctcttgcctcaccctcccaaagtgctgggattacaggcaggagctaccgtgcccaagttcttacaaggatttaagagcagccagccgtggttctagaatcaccataagagcagaacattgactgtatgatgtaaagtaatacttcagggaacaaaattgttttgagaaggagctaacggaatgcgtcccgaaggccagcttgccccagcagatcacgttggcaataattgaagctagtcatcagcttgcaactccctgtcggctctttacactgtaagcttgtccaggttgaacctaccagttcagtgtgtgttttctaaggtctaggggaactggggtgtgtagtgcaatttagctcatggtgttgatggactagaggccgtggctttgagacccttgggcccaggtactttgttccttagccacaaacaccagcccttcaccctactcagttgcctgagtgggagagaaaagataggccctgtgaaaatttgtctccactttgaggaacatggttccaagggtaaggacatgtttttactcatagaagacacagggaaatatggtagttaaagttgtggcattttatagcatgtcactgtcctgtaggtggaggaagtgctggtgagaaggtggcaggcagggagagctctgcagaggaccttggcgctccatggggaggatggagagagagagccaggccggcagtggtgacaggaggttccctttcccccacgaggggacttggaaatagattactcaaaatggaaatgtgcccctttctaggatcccacaaaaagtttctgtttctgtctctgcctagtcaggagtctccaagccacagtctctgtgggaggtggtaaaggctaccttgcaatacagtgcagcagaggtggaggcgcctagggcctgggccagaacctccccatgcccagagggctgtccactcttggagacactggtctggtggctcctgaacccgtgggcctgatggccccggtcaccacttctcctactctgtgagtcatcaggcagtggtccatgacattggtggtgtcctgggaccagggctgcctagacgtggagacctctctgtcatgttgaagctgtgtgacagacaggccttgctggccgcgtctgtgataggtgaagagcatcacccaggccacaggaaggcctgcatctgctgttagcgctgaagagatgaagggtccctgacggcagacaaagcaaaaccaatacagagcctgcagtgcagggtgagggggtccaggagcattctgattctttccttgaaagcagttgtgatgcatttttggtaatactggaccatttttccaggaaacatttcttgtcaccttttcagtgctcctgatttgtgggtgagacctggcttggtctgtacattgagtgattcagtaccatcgattcttactgcaaggaggtgtaatgggggttcagtaaacactgagggtcttcctgagatgtaattgttcaatcaatgctaattaagtctgaattcagatctagtcccagtgtctgggtttttcccccaagaaggaaaagaggccaagaaaggtggaagtaggtagagaagagtgcgagagctgccttgggagggtttagggagaatttcaacccgtattacttcaggaagaaagcgagcttggttgtcacaattctgattaacatgcaggccgggtgctgtggctcatgcctgtaatcccagcactttaggaggccaacgggggcggatcacctgaggttgggaatttgagaccagcctgaccaacatggagaaaccccgtctctactaaaaatacaaaattagccgggtgtggtggtgcatgcctgtaatcccagctactccggaggctgagacaggagaatcagttgaacctggcaggtggaggttgcagtgagtcgagattgtaccactgcactccagcctgggtgacagagcaagactctatctcaaaaaatcaaacaaacaaaaaccaaaaaaaaaaaaaaaaaaaaaaaccatgcaaacagcggcctcacaggctggggaagcaggaggaaatggggttctttgcagtgtaccgccctatgaacatgcgttgttctcacctgtcagccagggaggtagcagcacagtgggacttggccagctgaggcagcagccagagtgtctaagtgacttgcccatggttgccaagtaatggcagagaagggcccatggctggccctgaaacagcaggggtggcggaagagcagctgagggagacgtgggctctcccagccccattgtgatcactgcatcacggagttgactggaattcaagaaatggtgttttttcctgtctggatatttggctgtgaacgtaagtactttcctgaggacgcagtggagtctctctcggctgcggctgtgttctcaccctgggcagtggcctttgggttaagaatggcacagaaggggctgggtgcggtggctcatggctgtattcccagcactttgggaggctgaggtgggtggatcatttgaggtcaggagttcgagaccagcctggccaacatggtgaaaccccgcctctactaaaaatacaaaaattaaccaggtgtgggggcaggtgcctgtaattccagctactcaggaggctgaggcaggagaattgcttgaactcgggagttgggggttgcagctagccgagatcgcaccaatggactccagcctgggtgacagagtgagactgtttcaaaacaaacaaaaaagaatggcacaggaggtccacttaggtcaaccccaaacctgtgcactcatttcttcaacacacatggactaggcaccaagcagggcccaacaatacaagtgggagagtcccaggattcttgaggggagataagacaagggacagagaatcccctggcagcagaatcctcaggaaggcccaggtttgcagggaagtggggtgtgggcgtgtttggaggccagggaaagagtacgggggtgggcttgggaagggtggggggatgagatagtttggaggagtgtgagttacgatccggtggtagatctgggatatggtccaagtccagactcttccctgtcacccttgactgttagatgagatagtggatctgagggcctttgaaccatggagttagtaggacttgctgactggtcatggtttaaggagacgagaaaggtctggagcgcctctcagccatccagtttggcaatgggagtgaagtgaacagaagggtcctctggctggagagcagagttcctgcctagagcagcagccaagctgcagcccatccacccactaacccatgtttcacaggctgcccggtgccctggagaaactggccccaaggtctgaccctgccctgcaggagctatgggtctgactgggagatggccttgatcacaactttctaattctgcatgttatgagtgactccattgccctagacccagaattccctggccacctccctgcagggctgtgaagcccatgacaggcctcaccttttctctgctggagcacctgctgtcacagaggcgacagctcctgctgggcttgcctgtgtattttttataagttcttctcaagtgtcacttgtcttgccaggtagatctgcagctccctgagggcagggaccatgaggtgagtgacctccatggagggtctgatgagtcttttcaaacaggtagtcacttaaacaaaaaagagaggaacttggatggtgatggctctgctgagtgaaacggcctcatccttgaacctgaagagtcctgccctgttcaggggagaaggcctcaagtgagcacttctcagatctcagattccccaggcattttgtgtcacctgacctcaggccttagtttctgtccccagcatggtcaagctcaggttctgtggtgtgtgtttagctgctttgcagggacagtggccacaccatgacgcatttctctgtggccccagtaaaattggccaaaaaggaactatacctgctggaggtggtagccgagtgctctcaggctccccagctctaggagccacctacttgatgtcagaactttggagaactggattagcatggcaggtgagtgcggaaaatggagagtcgtggggcgaaatgatttcccaagctctctgcaagcctctcggcttatcagggtaaaagtgggcatcctgctgtggccagaggacccggctcacccatcctccaacacggagtgttccctgctcagtggagctatccctggtgacaactgcagccctgtggcaaccacttccttgttcttccttcttccatgccacgctttgttctgtgccaggcccgatgttttatttctgtattttatgccctctactcagccccccactgaagctgcctgccattaagacagacgttgatctgccatcttcagtgcctaggaaatgcctcacgcatagtgtgtggtccatacttattggttgaataaaatgatacaccatgcctgcatttcagccgtctcatcttcctaagagccaagacgcagggaccgtggtcttcatgtgctccgtcattgcctgagtgttgggggtgctgatttgcatgctgtgttgaattcttcagtacacattcagtgggttaggttctaaagtcaactagcagagcaaagacctcataagtcaaactgtcctctaaagtccttgaattgcctattagctcagaggcactccccctgctagaggcccagcggggcctgaggaaacagcacgttctgtgtcccatttccctccccagggaaagcaggggaccgggcactgccacttcagctttttgtcctgggtaccatgaaatctatgtaaatggaacgcatgtgaaggaactgcactgtgtgagctacactgtgtgaagcactttattgggagtgtgagatcccactcaagtgtattttgaaaaccatttctggagaatgtgtgagaaaagaaacagggctgacagtgatgtggaaggagagagtcaggacagctgaggtcctgtcttggctctgtcatctccaggcagctggggtgcccggggcagccacttctctcctcggagactgctccccactctgtgccactgcttgctcgcccaccgtcatctccagcacttcacagggcacctgtcttccatgggtgcttagtaaacatttaagacagaaatgaatggcagcttagacttggacccagtcatctctgatggccttgcaacctccaaaaggtgttctctggccaggagcagacactcacacctataatcttagcactttgggaggctgaggcagaaggatcacttgaggtcaggagtttgagaccatggcaaacatggcgaaaccccgtctctaaaaatacaaaaaaaaaaggccgggcacagtgcctcacacctgtaatcccagcactttgggaggccgaggtaggcggatcacgaggtcgggagatcgagaccatcctggctaacacggtgaaaccccatctgtactaaaaatacaaaaaactagctgggtgtggtggcaggcgcctgtagtcccagctacttgggaggctgaggcatgagaattgcgtgaacctgggaggtggaggttgcaatgagccgagatcacgccactgcactccagcctggtctctgatgtctgagtcatagagaaatatatacatggccaagcagatggcagtcccaatcatgacgtgagctcctgttttcccaagcttccagaataagtcttctgtcccagccagcatgagtgaactcagggccagatgttgacttagagttacaggaacttaggcaaaaactgcaattacttttgtaccaacctaataaacttctatatactatttctttctttttttttgaggcagagtcttgctttgttgcccaggtggagttcagtggcgcactcagttcactgcagctttgaactcctggtctcaagtgatcctcctgccttgacttcccaaagtgctgagattacagtcctgagccacagtgcctggcctactgtatactatttctgttttttttgtttttgttttttttttttgagatggagtctcactctgtcgcccaggctggagtgtactggcgcaatctcggctcactgcaagctccacctcgtgggttcaagtgattctcctgcctcagcctcccgagtagctgggattacaggcatgtgccaccacgcccggctaattttgtatttctagtagagatggggtttctccatgttggtcgggctggtttcgaactcccgacctcaagtgatccgactgcctcagcctcccaaagtgctgggattacaggcgtgagccactgcacccagtctatatactgtttcatataatgcagtgtaaactactaattcagtttgtttcacacccaaccaatgtaagtgaattcttagggtcagatgccaactaagagtgatagaaactcagttaactaatttccatatgctatatactgttgcatctaatgtagtgtaaaatacaaattagattcccactctcagttcctagagcgctttcttcacccatcagaaatgtcttcaaaataattgaaagaatgccctgtaacatgagagatctaaatgtcgcagggatgagccactgtcctcactgttctgagggaaaattgctggagggggagcttctgtgtacaggtatgtatggtgactgacacatttggaggaagaaagcctagaggtttgcttttccacatcccaccccgacccacggaatagggggactcaggcaagacctggccgcgggcagagcccagctccctggctaaggacggccaggagacatttgtgtctgaattaagactcttccacctgggtggccgtgagtggccacgtgtcttgactgcacttaacggcctggtgcttttttgtaggttgcagtggtgtgtcttgatctcatccaacagacagctggttgaatagagtcaacccaagactgtccattttgtgtctgctcagtacaggcagacagaaggattttttttaagggctccattttgagcacttaaatgatggttctttaggttcatgctgtttctaaaattagtcagccttgtagttaccaaggcctgcctgtgggacaggtgcagatgacttgtttattcacttgtggttgagctgtgtctgattttttccttttgctctgcatttcccctcctgtctgtgcttccttcattttctctgctagcaggagagcatgcaggaacaagctcttgagcagcgttctgcctgggaggtagttcagagtcctggcgagatcactgggcgagttgggaggccggggctgtgtcctcagcatgggctctatcactcgtttttattatgcatccaacggggactttcttaccagccctctttggtcaggtgacctcctgctgggtctcctggcggggtctcctaggctagcaggactgtgaggtcattacattccaactttacagatctaaactttccatttgcctggagtaccgggaggtgatctggcagaactgactcatttgaccaaactcatgggagacctatggccataaggggctggctttggagaggaggccactaaccagtccaggcctctggcttgctctgcagagcattttctcctgtaggtgaaattagattatagtctgaggtgtgtttctggattgaggagtatgaggagtagtatatatatatttttttgagatggagtttcgctcttgttgcccggcctggagtacaatgatgcgacctcagcttactgcaacctctgcctcctgggttcaagtaattcttttgcctcagcctcccaagtagctggaattacaggcatgcgccaccacgcctggctaatttttgtatttttagtagagatggggtttcaccatgttggccaggctggtctcgaactcctgacctcaggtgatctgcgtgcctcagcctcccaaagtgctgggattataggtgtgagccaccgcggccagcctttttttttttttttttttttttgagacagggttcttccccactgttgtccatgctagagtgcagcggtgcaatcatggcttactgcagcctccacctcctgggttgagtgttcctccctcttcagccccccaagtaactgggattataggcgtgagccactgtgtctgacttataatgagcattttgaggaaggagtcatgtaaaggtgctgcctaccattaaaaaactagaaactccacatcagtagaacgtttctgtatgtgtacttacatataaacaaatcccctaaactcctactgcccagaaaaactgttaatatgtgttatggaagagtgcagtggctcacgcctgtaatcccagctcttagcgaggcagaggctggaggatagcttgagctcaggagttcgagacctgcctgggcaatatatcaggacgctgttctccacaaaaaggaaaaaacaaagacaaaaaatgtgttacgtatgtaaatacatctaaagaagaatcacactgtgctactgcttttttattcttcactcactgctatattaaaaccatttttctatgtcaataaaaatctatatcattggccaggcatggtggctcatgcttgtaattccagcactttgagaggccaaggtgggcaaaatcacctgaggtcaagagttcgacaccagcctggccaacatggtgaaaccccatctctactaaaatacaaaaattagccaggcttagtggcgggtgcgtgtaatccttgttattcaggaggctgaggcagaagaattacttgaacccgggaggcggaggtcgcagtgagcctagactgcaccattgcattccagcctgggcaacaagagcgagactccatctcaaaaaacaaaaacaaaactatatcattttttaggggctgaatacagttacattatatagctaatcacatgcatgtaaccagttccattttcttgaacatcaagacagtggtgcatataaacatctttgcctgtgaatctgtgttcacatgtccatttacctctagaacgaatacattgaagtggaattgagtccataagagtgtacaggtagcaaggctgtccaggaaagttgtactgatccactatgctgtggccccgtgctgtggacggagtgtcaccaagtgagagtggtttgccaggaggttttactaaaattcagcatgatataaattgcacagtaattgtcatcatcatagttcctagaggccttagtacttttaggtttagaaccattctttgagtcctgtctgccttttgattttgcttctgcttaagagcaacagtgtcaccgggtgcggtggcacttgcctgtaatcgcagcactttgggaggccgaggcaggtggatcacgagatcatgagatcaagaccaccctggctaacacggtgaaaccccgtctctactaaaaatacaaaaaattacccaggcgtgttggcgggcgcctgtagtcccagctactcgggaggctgaggcaggagaatggtgtgaacccaggaggcggagcttgcagtgagccaagatcccgccactgcactccagcctgggcgacagtgcgagactccgtctaaaaaaaaaaaaaaaagtaacagtgtcttcttttttctcgtgtacttcctctctcaggctcctgtggcaggccttcagtggtgtgctcttcacccatggcctctcccgtgactcatcacaattcttgataaggggctgctcctaccgccatatcacagatgaaaaaaaatctgagactggagagtcaggtggcagggcagggtggtgggcgtggggcctgatgcctgtgccccactcggtgcaagattctgcccctgcagctctgcctgcgacacagggctcatgcttctgttggagggcgcagtggtgtttggggccatggggttgggctgatgtcttttttattttatttttaattttatttttattttattttttattttatttttatttatctttttttttttgagatggagtctcactctgttgcccaggctggagtgtagtggcgcgatctcagctcactgcaagctccgcctcccgggtttgcaccattctcctgcctcagcctcctgagtagatgggactgcaggcgcccgccatcatgcctggctaatttttttgtatttttagtagagacaggttttcaccatgttagccaggatggcctcaatctcctgatctgtgatccgcctgccttggcctcccaaagtgctgggattacaggtgtgagccaccgtgaccagctattttttatattttgagacagattctcagactattgcccgggctggagtgcgacggtgtgatctcggctcactgcaacctccgcctcctgggttcaagtaattctcctgcctcagcctcccgagtagctgggattacaggcggatgccatcatgcccagctaatttttgtattttttgtacaaacagagtttcaccatgttggccagcctggtcttgaacttctgccctcgtgatccgcccacctctgcctcccaaagtgccgtaattacaggcatgagccaccgtgcctggctaggctggtgtcttatttccgctgagactcatcatggtcgaggaggagcatgtagggttgggtgggaggagagctggcagatgggaaaaccagatctgttttctggtcctttctgtgacttaagttgagcttgttttgaagtgtttagaattcccaaggcatcagatacacccatcttcaagtgtaaaaataaataaatggttcagagccacccgcgatgttatctgagggagggactgtctcgtcctgcctccatcaggacaatgggaaatgggccatgttcaggattttccaggcctgcctgtgctagaacttggcagccgaggacaacggtcccagagaaggggacacattggcaacctccctgagtcttgggagggctcagcctcactagaggctgctctgcaactgagtggacctttgtggagggcctcctctttcctgctcatcacccagcgttgggaatagggtccctctggtcagctgcgaaaggccacagggaatcctggcctggtcccacatggacttgggtggctggattagccccaggtttggatagggcatggtggagaggggagtggagagggtttggggcccaggagcagtctcacagcaggggctcccttttgagcacctcctcacttggagcacttccttcatgtccctgtgctgggcacctgcatccaaacagtgcatgctctattaacgttcactgcacgccatcgtcctcctcagctcctccttgagccagtgctcatgctgaaatgagcactggagttgcagaagaatgtgtcctcgctccaaggcaaccagctgcacttctctcggggcctgttttaactacggaagcatctgctccagccttcccgccagggagtattccccatgccttggcctctgtactggctgaggctgtgtcatgtgacctaaagaaagccatgatccttttgatcatggatcacttgaagagaacttgtgttccttcagacctaaggaactgtagagatatatttttgtggtggaggggggatagagtctcactctgttgcccaggctagagtgcattggcgtgacatagctctttgtagcctagaatccctgggctagaacaatcctcccgcctcagcctcccaagtagctgggaccacaggtgtctatcaccatacctggctaattttatttttttgtagagatgggatcttgttatgttgcccaggctggtcttgaactcctagctttaagcagtcctcccaccttggcatccaaagtgctggaattacaggtgtgagccactgcacctgtctgtgctgtatatttgtaatgacacttgttaatacttaacctgaaaataatttaccaataattaaccagtaaaccaagttttattactcatgtggaagatgtgggaggtggtcagttagttgctggtgtggtgtcccatggctgtcctaggcactggcctccatcccaaggccctcatggtgaagcacagctactggagccatggcatctatcttccaggtggtagatgggaggaaggcaggaaagatgaagggcctggctccgggctgagtcggcttgccctgaatgccttcttatggtctggacacttctgcttacagctcattagccaaagctttgtcactctaagaaagctcggggaccctcttggttgatggacttgccctgagtgaaagtggagttctgtattcaagaatgggggagagagtggatttgggtgcagctggcaatctccagtctgtacttcattaggcggaacattgctgtttgagatcttgttattctgccttcttcctttgcagtgtgatgtggaggagcacagcacagctctgtatgggtggtggtatctgcgtagtaattcatggaaggcgtctccagcaatacagcctggacatctacatgtgggattttgttcagccttccaagaacctcattttgcacgtggggaaactgaggctcagagaggttgaggaatttgtctagggctgcaggccatcagcggcgaggcagggtcccagggagacctgtgctctcccaatattctattgacagtcaagcaaagaagaccgctgtctttgtttccaagtgccacaatgcaacaaggctgaatggtgccggaggtctcctggggaagcctaaagcctgaggagaagggcctgggacactgtccagctggccttgtcatccttgtcctggagatctgaggtatttgagctctggaacaaaccctgtggctgggtcgctgtgagggccccaggctgccatctggccaccctcaggggcacatccctccttccttaggccttgtgtactcactgttccctctgctgtccccatccctccctttgcctgctggtctcattaactcttccgccacctcctcccaggtttgcttgaagagatggtgttagagctccagaacggcgatcttgctgtccttctactgtgccctggactttctcgataccactggtcacagatgtaattgtgtttgtggttttttggcgaggggggtgattatttaacgctcatcctcttcacttgaccgtaagcttctggaaggcagggacatgtctttttttttctttctttgagatggagtcccgctctgtcgccaggttagagtgcagtggcgcgatcttggctcactacaacctccgcctcctgggttcaagtgattctcctacctcagcctcctaagtagctgggattacaggcacgtgccaccacgcccagctaatctttgtatttttagtagagacggggtttcaccgtgttggccaggatggtctcgatctctggacctcgtaatccgccctcctcagcctcccaaagtgctgggattacaggcgtgagccactgcgcccagccagggacgtgtctttaatccccagcctgtatctggcacggaggatgtgctgagtaactatcagaaggaagcaccatcccccgccctccccttagagggcctctgttacgtggtcacctcacagactgtgcttcagcccagccctggggtgcttgggagaataggcggaacagctacgtggtcagcggccatcccttgcaagtaacagtccccctcctaatgaccctcacgctgcatggcccgttacagtggttcagtaagtttttatatccatgccttacttaattctcacaccgccctccaaggtgggtttgaactaatccgtctgtgtgttggatggagatgtcacaggatggaaaggcctagtgtgggccaagcctccctggaagggtccccttcaggcctgcacccttggtggggattctgtgctctccttttcccgctgccctgtccctgcagggtgctgctatctggactgagagcatcttccctgaggcccacgtgagctcctgcttgcttctggctcacttcttgctttggccttttcctccagacctggtttgggccttgccattctcttttcagacccaagaagcacagagagtgtttgtcttttacctcggctctgcccctcatggagcagtgggcacctcctttattcagcacatggaagctgcaggcaaggcagaaatcggcctttcagttttcccagcaaagcagaaagccctgttcctggctggatgcctgggacctgcctcctggggacagaggagcccctctgaggccagctggcgtcctgacgccatggctgccacgtgggtaagcacctcctggggatgcagcaccaagccagcccagctctgagaaatgtgtctgggcagcagctgctgcagagcccctgccaccagggtgtattggtggagcatccttccaggggcattgccaaccttgggcactcccaggcaggcccctggcatttccacagcccaccaggagagatggcccttggaggactgctagtgtctctgccttctcaaagagttgtctcgggttaccgtggagcaggtggcccagctgagctgtgctgtgagggaacgctgctgagctgagttcttagggagggttttgattgcaagtccctccagaatccggtagaggcatccccttgtagtcatattagtgaacatgcaccaggacccctcgttgggaatcagaaggcactccatggcagaggcgtcaatacctgttgttttcctccctgttggaagttgcctaataaagcataataatagcagtttccatttatttagcgtcattgtgtgctaggcccagcgtttctgctgcaggcgtttcacacacagtctctcttcaacctcactcccaccctgagaggtaggcatgatcatctctgtttacagaggaagaaaccgaggctcagctcgctcagctggaaagtggtgggtcttgggggtctgggtttgaattaagctgatgcagagcgggcccccccgccttttttttttttttttttttttaatattgatgacgtcttgccatgttgtccaggctggtttcgaactcctgggctcaagtaatcctcccgtctcggcctccccgagtgctggaattacaggcctgagccaccacacctggcccagagcccatgttcttgactgcttgtttcatttaaagccttccaccgggtggcaagcacatccctggggtggggccttgccagaacaacaaactcagggcctccccaggagcgactccaagacttgcaggccactcttgatccttctggttgtgaagtcctgtcccagccctgcacttggctgatacgcaccccttaacttctagtgggggttcctctagcacagcagttcttgaaatgtgatctgcagtctcctgggggcttcctgagaccactcggggggctaggatcagaactgttttaataataacacggccatgatttgttaccatgcctctttgtttgtgatggctttcacattgatggtgtaggagcagtgcggaaacaagctgtggggcctgcactgactcaagactggcaccacactgtgctggtcttgttgtaattgagtcttcaccaccacacacacagtacacacacacacacacacacaccagtgttgcatcagaaaaagcagtaaaaatcaactttattaagtcctgacccatgagtccacagctttttaagatcctttgtgacgaaatgaggcacacatgaagtatgtcaaatggagtttgatgctgtcgtgaggaaaagcacacgtgcattcatttgaagtgtgggccgaactagctgcctttttcatggactccatcttcacttaaagaacaactggcacacaccgtggttattcagatttggatatttagcatacactttcttgaaaatgagcaaagtgaacttgctacttcaagggaaacaactgaccttttatttttgtatatgttgctgtttctatatttgttagtgctttgttgccagtgatgaaattcaagctttcaaatgatgattagcgttaacaatatttagtgactttaatgacattggtagtgataccagcaatgtgatttaaaaaaatatatattgttcaatgagatgtgtcaacattggtagatctgcattacaggaacccgtattttcaggtgacccacacatgatgttaagaaatcatgtctatgtaaaagacccattccaaatgcaaggtacaccaatgacttctaatgtaacacattagaaaaaaaccattgttaaggcttccaattcctgtggcaactaacccttaagaaactaccacttgtcggtcaagtgcggtggctcacacctgtaatcccagcactttgggaggccgaggcgggcagatgacgaggtcaagagattgagaccatcctggtcaacatggtgaaaccccatctctactaaaaatacaaaaattagatgggtggcatgcctgtagtcccagctcctcaggaggctgaggcaggagaatcgcttgaacccgggaggcggaggctgcagtgagccaagattgcgccactgcactccagcctggtgatagagcgagactctgtctaaaaaaaaaaaaaacctaccacttgtcaagtcttgatgtagtattagtccattgtgcttctctaacagaatacctgagactgggtcattcataaagaagaggaatttatctccttacagttctggaggctggtgtcttagtctatttgtgttgctataaattacctgaggctgagtaatttataaagaaaagagagtatttggttcctggttctgcaggctttataggatggcacggtgccaacatctgcttctgttgagggcctcaggctgcttccattcatggtggaaggcacggggggtctctgtgcagagatcacatggcgagagagggggtgagaaggggaggggaagcgctgggctctttctgacaaccagcaaggatgcggggactaacagagtgagaagtcactcgcttctcctccaccccagggagggcatttatctattcatgaggaatccacctcccatgtcccaaacaactcccattaagcctcaccatcagtcatcaaaactgtggtgcttgggaagtccaggatcaaggcactgccagcatctggcaagggccttcttgctgtgtcatcccatggtggaagggccgcggggagaggcacccacaaaagactagctaatcctcttacaaggaatccgctcccaagatagtgatttgtagccagtctgtcagaagcgcaggtcgcaagctaggaattgcgatgatcagaagtggggggcagtcatggaactgagccctcaacctgtgggatctgacacggtagcatcagacttgaatgccactagaagacgtccacctggtgtccgctgcagaactgactgcttgcttgttattggggagaaacccccacatgttttgccacagaagtcttttctgttgattgttatggtgtgaaagcagaggagaaacaggttttttctccacaccttcacatgccacagaacccagagggtgtggaggggtagactttgcagaggcctctggtcttccataggagtgacttactattaagtttgtgattgacttgtaaagattttcaaacaggcacctattttgtttgcaattaataaatccaagatttaaagcaagaaggccaagaagcctctcttggatttgtcagggctgcaagttgacttcagtgggctccccagaccccgcaagtctccccttcctcctctgttgggaactgggcagatccccaggtctcctagccccctccctcaccagcaccttcccacagcagaggtgctggggctgcattttcagatcagacattttccattttgtagcttaatttgaacagtactcgttttattggaaaactattttgcttctgatcgtgtgattgaaagattattcttgtagtttttattacaccctacacaacatggttttgtgggaatgcatgtttgattttgtattggaaggcactgggagaatgggtgtttgaattcgggaaatcttcatgagctgttttccagatcctctccttggtagagaaggacctgccctgcagtctctgctggggttcaggaaggcagcaggaggacgcatgtggatatggaggggtgagggggagcagtgagtagcaggcatggccctaggtggggaagacacggaggagcaacagggccctgcggcccccggtgaggggcaaagagaaggtgggctctggtgtggccatcgagctggaggggaagccagccctgtgcaggtccagacccttccctgtggcctgcattttctgtacccaggttgggtgaacaccaaaggagggctatgccctgtgggcttacaccctatcatcatgggcaaggctgtatgtggaattccagaaatagaatttttgagctctaggagatcataggattatatctgttgactttgatgaaaagatgggccagagaaaggcaacacctgcattctcagagatggggtgtgtgtgcacacgtgtgtgtgtgtgtgctccctgcaagggacccaggctgggatctgcaggtgcttcagtgactcaccaagcacagtgcagcttattttcctggtctgctcagagcatcccagggcctggaccattccccgatgagcaagaccactgcagaccacagtgttgggccacttggtggacggtggtgccacccagaggcgccagagagcattttctgggagtctgggagtttgtagcaggggctggcacttattccaactcaacgtattggagcagttttccagacgcaggtaaagccccatgaaaggctgccctcttctcccctgcaggagggcacctggcaggctaggagcagcctgggcaagggaccccaggaccagccccaagaggcactgctgctactccctgttctgttttttttttttttgttttttgagacagggtctcgcactgttgcccaggctagagtgcagtggcctgatcatggctcactgtatcctctgagtcttgggctcaggtgatcctcctgcctcagcctccccagtagctgggactacaggcatacattatcatgcctaatttaaaaatttttcttttgtagagacaagagtcttgccatgttgaccatgctggtttcgaacccctggcctcagttcatctgccagcttcagtctcccaaagtgctgagattagattacaggaataagtccctgcacctggccactgctcccttttcttaaccctgtgccattggaattcactgtgcaggcaggagggtgggagagtcatgctggggtcctagacttatgccccgccccatccttttctaggcctccatgtcttctgtggataataaggcaactcagaagaggtgtaatttctgaacacttggaaagatgttctgtctcctgattgccaaagaaatgcatataaaaataagtgacattttaatatgaaaattaataactggcactataaattggcatcctttcaaaaaggcataaaatgctcatgtcctttgacctagtcatctcactctgacaagcttagcctgaggagataatctaacaaaagggaaagagcggtggacagaggtgttctcttgtatttcatgaaagcagcaagtagggccttgcctaaatgtcttaatagggtttggtcaagtatgcccattttgtggaatattaatatcaacggtcacggagtcttgtaagatggaatatgtgtgacacagcattaaaaggatttaccagcctggtcaatgtggtgaaatcccttctctactaaaaaaatacaaaaatcagccagtcgtggtgccgtgtgcctgtagtctcagctacttgggaggctgaggcaggagaatcgctgggacccgggaggcagacgttgcagtgagccaggatcgcgccactgcactccagcctgggcaacagagcaagactctgtctcacaaaaaaaaaaaaaaaaaaaaaaaaaggatttaaaactgtcaggacagcaactatatttttatatggtatgggctgggcgcagttgctcctgcctgtaatcccaacactttaggaggccgaggcaggaggattgtttgaggccaggagttcgagaccagcctgggcaacatagtgagacccccgtctctacaaaacaaaaccaaaaggtacaggtgcctgtgcatacagaccagcagggacatgtggagatgggctgcagtaggactaattttcttttccctcattttttttaaaaataagttttattgacataatttacgtaccattcaattcacccatttaaagtgtacaattcagtggtttttagttattcacagaatcgttcaactgttgctacaatcggtttcagagcatcttcgttaccccagaaggagattccatgttccccatttcccctctcccccagacctaaacagctactaatgtactttccgtttctatgggtttgcctattggggacatttcatataagtgaaatcatacagtatgtggccttttgtgtctggcttctctcaccaagcatgttttcagagttcatgctgtagggtgtcagtgcttccttcctttttatagccgaatcgtcttccattgtctgggcagcctacggttttgtttatccactttgttgatggacatttgggttgtttccactttttggctattatgattcatgctgctgtgaacatttgtgtacaaatttctgtgtagacaggttttcatttcttttgggcagataactaggggtggaattgctgggtcatctggtaactctaggtttaaccttttgaggaactgccagactgttcctcaaaaggggaacaggggctggcagttcttcaaaaggtttgcaggggctgtcccctaccagcagtgtatgagggttccagtttttctacataatgcctattactgtctttttaaattttagccatcctagtagataggaaatggtctccttgtggttttggttttcatttcccttatgaaaagacgctcagtagtttttcatgtgcttttggccatttgtcttttgagaagtctttgttcaaatccttttaaaaattgggttgtctttctgttattgagttgagttctttgtatttcttaatacaagtcctttatcagatctatgaattataaaatgtgatggtatcctttgaagcacaagagtttttcattctgatgacatccactttaagttttctttcttttgttgctttgcttttggtgtcatatctaagaaaccactgcctaatcgaaggtcataaagattgatgcctgcattttcttctaacagctttttgatctctttcagttttcaaacttccatggtactttatagttgaacccaagagcttggacttggttcctctggccctgcccctgatttgttaaactttatattcaaacttatgtgccctccatcccctgcaggtgctgggctgtctgggaaacactcctttccctgtattttttgttccactgaaactgatttttgtctcattttattacttttagctaaggtaactgaaccccacttcccaagtcctttatgatgctaagtaagagcaaaagcttcccacctttctgagctgtgctcagagagtttggtgacagaaatgagggaaaagatttcacttgactcttcttccccctgacccccacctcaacaaacaaaccagaagggcacaggccagagcacagcttgcctggcagtccagtcctcatgcatgggagctcaggcctggtgggaggggaggcagagggcccagccgtggcccttgggtgccagcagtcctgggggagggaggaagcagacctgcgacgggaccgaggaatggaggggtggtcgggtgtgtggatggcagagtgacagctagggagaagccggatgtggaaggggaggaactgtgtggtatgcccaggcccctgggcccagccctggcttggcagcccttgctccctgctgagggccctgcctttccttcccctgaaacagctcccggagccctgcctgttccctgtccatccaggccagcagctgaaggagcctcacctgcctcccttctctgagtagcacggatttgaggtaagaaatcccccagaacccccattcccagtgcagcctgtggcagagatcggtccagtgtctcctccgactgccttagtgcccgctaaacgtttggggaggggagagctcggtgccaaactgctctcgtgtggggcaagtgctgagttaggctccttgggggactttacctcactgggccctgcttcctgggttctgtccttgcccttcagcttccaaacagggaagagcaggtgactactgagaggtgaggatggtggctctgggctaggtggccctgggaaaggtgggggatccccagtgcctggaggcagacccttctgaggatggtcacacgccttgtgcagcatcttggccaccccacagggctgaaggagaaggaacctggctgggagcttagttcatgtctgggttttccctccatgtccaggagaagcagcgaagatgtccagcgagcctccccctccttatcctgggggccccacagccccacttctggaagagaaaagtggagccccgcccaccccaggtagggggtcactgttcctgaggctccatattgcagccccctgccgccatggcatggttgggactctctaagtggtgatgcccactccagggttacccctgggccccatctgtgtcccaaaacagtggcctctggtcgagctcatcgtgcagaggctccagctcagtctcctctttctgcctctctctgtccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtgagtggggaagggatctgaggggagcatggggaactcctggctgctgtctggcctgcgctggctgtcctcagtacaggtgggcatctgctgtagggcagggactccaacacgcccaaccagcccttgcctagggctcaggctgtgtgtggacagggactgtggacgtgggaaggtgggactgctcttattcaggctggtcaggaagggctggtccttggcacaccaggacctgacatgggtggggaggggcgccttgtgtgcaggagaggggtgggtgacccgcaaggctttccctctcttggtcatgggcttgaggctgagtgccctgtccttgcatgctggagacagacagaggagcagagggaccgggccatgtgcctggctctctgccacatctgtcatgggccccaaggggtggggaccaggaagggctgggagaatgtggccccacttgacttagggccccagctgtaaggcctcccactggcccgttaggagggcggtaggaggtctgaggcgtagccttgcacgctgggcgctgtggaccgtggggctttgcgccaatctctttgtctggtgcaggtggcaggccagtgacctctcgcctccatcttctgtgccattccaggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatggggtaggtggtgtgggcactggtagggtgggggctgcaccagggtcaactggctgcctctgcctcctccgcagcaggcctcagcctgttcttccctgtctctgattcagatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggt

SEQ ID NO: 38306 - DNA, 9328 bp, Homo sapiens
ctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaagggtgagttgggttccctgaagcaagaggaagcctgagagacccagaaagagattgaatagagccagagagggccccctcctgtttttttatctcttaccaagacctcctggggctcctcattccttcagaaagaaagctgcagggagtgggggagggtctggttgcaggggcaaaagtcagggagcttctgagtatgctctactgtggtaaataatgatgttgattcctccttaagagtgctgagttaggctcctctgccccgttcctaatagaaacccaaatccctggtgtcagccagtgcagcacaagagatggaggtcagacttcagaaaggacttccctcttttatttttttttctgagacggagtcttgctctgtcgcccaggctggagtgcagtggtacaatctcagctcactgcaacctccacctcctgggttcaagcgattcttctgcctcggcctcccaagtagctgggactacaagcacctgccaccacgcccggcttatttttgtatttttaatagagacggggtttcaccatattggccaggatggtctggaactgacctcatgatccgcctacctcggcctcccaaagtgctgggattacaggcatgagccaccacacccggccaggacttctctcttgagaagaaagggaaaccagcaaacaagaggaagaaagtcatcttttctgggcaggtgtacagggaacgagagaaaggagagacacatcccattatagggtggggcaataaatacatagggaagacagaaaatatcatgaatttgctgcagagtctgatagaatccagaggactcctagggttgtagcctcgtctgcctggcccttggctgactcactggacctgcataccaggcactgggctcaactttgctgtccctggaagcatgcatgtatctttctagcccctgtgtttggtgcctttgctgttttccaaccccaccttcatacttcctttagggcagggtggactctccagccaccctaccccaatgcctctcccaacctcagcccggcccctcccttgagctgggactctcactccagaacccgcccttgagctggggaacctgtactactggcatcttttccaggaaggaaagggttagcaatagtctggggcaataatatgaggaactaccatttattgagcacttactatgtacctgccactacctcattaataccataacaatccccgaaagtcatattttattttgaggggcagtgtaacattgtggtcaggagccagactgggttcagatctcagccctgccacttacaagtattgcgggttggtcagccgggtgcagtggctcacgcctgtaatcctagcactttgggaggccgaggcggcgggatcacttaaggtctggagttccagaccagcctggccaacatggggaaaccctgtctctactaaaaattcaaaaattatctgggtgtggtggcacgtgcctgtaatcccagctactcgggaggctgagacaggagaatcacttgaacccaggaagcagaggttgcagtaagccgagactgtgccactgcactccagcctgggcaacagagcaagactctgtctaaaaaaaaaaaaaaaaaaaaaaaagtattgagggttgggttggggtccctagaagcagacgctgagaagaagttggggtgttcaatgtttgtttgttttttgagacggagtctcgctctgttgcccaggctggagtgcagtggagcgatcttggctcactgcaatctccgccttcctacaacctccgcctcctgggttcaagcgattctcctgcctcagcctcctgagtagctgggactacaggtgtgcaccaccacacccagctaatttttgtatttttagtagagacagggtttcatcatgttggctaggatggtctcgatctcttgaccttgtgatccgccctcctaggcctcccaaagtgctggtattacaggcgtgagccaccgcgcccagctcaatgtttttttacaaatcagcacctgtgaaaggaagggagaggaaacataattgggcagagggagaagtcaaacagcaacacaggctggacaaacctgggtcaagggcggggagctctgtgattgcctcaccttgcttgagcactgggtgtaggctgcccagaaaaggcatgacttccagtgaggccgctgtctgcaccagaggcagacgctgaaggagctgacagctggagcctgtctgcagcctgcactccctgcagcttggggcaagtccttccttgaaggctgatctggccagcacatctctgtgtttacaacactagccctgttatcttgggcaagtcatttgacctccaaagcgccttgtctgtaaaaacaggtaaaatagtaatgggattcatggcattcttatgaggattaaatgaggtaatatgtgtaaagcttttaacgacactgcctggcacatagtaagcattcagtacactgtaaacatgaaccattagtatctccactttacaactgaggcttagaggcaaagtagtttacaaaaggccacaaagtctgacttcaattcccttgccctaagcacctttgtggtatgacgctagggctgagagcccacccactgagagggatgagggagatgtgcccagtaggggagaggcaggaacacacacacacatatacacacacacacacgcatacacacacatcctcttacccacacatatccatattatttccagcttttccatactgtcctatgcaaataaggaatgtttaaatatatattttttatttttattttttgagacacaatttcactgtcacccaggctggagtgcagtgatgccatcacagttcattgcagccacaacctacggggctcaaacaatccttccacctcagcctcttgagtagctgggactacatgcatgtgccaccacacttggctaatttttttttctttttctttttttttttttgagtcggagtttcactctgtcacccaggctggagtgcagtaacacaaactcggctcactgcagcacccccagggctcaagcaatcctcccacctcagcctcccaagtagctgagactacagacacatgctaccatgcctggctaatttttgcattttttgtagagatggggtttcaccgtgttacccagggtggtctcaaacttgtgggctcaagagatactcccgccttggcctcccaaagttctgggattacaggcgtgaacctccacacccagccaaggaacttttaaagttggaggaggcctttataagttgtataagcaaggcaactgagactgagaaaaggtgagtcacttgttcaagttcacacagttagttagaagctgagcagggaccagagcccacaatatgtggctcccagtccttgggtgccagcctgcctttccagaaccactctgggtggcctcctctaattctgtgtgcttagttcagtgccagtgcaatttgtgggctctactcacatcagccccctacactctaccccagcccccagctcatccacatgggtaagactgggccctggatgctgcccaccagtctaaagggtcttcatggcccctcaggtggatccttgtctctgaaaacccaaaggcaaaaactctggcctgctaacaacaatcataccagtcatgatttttacacttactatatcctgggcaatgtctcacttacttcctacaataacccttaaggtagatactaatgtcttccccatttttcatatgaaaagaacagctcagattggttaaataacttgccgaaggacacatagctggtctaacacccaggcccatgctcttaaccatgcgggactgtccctccttagggacaactggaacctaacttcttacacacacatgagcacacatgccttcctctcacccacagatgtgtcaactgccaaactttctccttacccacactttgattcacacctctgttccttatgcaaacacacacacaccaaacctcccacttgtcctcccagctcatatatatagagacaagtgcaatgttctcatactccaagtcctagtccagaactgtgcaccccctgacctcccaccatccctgtccatattcacacacaacagtaatgtctccgcatgacactcataaagagcccacagatgtcactccctcaccagagatgcaggctgactctgcaaccatgtatcaacagaccaggctataacccgtcaagcccctttgtttgttttaaactcttggctttcctgcccaccaggacagatgcattatgcagagttgcagactccagtctcacaggagactccgttccctaatcttttttctgagctcagttccctttttctgctgggcagaccctccaagctcaggtggggttggagctgctctaccccatgctcagcccttatctctccactccttcagtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtgagcccgggcctggggggctgctgggtggtgggagttctggggaagtcgaggaacacttctggaggagaagtgggggaggaggaggcaagggggctcagcagtgggctctggggggtggggatggagatcacagaagataaaaggtactgtaaacagaaacagcacaagccaggatatagtaacactgactagtactactaaaagcaggaatcattgccacttactaagcctttgctatgtgcccaggaagggacaagttactttacatttggcattttatgtaacccttaaagtaccacaggagtaaagtgctataattagttaatttctgtataaatacaaacaaggtgaaatcagggtggagctaggatgggggcgagctgcacggatcgagagcgccccctcacttccgcacaatgctctgcacttggcaactttcatctaaccacagaggaccaaaagctgaacccagcatctgcattttatgaagactcagaggacacacaggaggttaggcctcctgacaccacatccgaagtgtctcttaggccgggtgtgttggctcacacctgtaatcccagcactttgggaggccaaggtgggtggatcgcttgagctcatgaattcgagaccagcctgggcaacatggcaaaatcctgtctctaccaaaaatataaaaaattggccgggcttggtggtgcgtacctgtagtcccagatacttgagaagctaaggtgggaggatggcttgaacccgggaggcggaagttgcagtgagccgaaatcgccccactgcactccagcctgggtgacaaagcgatactgtgtctcaagaaaaaagtgtcagctgggcgcggtagctcacacctgtaatcccagcactttgggaggccgaggcgggcagatcacaaggtcaggagttcgagaccagcctggccaacagtgaaacccccgtctctactaaaaatacaaaaattagccaggcatggtggtgggtgcctgtaatcccaactactcgggaggctgagacaggagaatcactcgaacctgggaggtggaggttgcagtgagccaagatcatgccactgcactccagcctagcgacagagcaagactctgtctcaaaaaaaaaaaaaaaagaaaaagaaagtgtcttccagtcagtgtgaggcctaagcatgtgaaatggggtctgtttgtgtgtatatggggtggatagcacttgccagggggcaggaagcaagagtcaggggctttggttacacatgctcctcgttacctgatctcttatgagcctcagttgactcatcaatgaattgggagttagacatcactagtctgaagacatcccatccaactccaagagggagactggatgctttcagtgatgccttgaatggtcaggccagggactgctgcaagaggtaggcattcagctaatcctagaaagaaggccacgggagagaacaggccactgttaaggagccatgtgaggaagatcttgaaggtggcagagttggctaaagcccagatgtgcactggtggagagtaggggctaaaatcaggacgagaacctgagaaagtagaggggctggctgtgaggaagccaatagagattttagagcagggaggtgaaactttatttatttagttagttagttgagacaaattttcactcttgttgccgaggctggagtgcaatggagcgatctcagatcactgcaacttccgcttcccgagttcaagcaattctcctgcctcagccttccgagtagctgggattacaagcatgcgccatcatgcccggctaatttttgtatttttagtagagatggggtttctccatattggttaggctagtcttgaactcctcacctcaggtgatccacccgccttggcctcccaaagtgctgggattacaggcgtgagccaccgcgcctggccgagggaggtgaaactttacaggctccaagactagtgtccctggaaggcagaggagccttgggctgctctgttgggttctgggcccctggccgcaagtttctgtatttcctgatctctagtactctgatcccgggtgttccagcttgacggctctgctctgatgctgggtccaatgcctctgatcgtatctctgtccatccttctcattcccacccaggtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctggtgagagcctgccactacccaggctgactcctccaagcttagcccacctttcccttgcagtctcccagcccctgcccccacccatagagcccctagcctggccttcctccatacagtcctctaccccatcccctcttcctcaggatttcccagcacttcccctttgggaccctgtgtctcccatgatgtcccaccacttgccctgagattgtctttattgattttttttttttttttttttttgagaccgggtctcaatctgttgcctaggctagagtgcagtggtgcgatctcggctcgctgcaacttccacctcttgggttcaagcaattctcatgcctcagcctcctgagtagctaagactacaggtgtgcgccaccatgcctggctaatttttgtatttttagtagagatggggtttcatcgtgttgaccaggctggtctcgaacccctgacctcaggtgatccagctgcctcggcctcccaaagttctgggattataggtgtgagccactgtgcccggcccgtagttaattttaaggcagccccaccctgtaatgctcaaagatcctatggagaggataggcttcccaggagttttctgagtttagaggcagcacaatatggtggttaagggtgttctggagtcccatggcccagtctcccatctgctcttggccagttactaaatgtgggacatggagcaatttccttattctttttctttttctttttttgagaggagtctcgctccgtcacccaggctggggtgcagtggcacgatcttggctcactgcaacctccacctcctgggttcaagcaattctctgcctcagcctcccgagtagctgggattacaggtgcccgccaccatgcctggctaatttttgtatttttagtggagacggggtttcaccatgttggccaagccggtcttgaactcctgacctcgtgatccacccacctcagcctcccaaagtgctgggattacaggcgtgagccaccgcacccagccccttatttgttttctttgtgtttctggattcagttttctaaatgaacctaccttgtaagttgttttaaggattaaatgatctgctacatgccaagagtttagcacatggcaaatgtatatagcaaacattaatattattattattattgcctttgactcccacaattaatggtgtgtttcccttcctggcagaaaacaatggactgctcttcctggagacctcagccctggactctaccaatgttgagctagcctttgagactgtcctgaaaggttagagcctacctttattctgcacccctattccatccccgtggcttctacaggcagcagtaggaatgcagacactcagccctcaccccagctaatttctcagctcctctgtgggtcctggcaccactgcctgtccccctcagtccctccccagtgcctcccactcagtctggagctcagggagggaacaggccacactccccatggggctgactcttggttccttctccacccaagtaagtagaagggacccctatgtccacacttcatttccttcctgcaaaacctcctgcaagtgtggccaccccccatgctcagaaggggcatgcagtatgtatgggggggttggggagaagggagcatgggctctaaatcttctggcctgatcactgccctctgccctcccagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatc

SEQ ID NO: 38307 - DNA, 3590 bp, Homo sapiens
aattcggcgtcggactctgcgccccgcgtagttccggtggcgactgcggcgcatggcggtgagcggtgtggagaagacgcgcgggtggctgggccttgcattgttggcggctctcggtgaccctcgtgctacccccctttctccaggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcaagggcgggcttcggtcgggaagggtggaatccacgggtgcgaatccacgggcacgtgtgatctggggtccgcggagttaaggcggggaggggcatgggatggggccggcggctatggttttccagtgccctctcacagccacttccccaaatccatcacaggcacaacagttggcccaggaattggcttggtgtgtggagcaactggagctgggcctcaagaggcagaaacccaccccgaaacagagtaagggacccttctgtagagctgggggatgtgaacagtggcactgcctggcctgcaggtgctggcagagtatggagttgttggctttgcggcggggtggtaggaggtcagtaatagaggtgttcactagtcctttatttttattcgcagaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctggtgaggagctagccactggttgattcaggaaggcctaacttaaggaggaagtgtctagggggtgaaaggaagaaggcccagagcaacaagcctggtgggggaaggagatgggctcagggaagcctgagggagcagggaaacagaaagcgtggacctctctttcctcttcctaggactgaacctgggaagcagcggggaggccctgggaggagtgggaaagagcatggtcctatgttggtcctgctcctgggttggggaaagctgcctcatgtctttgtgtcttggctttctctactagcaatgaagccatatcccataacagtttgagtgcaattcctggggccagatcagctaggttcaaatcctggatctaccacatagtagtactaacaccttttgcaaactactgaacctctctaagtgggggatgatagtaatatcaaccttacaaatttgaggaattaatcagttaatttatgcaaggtggttagaattgtatgggcaaacataactgtacaggtaatgttaattgttattattcagttctgacatacgctgcttctctccccgacagctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaaggaatattgtactcagtctttaggattagattaagtggctgttggtaacaaagattagtggagaagctgtataatcgtacactggttttcacttttgaaaggaatccctgtcaaatggtttagtgcttaatgctgttatgtcatattgccctaatctctatttttgataaaattggataaggagtgaaagagtatgctgaccacctatgttagaggaagtacagaagatgcaggggtgtggtatccctgggtccagtccctcacctggtacctttgtgcatgttgccttcattcctgagcaggtatcatcctcagggaaccagcatggcacctaccaggccaggctctgttcttaggagcaaggagcttcttgcgctaacagttctggcctgagacctggattgagccttggcagacttcttgtctaaatgttggccattcagtctcaggccctctgttccatggaattgggaatctccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcccggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtgcagcctggcatttggggccactactggtctccgcgtcttggtggtagtggtcccccaggcccaggtgtcttttctttt

SEQ ID NO: 38308 - DNA, 2254 bp, Homo sapiens
gcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcaggtgcggggctggccggggacgggcgctgggggcgacagggccacccctgggggccgacgtcgcggctaaagcctcgcgtgtctccacagaggatgacggacaagtgtttccggaagtgtatagggaaacctgggggctccctggacaactccgagcaggtgagacccgcggaggttcggggcaagggtcgcgagggcctagattcgaggggggaggtgtctgcgcgtgcgcagactaacggggaggtgcgacggagtggtcactgcacgtgcgtagtctgcagcccgggcgtcctggagccggggtcagggcggtccccggggccgcgaagtcccgagctgagccgtgcgcccctccgctcccgcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggc

SEQ ID NO: 38309 - DNA, 26345 bp, Homo sapiens
cacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggtgaggcggcagctcccgggacccgggattcgggcgccgggaggggcggggcggggccgcggggagccagggccacacggcctccgcggctgggtaccctggtccggcctcttcccgcccgccagttccgttttcggaatccttcggatccctcttcctcaccgtgtccgccaccctcgtgacctttctgcattacagcagctgcctcctaacccgacctgtttcctccccgttctggtgccagaataatctttctaaaagtcagacttgatcagaccatcccccctgcctggcaccttctgtggctccctcctgcccgcgggtagagtcgaaaccctttaacatagccttcaagattttaatgactgggccccttccagcccgtcataattcttctctgacattcttcagcgacacagagttactttcaggaatgacagttcctggaagttgctgtggtctctctcacccgccattccctgtatatgaaatatgaagtggttaaaagccgggcctttgagttcaaatctcagttccaccactactagctgtgtgaacatgggctgcttacttagcctccgtgaacccttttccccatttgaaaacggggcttgaaaacaacagttctttccacatggagttgttatggggatcaaatgagattctcagatagagctctgagcccagcacttggcacacatgagtcggtaaatgcgtgctccctcttctgttgggactgccatattcttcattacgaccccagcccccagcataaggcctggcctgcactatgattctttggtttagagatagctcaccccatctttcctttcccttcatcaatgctactcaactgattttgtatcatttgtgataggttttttaaatgtttatttatttatttatctatgttagagacagggtcttgctctgtcacccaggctggaggttttctcttactgtttttttttttttttcctggttttttttttttttttttttgagacagggtctctgtatcacccaggctggagtgcagtggcatgatcccggctcactgcaacctctgcctcccaggcttaagtgattctcccacctcagcctcccgagtagctgggacccacaggcgtgaaccaccatgctgggctaatttttttgtagagatggggtttggccatgttacccaggctggtctcgaactcctgagctcaagcaatctgcccaccttggcctccgaaagtgctgggattacaggtgtgagccaccaccctcggcccttgctgttccttcgggactggttttatggaaacctaatcactgaatcataaaaatactttacaaaaataacattgctaacattttttgagtgcttactctaccaggtactaagctaaatgctgtacatgcaccatctcatttaatttttacaacaacccaatgccatgatgctgccgatttcattttaaaggctaagagaaaataagtgacttaggcaaggtcacatagctagtataataaatacagtaaggggttttttcagtttttgctcctaagccacaggactccagcctttcttctgcaacattgttttctagagggaaattcccactcttaatttgaaggagcagtctgtttttcctcttggaatgccgaagttgtagaaatatctagagatactgaagccatagaaacaaagctgtactgaccaggtgcagtggctgattcctgtaatcccatcactttgggaggctgaggaaggcagattgcttgagctcaggaattcgagaccagcctgggccacatagcgagaccctgtctctaattccattgagctggaatctaggtggctgcagcctttaggaaagggatctggccagctctgctagagacactgtgcaactttagtcaggtcagtctgggccttgggatcttcatctagacaatgagagctctgttgcccaaggtcactttcagttctaatgttctttgaactttccagcatcaagtcctgactctaccatcttatgatttgtctaagagcaggagtagtgatctcagcactgacatttctggacccaagaagtttttatttttttttttcaagacggagtctcgctgtgtcacccaggctggagtgcagtggcgtgatctcggcttactgcaagctccgcctcctgggttcacaccgttctcctgtctcagcctcccgagtagctgggattacaggtgcccaccaccacacctagctaattttttgtatttttagtagagacggggtttcaccatgttagccaggatggtctcgatctcctgacctcgtgatctgcccacctcggcctcccagagtgctgggattacaggtgtgagccactgcgcccggcagccaagaagtttttaatagcatgaatacctctgtgtctacagaaatggccgtgagatgggactttagtgggttttaattactctttttcttgagtagattgtttttgtttgagtcaaggtctcactctgttgctcaggctggagtgcagtggcaccatcatagctcattgccacctcaacctctggggatcaagcgatcctcccccctcagcctcctgagtagctgggactacaagcgtatgccaccatgcctggctaatttttatattttttgtagagacagggtcttactatgttgccgaggctggtcttgaactccttggttcaagcaatcctcccaccttggcctctcaaagtgtttggattataggcatgggccactgtgcctgacctcttgagtgttttttgtttttttttttttatagtcaaacaatccggcttttatattattgcctctgctcagtagaagtcatctaggggctggggcatttttgttttgtttgtctgctttttaacatgtaacctgttcaaagaaaatgtcatggagaaaagcgccagtgcaaagcagctaaaagcagagttgctattgttgaaatcagagaaagaggcatagggcactgtccctggatgttcctgtccctgagagggcctcattaggacagtttacacatcctggaggtagcccaaactgcttttatatcgatggagaaactgagtccagagctgggaagtgacttatctaagagttagggtcaaagttaaaccagaatttttctttactaaattctggtccagtgctgagttgactattctttgctcagttatataacttaaaatcttccttaactctttgatccaatgtttttaatatttacaatgcaaaacaaaggaaaaaagtcccatttttttttcttttggcatgttaagagaaaaaaatagggggaggtctcccatctccaaacaaccttttcttcctttcagactttcttgccttttctgttcctcttccttggaggtccttaaggtctctgtcagtctatgttgtttttaaagatggtgatgtcggctgggcgcagtgactcatgcctgtaatcccagcactttgggaggccaaggcgtttggatcacctgaggtcaggagttcaagaccagcctggccaatgtggcgaaaccttgtctttactaaaaataacaaaaattagccgggtgtcgtggtgggtgcctgtaatcccagctacttgggaggctgaggcaggagaatggcttgaacccgggaggcattggttgtagtgagccgagatcacaccttctgcactccagcctgggtgaaagagcgaaactctgtctctaaataaataaataaataaagatggtgatgtcatagtggttgctccagaattttttcctttttttgagaatctacgacagtcactgaaagatgtcctaatgtgtgttgtaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgaggtgagtcctctgctgctctgtcatttgtcactttagcagaccaagggtcagcaggcagcctggtgacttccggcttagggccacctccagcccttgctcatcctttctgttcccagctactggagaggctagcaggcgccaaagcccagtgagaatctgtgggaaggatgccattgttttaaaaacacattgtctctggccgggcttgatggctcacacctgtaatcccggcactttgggagactgagggggatggatcacctgaggtcaggagttcgagaccagcctggccaacatggtgaaaccccatctctactaaaaatacaaaaattagctgggcatggtggtgcgtgcctgtaatcccagttacttgggaggctgaggcaggagaatcacttgaacctgggaggtggaggttgcagtgagccgagatcacaccactgtgctccagcctgggcaacagaacaagagtccatctcaaattaaaaaaaaaaaaaaaaaaggccaggcgcggtgtctcacacctgtaatcccagcactttgggaggctgagacaggcaggtcacgaggtcaagagatcaagatcatcctggccaacatggtgaaaccctgtctctactaaaatacaaaaaattagctgggcgtggtggcatgcgtctgtagtcccagctacttgggaggctgaggcaggagaatcgcttgaacctgggaggtggaggttgcagtaagccgagatcgcgccactgcactccagcctggtgatagagcaagattccgtctcaaaaaaaaaaaaaattaataataataataatagtaataacaataacaagttgtctctggaagtaggggtcagccacactggaatcccagagtccctccaagctgtagggacaccccagctgggccaggtttctcccagtagaaaatggtctgggaaccagggcctgggtgtggtggctcacacctgtaatcccagagctttgggaggctgagctggaaggactgcttgaggccaggagctcaagaccagtgtgggcaacacagggagaccctatctctacaaaaaacacaaaaattagccaggcgtggtggcgtactcctgtagtctgggaggctgaggattgcttgatcccatgtatttgagactgcagttagccatgactggaccacagcactccagcctgggtgatagagcaagaccctgtctcttaataaaaaaaaaaaaaaatagagcaaggaaaccacagttctggagtccgctccttgctgactagccttgactgacttgagtggggggacactggcactgtccagaagggaatggctcacaggatggtcaccggtggtttttggcttggccatgctacatcctggaagagtacagctcgtgccaggtctcaggtcccatctgctctgtgacctgcctccttaaaattccttcatgtgttcttttgaatgtaaaaaaaattttacttgtaaaaataacattacagaaagtttagaaaatgagaaaagggaaaaaactgacccataatccctctatagcagttctttttatatatttcctcctgaagtctttttatattcttgttttattgcctgctggtactatttagtgaacatcgagttctgtgcctgcttgttttagttaacattatagcacaaacttttaccccaccttatgcttaaagattttaatagcaacgtaatatttcttttggtgcatgtactatactgtacctaaccattcctctacttttggatacggaagttatttcagttttttttttttttttttttgagacagagtctcaaaaaaactgggggaagagtatataggatttctctgtgttctttcttacagctgcatgtgaatctaccattatctcaaaattcaaagtttaaaattaaaaaaagtttcttcaattttattttattttatttattttatttttttgagatggagtctcactctgtcacccaggctggagtacagtggcgtgatctcggctcgctgcaacccccgcctcccaggttgaagcgattctcctgtctcagtctcccaagtatgcatgcaccaccaggcctggctgattttttttgtatttttagtggagacagggtttcaccatgttagccaggctgatctcaaactcctgacctcagcccatccgcccgccccagcctcccaaaggtctggggattacgggtgtgagccaccatgcccagcccagttttattttttgttgttgtttgcttgttttgagacagagtctcactgtctcccaggctggagtggagtggtgtgatctcagctcactgcaacctctgcctcccaggttcaagttattctcatggctcagcctcctgagtagctgggattacaggcacctgccaccaggcccagctaaattttgtatttttagtagagatggggtttcaccatgttggccaggctggtctcgaacttttgacctcaggttatccatctgcctcagcctcccaaagtgctgggattacaggtgtgagccactgtgcctggcctagttttttttgttttttgagatgggatcttgttttgtcacccatgctggagtgcaacgatgcaatcatagcttactgcagtctcaaactcctggcctcaagtgatcctcctgtctcagcctgctgagtagctgggactacaggcatgtgccaacacgcttggctaattaaaaaaaaaatttatagagacagggtctcactgtgttgcccagattgatcttgaactcctggcctcaagtgatcctcccatctaggcctcccaaagtgctgggattacaggtttaagccactgcacccagcctgtttttttgtgctaataagtagtgctgagatagacatcttttctctgtttggggttgtttccttaagatggcttcttagaaatagatttttaggtaaaaccttagaacatttttatgggtcttgaaacactttttcttttggtcaaccaggttatttgaagcagacttctgactctgtgccacttttccagttctaaaacatgtgtgtcgactgagttgaaagaagcacacatgcagctcaggccagaggtaatgggtggtttaaaaaaggaggaaggtggagaacctaggcctctagagaacttggcagtttcaggctacacttctgtagaccaaattcattccttaattcacagcattcgtacgcatgacattcttcaaatgcagttgtgtacttaacaatcctaattccctattttttttttttaaagacggagtcttggtctgttgctcaagctggagtgcaatggcacgatcttggctcactgcaacctccacctcccgggttcaagttattctcgtgcctcagcctcctgagtagctgggattacaggcgcctgccaccacacacggctagtttttgtatatttttagtagagatggggtttcaccatgttgaccaggctggtcttgaactcctgaccttcagtgatccgcctgcctcggcctcccaaagttctgggattacaggtgtaagccaccgcacccgccctaattccctacttttgaagtacacattattgtttatgaagcatcttcacatacagtaatatattttatccctacagtgccccattttacagatgaagaaatggaggaccagaggggccagaagtttgttcagtatcacacagttaggaaatgggtcttaaaggtagcagatctgatgcctagagcagtatgctttccacagtccctcagctgctgctgcctggctggcagcccaggcttcccagagcgtagactcccactgtgaatgcctgaaagctcaggagagtctccgcatgcaccacgctcggtaccagttcaagactgaagttggctggagagtctctgggcccaagagctgccttgggagtggggacagattttttttttaaacctacgtaaaaaggttagttagatatattgctgatcttcagttaattactgccctgcaacctggggcaggggcctcactctgcatccagtttcaaatctgagacctgggtttgctcaaattcagttcaaactggtgacatagcagcctgcattcagaaaggaataggtcttgtaagtatcaacaacagaaccaaagggacattattgtgttaatccttctgggcgtactcacagcccaggagagtttctgagattgtatgtggtgtcctctaaataaataggattgtttttcaacagagaattacaatgtttagcttctggtgaaataatattattcttttaaagtgttagtcactcctggtgctttttttttttttttttttttgaaacagagtttcgttattgttgcccaggctggagtgcaatcaatggtgcaatctcggctcactgcgacttccgcctcctgggttcaagcaattctcctgcctcagcctcccaagtagatgggattacaggcgtccaccaccatgcccagctaatttttttttttttttttttttttttttgtatttttagtagagacggggtttcaccatgttggccaggctggtctcgaactcctgacctcaggtgatccacccttcttggcctcccaaagtgttaggattacaggcgtaagcctctgcatccagctgcttttttttttttccccctggagacagaatgataacggtttggctgtgtctccaccgaaatctcaacttgaattttatctcccagaattcccacgtgttgtgggagggacccaaagggaggtagttgaatcatgggggctggtctttcccgtgctattctcatgatagtgaatgagtctcatgagatctgatgggtttatcaggggtttctgcttttgcttcttcctcattttctcttgctgctgccatgtaagaagtgccttttgccccccaccatgattctgagacctgcccagccatgtgaaactgtaagtccaattacagcttacagccttccccagagtaatcactttgagaagcactttcatttggaggactaagtcctaacctggttgttaaaaataattaggctcagtagttttgtcatccctcctcctccatagttgcttccccaggacacagtttttctaaaacttgaccatacctagtgttgaatccatagtaaggagaaatgttatgtgtgcatttcattgcagtgacaattaaaaacaataataaccaatcagagtaatgagaagtatatgaaggcggtttccaaagtgtggttcaggaacccctgggggattcatgagccctttcaggaggtccacaaaggcaaagctatttccataatgatactcaaatgttatttgtcctttccatcatcattctcacaagtatatagtggagttttccagaggctaggtgatgtgtgatgacatcattcctctggcagcggctcacctaatggaaggtgtgttgtgtgtctttttaaagaacagttttattgacacaccatccaattcacccaatcgagggtacaattcagtggtgtttagtaatatttacagagttgtgcaaccattaatacaattaccgttagaacattttttatcacccccaaaggaaaaactacctattagcagcactcctcaattgccccaattctcccaggcctaggcaaccacttaccgatttttttttttttttgagacagagtctcgctctattgcccaggctggagtgcagtggtaggatcttggctcactgcaacctccacctctcaggttcaagcaattctcctgcctcagcctcccgagtagctgggattgcagtcatgcaccaccctgcccagctaatttttgtatttttagtggagacagggtttcaccatgttgaccaggctgatcttgaacttctaacctcaggtgatccacttgccttggcctcccaaagtgctgggattgtaggtgtgagccactgcgtccagcctcaaatttctgtctctataaatttgcctattctggatattgcatataaatagaatcatacaatatgtggtccttcgagcctgacttctttcatataacattgtgttttcatttatgttgtagcatatatcagtacttcatttctttttttgactaactcataattcaattttatggctatactacattttatttacccatttgtcagctggtggacatttgggttgtttctactctttggctgttatgaataatgctgctgtgagcttttatgtacaggttttatatggacatgtgttcatttctcttcggtattacatatatgagtggaattgctgggtcacctggtaactctatgtttaacttttttgaggaactgccagactgcttgccaaaatggctgcaccattcccgccagcagggtttgatggtgccagttgcttcacatcctcatcatttgtgattacctcctgattctagccatcctagtggatgtgacatggtgtctcattgtggttgtgatttgcatttctctgatgcatcttttcatgtgtctgttggtcatctgcatatcttctttggaagaatgtctattcagatcctttgtcagttttaagaattggattatttttctttatatattcttttgaaatttaattattttttcatgtatagccttccaatgaattgtctttatatattttaagtacaagtcctttagtagataaatgattgtaaaaaactttcctagtctttgggttgtctttttcactttcttttttttttgtgagatacggtcttgctctgtcgcccaggctggagtgcagagtggtgcaatatcggctcactgcaaccctggcctcctgagctcaagcaatcctcccacctcagcctcctaagtagctaggactataggcatgcgccatcagactcagctaatttttgtattttttgtagagacaagatctcactatgtagcccaggctggtctcaaactcctgagctcaagcgaacagccaaccttggcctcccaaagtgctgggattacaggcatgagccaccatgcctcgccctttttcacttacttgatagtgtcctctgaattacaaacatctttaattttgatgatgtccaaattatctttttttcttcttgtgtttatctatttatatgtttaaaaatttctcatttatttttatttttgagatagggttacactctgtcacccagactggagtgcagtggtataatctcagctcactacaacctccaactcccgggttcaagcgattctcatgcctcagcctcccaggtagctgggattacaggcgcacaccaccatgcccagctaatttttttttgtatctcttggtagagatggagtttcaccttgttggtcaggctggtctcgaactcctgatctcaagtgatctgccttcctcggcctcccaaatgctaggattacaggtgtcagccacctcaccagccatttttagcttttttttttcctttatttctcagttttaaaccacaatgtgatatcactgcacagctgtcagtatcgttaaagtaaaaagtggttggctggatgcagtggctcactcctgaaatcccagtactttgggaagctgaggtaggagggtcgcttgaggccaggagttcaagaccagcctgggcaacaatagcaagaccccatctattaaaaaaaaaaaaaaaagccaggcattgtggtgtgtgcctgtagcctcagctgcttgggaggctgaggcaggaaggcgggaggcttccttgaacccaggagcttgaggctgtggtaagccatgattgcaccagtgaactccagactccagccttggcaaaagagtgagatcctgtctctaaaaaaaaaaaaaaaattgataacaccacatggtgtcaaggatacaaagaaaatagatcattcatatattgctggtgggaatgtagaatgatccaatcactctagaaaacagtatggcagtttcattccttcttttttaaacagctttattgggacataattcatatactgtataattcaaccacttaacatagactgggagtttcttataaagctagataatgtgtttatcatatgacccaccagttgtcatttggtaatttatccccaaagaaatgaaaacttaacattcatacaaaaacctgtatgtgagtgtcattacaacttttattcttagtagctcaaaactagaacaagcaaaatgttctttagtgggtgaatggtgaaacaaactgtagtacatgcataccgtagagtactactcagcaatcaaaaggaatgaactatttttctttttttttttgaaacggagtctcactctattgcccaggctggagtgcagtggtgtgatctcggctcactgcaacctccgctgcccgggttcaagtgattctccttcctcagcctcctgagtagcagggattacaggcacatgccatggtgcccggctaatttttgtattttttgcagagatggggtttcaccatcttggccaggctagtctcaaactcctgaccttgtgatccacccacatcggcctcccaaagcgctgggattacaggcgtgagccaccgcgcccagccaggaatgaactattgatgcgtgcagcagcctggatgcatctcaaggaaatgatgctgagtgagaaagcagcatatgcagaagggaacatactgtacgattctgcttccatgacattctggaaataacagaattatgacagtggagaacagatgagtagttgccaaaggttagtaaggggaaggggatgtggttataaaggggtgacatgaaagatccttgtagcagtggcatcatggtaccttctgtatggtgaccgtggcagtgctcacatgagtctgtgcatggggtaaaattgcatataattaaatataggcacacagaaatgaatacttgtagaaatggtgaaatctgaataagattggttgactttgtcaatgtcattcacccagttgtggtattgtactatagttttacaagacattaccattgggggaaactgggggaagagtatatagtatctctctgtgttctttcttacagttgcacctgaatctaccattatctcaaaattcaaagtttaaaattaagaaaagattcctctattttattttatattttattttttgagacagagtcttgctgtcacgcaggctggagtgcagtggcacgattgtggctcactgtaaccttcgcctcccaggttcaagcagttctcctgcttcagcctcccaagtagctgggactacaggtgtatgccaccatgcccagctaatttttgtatttttagtagagacggggtttcaccatgttgaccaggctggtcttgaactcctgacctcaggtgatctgcctgcctcagcctcccaaagtgctgggattgcaggtgtgagccaccgtgcccagctttcattttaaatttttattttatttatttatttcactctgttggccaggccggagtgcaatggcgtgatcttggctcactgcaacttctgcctcctgggttcaagagattcttgtgcctcagcctcctgagtagctaggattataggtacccgccaccacacccgactaatttttgtatttttagtagagatgaggttttaccatttggccaggctggtctcaaactcccgacctcaggtgatccgcccaccttgtcctcccaaagtgctgggattacaggcatgagccatcgcgcctggtcacaattttaatttttaattcagcaaatacgaataaataaaaccacatcaaaaaataaaaataaaaaagatctgcagactctttagtaatttttttttttttttgagacagggtctcactctgttgcccaggctggagagtagcagcacaatcatagctcatagctcaccgcagccttgacggcccaggctcaagcgatcctcccacctcagccttcttagtagctgggactacaggtccatgccaccacaaccagctaatttctaaatttttttgtagagatggggtctccctatgttgcccaggctggtcttaaactctgggcctcaaacagtctcccacctcggcctcccaaagtgctaggattacaggtgtgagccactgcacttggcctccttagtaatttttaagaatttgaagatgaaaacatttgggactccatgctgaatgctgtatacacataccccagctgtgtggtgtgtacctggctatatgatggcacgactgtatggtacacacctcagctgtatggtacatacccccgactgtatgatgcacaccccagctctgtggtacacaccctgctgtgtggcccatacccgggctatatggcccagtggccaagtgaatggactctagggtcagattttaagtttgaatatggctctgcctgttatttttggtatatccatgtggaggttatttaacctttttgtgcctgttttcttcagttgtaaagtgggcttcctagcagaacccatctgggagggaaagtgaagattaaatgtgatcgttaatataaagcatagtacacaatcagtattcagtgaatatcagttacaattaaggaaagcaacctgggctaagggctaggacatctgggtacttgcaggctgggacatctgggtacttgtcctggctttgtccttaactctcagtgtgaccttggtgagccccttccctgcctgggccaccatttcattttccgtgtgtgaccaagctaccatccagtggttctctctattctgatgtcctgagtcagcgcagaaccagggaagatgtcatcaaggtgacttgcacctggattggggacttttctgcttccgtccacgtttcctggaaatgcaagctccctgagctcctggatctgacctaggagaaaggtgcctccttgcccgtgaggctgccaaggcggagtcacttctttaggccgtgccctgcaggtggcatcggttgagaacccggagcagttgggtgatagggaggagtctggtgtttgcagcggggcttcctccttggttttccttccctctgctccccaggcagcccatttgcttggtgtctgtgatgggtgttttagagtcaggctctctgagctcagctcctggtgctcacactctgtgtggcttgggctcctcatgtaaccttggagccgcagtggcccccgtctgtaaaaacaggattgttaagatgctcctggggctatctggaggattcagggagctaaacccgtggggtgccagcacagggccaggtctacactcacccagcgatggctgttctgtgactcagaaccctttggagtttttctgcctcagcctatttgggcaggtaggttcctctggatgaggaatgccttttgtccccagctagtcccctgcctgacctagggcacaggcagtgagggaaagtgcattttttttttttttttgagacggagtctcgctgtgtcgcccaagctggagtgcagttgcgcaatctctgctcactgcaacctccacctcacgggttcaagcagttctctgcctcagcctcccgagtagctgggactacaggtgcccgctaccatgcccagctaatttttgtatttttagtagagacagagtttcaccatgttggccagggtggtcttgaactcctgacctcatgatccacccacctcggcctcccaaagtgctgggattataggcgggagccaccgtgcccggcaggaaagtgcattctttaagagcctttacgagagttaatttaccttgccctctgtcaaactgttggaggtagattggttccttgttctgtatttacctagcaagtggctcccagtgtttacctaccctaacttccttatagaaacaggcatttattgaatgcatattttctccacactgtatgctgttctagggcgttctctgtgtgctgaggaaaggttaaggtgtggcagaattttattaaggccaagaaaaccgtcagggcttctggttgaaagttgcaccaaggctgtggaactcaggtgaaacagcagaatgtctttagtctaaaaggaaagttctattgagaaggcaaatggaagccatgaccaaaaaggtgactcctgagggacatgctctcctcacacacagtggccatcccagcaaagccgcccttccctccagcacctgcctctgtcctaggcacggtgccctctgacaggctgctgccctgaggctggcccagcctatttgtggctacacccttcccctgactccctgttctccccagctcatcaccatgggctttttttttttttttttttttttttttttttgagacggagtcttgctctgtcacccaggctggagtgcaatggcatgctcttggctcactgcaacctccacctcccaggttcaagtaattgtcctgccttagcctcccgagtagctgggattacagacacacaccaacacgccgggctaatttttgtatttttagtagaggcggggtttcaccatgttggccaggctggtgtcaaactcctgacctcgtgatctgcccgccacggcctcccaaagtgctgggattacaggcgtgagccaccgcgcctggcctgggcttctttttttttttttccaatcctgaaggatccaaaacctgaggggagaggaagggactttagaaaaatctcagctccactcctctctttccttacccctgactcagatcagcagttcccagagtgtcccacaggacacagtacagaaatggggttctgtgggcacgtgttgtccaccctcattcattaattgatttagaatcaataaagggttttttggtttattttttgttttgtcacccaggctggagtgcagtgacacgacctcagctcagtgcagcctcaacctcctgggttcaagcaatcctcccacttcagcctcctgagtagctgggactgcaggcacacaccacacacccggctaatttttatatgttttgtagaaacgggatttcgccatgttgcctaggctggtgtcaaactcctgggctaaaatgatcctcctgccttggcctcccaaagtgctgggattacaggcatgggctaccatgcctggccagaattaataaagttctgagtcgaataagtttgggaaacactgggtttggaactcagctaagttgatttactgggaccctctaagaaggcattaaggcagggtagtgtttctcccaaacgaggctatccatgggacccatttctgcatgttgaactcagctgggagcccgaggagagttgtacatgcctgagctcccttcagactcccacagactttgtgctatggggcaggagggagagaggagtgctgaggctgccgggctgcatggaaccccagatagagggaacccgatagcacggtcggcaggctaggggaagtcaaggagtccctgaagagaaaggggtcaccagttgctgacccagcctgtagtagcccctaggcacagcgatactgtcttagggctgaaagttaggatcttccagattactcagattccctttgcccgatggctctgagtggcagttttctaaatgtccactgggtggcgctggctccccaggaggcggcaaaatgaggcgccccttccctttccagcaggaattggcctttttctttacttgaaaattacagaattccatgcagattttacagcctctgtaggtaagctttcacaaggtgtttttctgcacttgtcccccctccttgccccgatcgctctgcccctctcttgggggggtttctgcttctgtttatgccctggtgggccacaccacactcccacaagatgaacattatacaaaagaaaactcagtggaaggttccttctttaaacagaaagcactctcttcatctgccaaatgaagtgagaagggtaggaaaattagattttattgaaaaaatatatttaaaactgatgttttttcagttctgtcttagggctagttagcagtgttatgagacacaaacaggaaggagtgaggtggaaaggtatggaaggtactgggcatggcagctgaagcttgcaaccccagcactgtgggaggccagggtgggacaactgcttgaggtcaggagtttgagaacagcccgggcaacatagcaagaccccatctccacagcaaattaaaaaaaaaaaaaaattagccacatgtggtggcacgtgcttgtggtcccagctacttgggagactgaggcaggaggattgcttgaccccaggagtttgagaccagtctgggcaacatagcaagaccccgtctctaccacaaaagaaaagaaaaagatggaaggggaaaagagaagagttaaaaataaagcagaggaagagcagtgagaaaggtgaaggaagggaggaaaggaaggaaacggtgggagggagggaggaaggaaagggagagagggagggaaggaaagggaggaaggaaagggaggaaagggagggagggaggaaggaagggagggagggaaggagacaggaagggaggtaggttggttggtccgtcggtccgtcggtcctagaccaatcagagtttgcatttcatttcagcaacttccctgggagagggaaagatttgtgcccatgtgatcaagtgtgagcaactcactaagccctaacttatttctgagtcaccattcagagacattgattttttcgacttttgatttccaacttcaaaacaaaacaaagggactcaagaaaacttttgaaggtgatgtgtatgtttattactcttgtgctgatggtagcagtagtgtatacttaagtcccaactcaccaaattacattatgtgcagtttttagtatatcaattacaccttactgaagctggaaagaaatgataataaaaagtttttgagttcttataatttgacagcaaactgagattttactcttataacttgtgatccactgattccttcagcaagcatttgctgacatttaccaatttcctgagtcttgttgatgaatactagagaaggatgttgaagagcactaaataggtaacctcaagcagtgacgttatatctgaaaaaagtgactgaggttcacttttaagtaggcagcgtgctttgaggcctgaaagggctcgggttgaatgggccctgccagccatggatccttatgtagaggctgggcaaaaaaatgctccattttccccctttcgccaagaattgaaatagccccttttcctgctcgtttggccgagtagaagggaaagcctttgaggctattcatgttttcactgcctggttttctgggtcaggattaggtcatgaccgtttcatgtttgttcatttggccttgggcccctggggcaggtagggtctggccaggggaaaggttcttttccagattcttttttttttttgagatggagtctcgctctgtggcccaggctggagtgcagtggcatgatctcagctcactgcaacctccgcctcccaggttcaagtgattctcctgcctcagccttctgagtagctgggatcacaggtgcccgccaccacacccggctaatttttatatttttagtagagacggggtttcaccatgttggtcaggctagtctcaaactcctgacctcaggtgatctgcccgcctcggcctcccaaagtgcaggcatgagccaccacgcccagcccttttccagattcctgtagccagcaaagaccagcaccaaacgtttgttgggctaatggatgggtggatgcaaatgaatgtttgcatttgaatgaaatgactgagaacaaatctttgcctgctttcaagttgctgagcgtccctctactgcctaagatgaggggtttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggtaagtgtctaatttttgacttaaaatcgaagggagtccaaaccttcatatttttactcccctcatggtggcccactttcagcagatttcatgaagacaaattttagcctcttttcatttttttaaatagagatagggtctcgctgtgttggccaggttggtcttgaactcctggcctaaagcaatcctcccatctcgacctcccaaagtgctaggattacaggcatgagccactgtgccctgccagaaacctcttttcaatcagcctgtacttccattttttgtaagctaatttgaaagaaaatgaattaagaatatgacagtttttataagacatttagaaattctttttaagaatttttttttttttttaatagagacaaggtctgtctatgttgcccaggttggtcttgaactcctggattcaagtgatcctcctacttcagcctcccaaagtgttgggattacaggtgtgagccactgcacctgtcctagaaaattttttaactaaaatttataagaaattaaggatatgacagtatatataaaacctagctgggtatggtggtgcattactgtggccccagctactcgggaggctgaggtaggaggattgcttgagtttgagaccgcagtgggacatgatcgtgtaaagtggttttacaacatgaacaatttcatttgatcctcataacactcctaggactgaaacaggtcatgattatgatgcttgatacttatttcacaggggaggcctctgagactcagagacggacagtactctgcccaggcacagctagaagtggcagctccacacctcacattcattcacactcttgaatcagcactcattctactgtactgccatggtatacaacctattaatcagataagatactcattttcctcttggcagtgtgaaattcctctgcctctttaattcagttccttttgctcaagaacactgtcggggggcagaggggagcccacctttcctgtggccgagggcaggaacccaacaagctcctctctgttcccccacaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggtgagcaggagggagggggttcccttcttgggccatttactatggggaaggcgtagtcttttttataaccaaaattctaacaaacatggcatactttataatttgaacatcctttgacagtcttgctgttaccaaatcaaattcgagctaagcagttgaggaagcacatacattctaaagagggtgactgtaaatgaaattttcttggccaggcgcggtgggtcatgcctgtaatcccagcactttgggaggtcgaggtgggcagatcacctgaggtcaggagttcgagactagcctggccaacatggtgaaaccccttcttattaaaaatataaaaattagtcaggcatggtgatgcgtgcctgtggtcccagctactcaggaggctgaggcaggagaatcgcttgaattcaggaggcagaggttgcagtgagccgagattgcaccactgcactcaagcctgggtgacagagtgagactctcagggggaaaaaaaaaaaaaaaaaagtctgtctgtcaacagacatttgggatgattttaccttttggctattgtgaatgatgctgctatgaacactagcgtacagataaatattcatcttttttcatactgagttataggaggccttcttgaaacttcctggctttttctgctttatttgctgactctcttattttctaatgctgagcatccctgaggctcatactagttatagtgacagccttgatggaaattactctctcccacgattttgcctactcagtcatttcacagatggtgaaatccagtcccaagtcgggaagcctgagatcccacagcagcttggtggcaaagctggaactagaacctgggcatgtccccctaggcctttgtctcttactgtctcacgccatctctctcagttcttcctgtagcactggaaatttaactttattcgaaaatatgtatgtaattatcattaaaactattatagtaacattaatggaattctatctatctatccacacatactagaatcctgatattgcagttgttttccttttatattttcctttcagtatagtatttgacattgttttccccataatataagctttcttacatgttgttatacagccattaacttaaaaagttagcctttttgaaaactgacattactctctttttacctaaactttctgtccctcccaatcctgtttttgcttcacttacagcttatctaaatcacgttatttttaaaatttaaaaatgatttctgtgaaatatgtaatgtcgaaagtaaacatcccctgcactcccatcccacagagattccgataattaacagtttagtagacgtgaccccagctattttccttttcagtgtatctccgtccccactcaaggtgctgtcatgtcctctctcttgacactacacattgcaggagttattctgccagcctatcccatcttgggcctgcacatagtacagtggtttgaattttcaaacttgtagcaacccgcactccatcacacacccttaagcctggttttcaaggcctttgccacctaaccctcctaatcttttgttaaatcccacctgaggccagacaccgtggctcatgccagtagtcccagcactttgggaggctgaggcaggtggaccgcttgaggccaggagcttgagaccagcctggccaatgtggcgaaaccctgtctctactaaaaatacaaaaattagctgggcgtggtggcgggcacccatagtcccagctgctcaggaggctgaggcaggagaatcgcttgaacccaggaggcagaggttgcagtgagctgagatcacgccattgcactccagccttggtgacagagcaagactctgtttcaaaaagaaataataaataacaataaaataataatacacgctacctgagtctttctactgtactcagctttctggtcaccctcaccaacaagactcacccatcttagagtgtcttttgttgcattcagtgaattatagataacggattaattatttatcattttcaccaaaggattgttttgagattgggctgtgtatattattgatgatatttgtgcatatagcacacttgctttcagcagctcaggctaattaaatgtgacagatggtttttgaatgaggttagacattcatttatagttctgttgttactcttggtgtattgtgcaatgtgaaacattcttaaaatgcattctttagaataacagtaaccatttttagagcatttacaatgtgctgagtgcttctcatgcatttacagcaacactcagcaggtattattatcatccctaggaaagagaggctcagagagcctcagtatcttgcccctggctgcacagctagtgagtggctaaaccggggctcaaccagatacgcttcacctggagaatatgcataaagcagcatgatatttaatgttatttttctttttccattttaaaggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaaggtgtgtcctgccggactctactcggttctgctgccgtgtgtggaaaaaggataggctggcctgagagggatggtcaggaccagccctccctgagccaggctgatgaaatgatcagtgaatgtgctcccacccgtgtcagcttcttcaggcttctcttcagtaatgcatgtcactctggcctgtagcagcagcaggagacacatgttatctaactttagcagtttctctggccacctagggtcacattagagtcttccactaattctctgaagcccatggccccagtactcctagactccagaatatgtaacaggagtgaggccctggaataagtcaagtctgggctcccttggagcaggtaagccctgagaaacatttaggcacggtgttccctgaggtaccagaagagcctgtggcatttcctaagccagggtggcactggtgggaagggcagtgagtcgttgcagaggtgggtgggtgatgatgcagctattccttgtgcaacagtgaccttcagacagaggaactggtgggcctagaagcactgcctggcatgctgactatcagggcttcctggaagccgtggcctggaccttcttgccttctgagtcatagagccaggcaggcatcctggggctgccaggcacacacacacctaacctgtaggctgtcggggtcaaggcaaagaccaaacaccaggcatgcctgggactgttgtcaccttttattctagtggggcctacctgcttccccaaatcaaagatgcatctataccaggaaattaaaataaagtaaaaagaaatagtttctttatagaggaaacaggagagaattagaccagaaaccagagtaagatttataacagctgagcacttaatttggctctctgagcagacagtaaaacataacaggatgcatgattatcacttgacattttttcctggcaccacattccaagcagaattgattccttgtactcttacgtggaggatatagagtaataaaacacgtaatttatttgaaagcatttatagagaagacaaacactggtcatgagcttcaggtacccttcattccctcatctgcctgtattatctgccccttcctcgggggctccttttcttgccatctgcataacagccacattcaccatcttatgagtccttcatatttctattttaccaaacaaagtggcggtaaggtgtgtgccctggagaacggtgtgtcaggagttaagaatctcatccctatgttatgtttcatcttggctgtctgcaaccctggccaagtcacccaccctgtatgggcctcagtttccccatgtttacaatgagatactgagctgaatggtaaccaaaagaatcagagtttgcatgtattgagagcattctatgttccacgtacattctgtaatatcaccaatccttacagtcatctgacaggataagtttccatttgacagagaaactaaaacgtggcctataccccacagactgggatttgaacctggctccgcctacatagcctcagccctttcctttgcactttgttgtaaaggctcctcctctgagtctctgaattcaatctatactggttgaattcctgccatgtatgagatattctgagcagtgtagggggcaacagagtgcctgctcccaaggtactgcctggggaagactgatcagggaccttgagtgtaaagtaaagtagtgtgcactagttacttctgtgaagctggcactgaatgttcattttgtccacagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctctg

SEQ ID NO: 38310 - DNA, 29270 bp, Homo sapiens
aatagtgaggggcaccgggagcgaggtgcagggggcggggctcggcctggccgcagccattttggtgcgagagaaacaataggacggaaacgccgaggaacccggctgaggcggcaggtaaagctcgcgtcctatggccctagtgcccgaggagctttgagggagattttttcaggctactgggaaacgggatctctgatcattggagtctcccaggttatttgggaaagacttcttccgtggtcattgtgggggaaatctcccggggtccctgtggattcgatttccctgggtcatttgggaggagggtttttcttctgatcattgggggagggatttccgtggttttgggggtccagcatcctccccggtcattggagggggtctcccgggtttgggggagggcaggatctttcctggtcattgagatctccccgggtcttgggaagcgcaagatctacggtgtcattgaggggtctccccaggtcattggcggccacgatctccccagatatttggcgggtggaggggtcttcccggatctttggatagggagtcagctcagcgcctcaggtactgttacctggggtcggcagatgtgcagccattttgagtgttgaatgccatttgggcccgtcagatggtgttcgatgagggaatctacacacttaaccttattatagaaaaaatgcctttaaatggataagaggacacctttatagtgatatttccactctttacgtttgattacagaccgcttttgtcttttgcatcctaatggcttatttcattttaggattgtattcgttctcatatatcaactaagctacactagcagaaaagtgagtgaaaataaaatgtagaaaccagtaaaatccagtgctcttaaataccagggaaaacagaactagtcactgcttggaattaaacatttccgtagcagaatgtacacagaacaaaaaatcatcttgaatagttttaagaaaaagtactggcactttggaacgtggtaacaaaaatgttgtagatcatcggttctatgatatttttaatagaggaccatgattacagtaattttgttgaattctagtgtttaaaatgtttgctgtatttgcagttgtagccaggtaatattttaagtgaactaagatgcttatttatataggttgttgctgtggggtttgtataattgcatcgtgtaacttgggtgttaagtatttaaagagaagcttcagggtgttgttttaactttagccactatcagagttagaaagggccaaatgaatactttatcacatttgacataataggcaaattgatggcctagtaactttttttttttttgagaaaaagttaaactgttaactgtcatttaaaattttttttctattttctgtggtcttgtctgacattgtcatttcgatagatttacctgctttgtgactttagaattcacaggcattgttagaaatcaaatggagaatcacttgagcccagcagttcaagatcaacctgggcaacatagcaacaccctgtctctacaaaaaaaaaaaaaaaaagagagagagagaaagaaatgaaatggataagaacactgactagagttaatacaattgtagaaactagctttttgtttgtttggtttgttttttatgcagggcctgggtagggagggagcaaggcagggacctgggagatctagaaatcagtgtaacagatataatagatttcttttgtgtttcaaagcttcctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggatgagcctgaacctccctgaggccagcttactgaggtgaaaattttccattgtttggctcataaagaggatgcactggggaagaattttccctttaagtgaagttatttcacctagtgggataatcttgggtaacaaattgaacacactcttatacattagaaagtaagcagatgattattctcatgttattacattttaaagcatgtttttgtttttttaaattatgtttttgcctatttgtgtaccatataataaaagtaataagaagtagttgtgttttacagtatattctggtggcaaggaaatgtccttctctccaaaaattgagtttagagcccacttcaggatttggagaagtcaatttgccgagatgatgcacagttgatttgggtctgtcatccataaccagcttcagtagttactaattcctggccaatcttgtttcatctacactgtgcctatccccatcactgccctactttttttttttttttttttttgagacggagtctctctctgtcgcccaggctgaagtgcagtggtgcgatctcggctcactgcaagctccgccttccgggttcacgccattctcctgcctcagcctgcctcagcctccgcgcctggcctgccctaccttttaaagaaagaaagggccagggccaggcttggtggctcatgcatgtaatcccagcactttgggaggccaaggcggttggatcatgaggtcaggagttcaagaccagcctggccaacctggtgaaaccccgtctctactaaaaatacaaaaactagccagcctctgtggcaggtgcctggaatcccagctactcaggaggctgaagcaagagaatcgtttgaacccagggggtggagattgcagtgagccaaaatcacaccactgcactcccgcctgggcgacagagtgagactccatctcaaaaaaacacacacacacacacacaaaaaaaaggaaaaagaaagggccgagcgtggtggctcacgccagtaacaccaacgcttcgggaggccgaggtgggcagatcacttgaggtcaggagtttgagaccagtctggccaacatggtgaaaccctgtctctactaaaaatacaaaaattagctgggtgtggtggcaggatcctctgtctcaaaaaaacaaaactaaacaaatttctgggatatgctccctttaagattcaggggttttttgttttgttttgttttgtttttaatgagacggagtctcgctctgtcacccaggctggagtgcagtggccagatctcagctcactacaaccttcgcctctcaggttcaaccgattctcctgcctcagcctccctagtagctgggactacaggcatgtgccaccgcacctggctaatttttgtatttttagtagagacggggtttcaccatgttggccaggctggcctcgaactcctgaccttaggtgatccacccacctcggcctcccaaagtgttgggattacaggcgtgagccactgcaccgcacctggcctttttctttcttttttgtattactattttttttttttttttgaaaaaatgtcactctgtcacccaggctggagtgcagtggtgtgatctcggctcactgcaacctcagcctcccgagtagctgggattacaggcgcgtggcaccacgcccggctaattaatgttgtttgctttctctatgtatccacctatcttacttgagacactcctatgtgttttcgaaattgagtgtctaatcccaaacctaaggaagagtaaaacttcttttaatggaataaaacatgttagttaccaagaagcagacatctggctctagtgttgcttttgcacttagtttgtgagaatgtgcccagttggaacctgggctagatctcctaagtctgggtttgtggaaggctgccacgttgcctgctctggccctggggtgctgtggcccaagttccccaggccatattactctaccttaaaaccctacctgttagaagagcccacctgttatggctccttgccttgaaccttgtcttgctcttttagttggggctgcttcggggccaacaggccttcgtaactgaagctgcacactcaaatgagatgccccatgggccgtgtgagcttgtctcagctttcatggggattgcaaaaatctcgcatcccccttcagtatttgttttataagaatagtaggttatttttgctttgcaagtatgaaactaacattggatatggctttttggtataactactcacctgcccattcagatttttatgtgccctagtgtcttagatttatatatttattattattattgttgtttttggagacggagtctcactctgttgcccaggttggagtgcagtggcgcgatctcggctcattgcaacctctgcctcctgggtttaagcgattgtcttgcctcagcctcctaagtagctgggcctacaggcatctgccaccacgcctgggtaattgtatttttgtagtgatgggttttcaccatgttgtccaggctggtctcgaactcctgacctcaagtgatccgcccactctggccttccaaagtgctgggattacaggtgtgagccactgcgcccggcctgcacatacaaattttaaataaagacagtctcactcagttgcccaggctggaaggcagtgcagcgatcatagctcgctatggcctcaacctcttggggccataagtgatcctcttgcctcaggctcccaagcagttggggctacaggcacatgtcactgggcgcagctcattttaaaaattttattgtaggccgggcatggtggctcatgcctgtaatcccagcactttgggaggtgaaggcaggcggatcatgaggtcaggagattgagaccatcctggctaacacggtgaaaccctgtctctactaaaaaaaaatacaaaaaattagccgggtgtggtggtgggtgcctgtagtcccagctactcgggaggctgaggcaggagaatggtgtgaacctgggaagcggagcttgcagtgagccgagatcgcgccactgcactctagcctgggagacagagcaagactctgtctcaaaaaaaaaaaaaaaaaattttttttttgtagagacagggtctcgcttttttttacccaggctggtcttgaactcctggcattaagcaatcctcctgcttcagcatccacaagcgccaggattacaggtgtgagccactgcatttggcaaagatcccttttctacatggtattgctgaggctgcagccacatttgtttggggattaacctaactccaagcctgcccactttcactctgatgcccatttgtttagatgtgctttaaacttggtgtctgtggactgtgccatggttccttcctcctcatcagcagggggtggtggtaagttcagtttgcgtgcttttatggggtgccctgtggagttatatgcttggctctggtgctgaagagtcatcatatttcttgagaacttgcctagttactcaaggaagaaagaggagggctgattgtagtatacttgaccgaggaatgtatgtttttatgagcttgaacaacctgacaagaaaaacaataacaaataacttgttaaaccatctttttgcacgttgctgagattatgatcttcctaaattagttaattcttattaaacattttcaatttttcatctattatgaatggaagttttacctgtaaggcagtaaaaggtgtcattccttgaacagtatctgttcttccaggcaagtgcctctaaaggagagagagcccagttgattacaaacccactactgaagggcttgggtttttcttgctttgtgtttgtatctgagcatgaggataaaagtgtctgtctcttcctcaggtctttgggctgcctctgcccttcgtagattctctgctgggcctttggaactaacacagcaacttccagggtctcatgttgaagactttatgggttagtcagaatgctgcatttacactgggaaggccagaggaggactgtaaatccaggatacaaggtcctgggggatttgggagggtagaatttacaggggtgccagttggcagctgacaggtttagattctggggcttaaaaactaatagatgtgtggcctggttcagtggttcatgcccgtaatcctggcacttcaggaggctgaggtaggcggatcatttaatcccaggagttcgacaccagcctgggcaacgtggcgaaaccttgtctctactaaaaataacaaaaaattagctcgacatggtggcatgtgcctgtagtcccagctacttgggaggctgagatgggagaattacttgaacccaggaaggcaaggctgcagtgagctgtgattacaccaactgcgcttcagcctgggagacgtgagtgagaccctgtgttaaaaaaacaaaaacaaggccagatgcggtggctcacgcctgtaatcccagcactttgggcggccgaggcggatggatcacgaggtcaggagatcgagaccatcctggctaacacggtgaaaccctgtctctactaaaaatacaaaaaattagccgggcgtggtggtggccacctgtagtcccagctgctcggaaggctgaggcaagagaatggcgtgaacccgggaggcagagcttgcagtgagccgagatcccgccactgcactccagcctgggcgacagagtgagactccgtctcaaaaaaaaaactaaactaatgaacatgaacagcaggactggggcaggtgaggcctgggaaaggtaagggacaggacccctaggatgatttatctcacgctcaaagaccgtttttactttggaaaataacttaagctccttgtaatgagcgagagaagagtaagatgttaaaactggaagtaccttgttgaccttcactgctggtcctgaaatgcaatcttatttttactttttttagagacagggtctcactctgtcacccaggctagagtgcagtggcacaatctcatagctcacagtaacctcaaccttctgggctaaagtgatcctcctgcctcagccttctgagtagctaggactacaggcgcatgccaccaagcctggctaatttttaaaacattttttgtgaagacagggtctcactgtgttgcccaggctggtctcaaacttctgagctctagcaatcctcccgcctcagcttcccaaactgctgagattataggtgtgagcctccgtgcctggcctcaaatgcgtgcgatcttgattgactgaatccactgctttcctcacaaactgggtgattctgaagagatcagtgtgacctttgctttggaactgtgaatgcaattgaacttgatttctgtaacaaaaattttaaaatatttttctggatcttattttggagagctaactcaggacttctgaagcataattggcaggtgtctctttattaggacatagtgctgtgactggtgcagtcttttttttttaattaattaattttttttttttgagatggagtctcgctctcttgcccaggctggagtgcagtggtgcgatctcggctcactgcaagctccgcctcctaggttcaagtgattctcctgcctcagcctccccagtagctgagactacaggcacctgccaccacgcccggctaatttttttatttttagtagagacggggtttcaccatgttagccaggatggtctcgatctcctgacctcgtgatctgcctgccttggcctcccaaagtgctgggattacaggcgtgagccaccgcgcccagcctgactggtgtagtcttaagacttttctcagaatcgtatctcatttttttctgggctggtctggaagaacactgactgcactcaggccaagtgggttgggtgatacaagctgccagattgctgccacgaacctggagtagtttgcagacccttgcgaggagtatttgtctaagcgagatgttgaaaggacccagaggaaattgtcagagttcccttggtcgcaggaactagtgctgcatagggtacacttttgttcctgctccagcaaatgcagcactcaggtgcttgcctgggcaggtccgggatgccctgcctctgtggctgcccattgggactgaatcactgttggcatcccttatttcagaggatgaattcatgtgtcatttgggtttggcagtgagctaagagctaaatggggtaaacattgcccactggcaggaaacatataatcttgtctgaagctaatggaccgttacttttttggttgtttgagacagtgtctcgctctgtcaccgggctggagtatggtggtacaatctctgctcactataaccttgagctttgcagcctcaagtgatccctccacctctgcctcccgagtagctgggacaacaggcatgtaccaccacacctggctggttattttttgtagagacaaggtctcactattttgccaggattgttctcaaactcctgggctcaaacagtcatcctgccttggcctccaaagtgctaggattacacgtgtgtgagccaccacacgggccctatggaaccattacttattggcatatgaaagaaccatgactcaaggattgcaaaaatccctcatagattgagacctgtaagcaattttggctttagtctgagagagttgcttctctgtgttcctgttgagttagtttcttacaatgtggtgggagactggagactgagaattgttcttgaaaaaggggtaactggcttttacaacagaactgaaaattcctggtatgtgtatagaatacattcagctatttgtaagaaaatttggccagttgactcatgccttgtaatcctagcacttggagagactaaggcggaaggatcacttgaggccaggagtttgaggccagcctgggcaacatagtgagcccccatctcaaaataaagtttgatatattgataaaggggacatatgagaccttagaatcaatcattgttttagcgagaagcttttaaaattgcttaaattctttataattctagcaggttattctgataaacatatttcttttttattatttatttatgtattattattattattttttgagacagggtctcgctctgtcacccaggctggagtacagtcatgtgatcacggctcactgcagccttgacctcccaggctccagtgacccttccatctcagcctcccaagtagctgggaccacaggtatgcgccattgcacctggctatttttttttaatttttatttggtagagacagggtgtccccatcttgcccaggctggtgatacacatatttctcggtagactgaaagttccttcttcctgttccctttaccttggagccctctagtctgtcattccagaaacctggtcagacgaggcagagagatagggcagctagttgtgctggtggttctagaaaggagaagcagctgagaggctactgtgtcccttatggaaaacctgagatttgtccagatttttggaacaatctgctgttttgggggaagaagctacattattgtatgactttcatgtaatcactccagttaaaatctgtggtttcttcattaaaaccagaatgagcctgggtgcagtggctcacacctgtaatcccagcactttgggaggccaaggggggcggatcacctgaggctgggagtttgagaccagcctgtccaacatggaaaaacgctgtctttactaaaaaatatataaaaattagccgggcgtggtggcgcatgcctgtaatcccagctacttggaagtctgaggcaggagaatcccttgaacctgggaggcagaggttgtggtgagccgagatcaggccattgcactccagcctgggcaacaagagcgaaactccatctcaaaagataaaataaaaccagaatgagatgctattgagggctctgaccttctagcaccttgtatacatcttaaggacagtgcgtgttgtggtgttgtggttgttattctcacttggagtgaagctctgagtacgaagggtgggccggatcagtgtttgtttctaggtggatttaaaaccatcaagagccaggcagccatctgtgttttcctgtttcaatcttgaatcctcctcttcccccagtattttctctctcagttataaaggtaatgtgtgctcagagttggaggatattataagtttgaaacattcagaaaactgaaaagcgggcaatcatgatcttaccacctagtatagggcaggttttgtggtgtctgaagcttatataaaataatataaatatatgtaacataaatacataatttgtaattatacatgtaattataaatgccatctttaaacaaaataatgtacaattatgataacaaaattaggtaagaaagtgaatgtttgtttagattgaaaaaaatcacaaaaagttacacatttaaaaatgcagaagaaagttctatagtacttacctccctacattttggggcagcattttgaccaccgctttctttcttttttatttttttggggacagggtctcattttgtcacccaggttcactgcagcctcagcctcccaggttcaagctattctcctgcttcagccccccaagtagctgggactatgggcccgtgccactacgcccagctagtttttgtatttttagtggagatggggttttgccatgttgctcaggctggtcttgaactcttgagcttaagtgatctgcctcccaaagtgctacttttacaagcctgagccaccgcacctggcctgaccacctctttctataatagcaatattacaactgtctgtagagagaacagaagggtcgccatagtcactcctcaagggtaattgatcctatcttttatttctttatttggttgtttgacataggatctcactcagtcatgcaggctgaagctcagtggtatgattagagatcactgcagcctcagactcctgggctcaagagatcctcctgcctcagcctcctgagtagctagggctacagatgtgcactaccacaacttgctaatttttttgtagagatagggtcttgctgtgttgccgaggctggtcttgaacttttggcctcaagtgatcctactgtcttggcctctttttttttgagatggagtttcactcttgtagctcaggctggagtgcaatggcgtagtctcggctcactgcaacctccgcctcccgggttcaagtgattctcctgcctcagcctccagagtagcttggaatataggcgcccaccaccatgcacggctaattttttgtatttttagtagagacagggtttcaccatgttgggcagtgtggtctcaaactcctgacttcaggtgatccacctgccttggcctcccaaagtgctgggattacaggcgtgagccactatgcctgtccttctgtttttttttattttattttattttattattttttatttttttattttttttattttttattttttatttttattttttggtagagaggggtttttgccatgttgcctaggctggtctcgaactcctgggctcaatcgatccacctacctcagcctctcaaaatgttgggataacaggcgtgagccaccacgcttggccaagctgtagtatatccttgaataattcttttagagaaggcttgtgaatagccttttttttttttttaatagacagtgtcctgctctgtcatccaggctggagtgcagtggcatgatcatacctcacagaattctggaactcctgcactccagtgatcctcccacctcagtctccccaccatgcctgactaattaaaaaattatttagagactggctgtcactgtgcagcttgcccagtctggtctcgatctcttgacctcgtgatccgcccgcctcggcctcccaaagtgctgggattacagatgtgagccaccgcgcccggccccatcttccttcttataacttaaaagtttatcaaaagtgaggcctggtgcagtggctcatgcctgtaatcccagcactttgggaggctgacgcgggcagatcacttgaggccagtagtttgagaccatcttgaccaacacactgaacccagtctctactgggtggggtgattcacgcctgtaatcccagcactttgggaggctgaggcagcggatcacgaggtcaagagattgagaccatcctggctaacacggtgaaaccgcatctctactaaaaaaatacaaaaaattagccgggtgtggtggcagacgcctgtagacccagctactcgggaggctgaggcaggagaatggcgtgaacctgggaggcggagcttgcagtgagctgagaatgcgccactgcactccagcctgggcgacagagtgagactccgtctcaaaaaaaaaaattagaaaaattagccgggcacagtggcgcgtgcttgtaatctcagctactcgggaggctgaggcatgagaatcacttgaacctgggaggcagaggttgccgtgaggtgagatcatgcactctagcctgggcaacagagcaagactctcagagaaaaaaaaaaagtgtatcataaacggcccggtgcggtggcacacgcctctaatcccagcactttgggaggccaaggcaggaggatcacttgaactcaagagttcaagaccagcctgagcaacatagcaaaaccccgtctctacacagaaatacaaaaattagccagatatggtggcgtgtgcctatagctgtcccagcaacttgggaagctgaggtgggaggatcacttgagcctgggtggacaaggctgtggtgagctgagattacgccactgcactgcagccttaacaatggagaccctgtctcaaaaaaaaaaaaaagtgtatcataagcattttctcctggttaaaaaatataaaattggtaagaaagctcttcatgctatcctaatagtccgtcatacaattgaatgaaaaaaatatttttgtttcattcatctcctattgctggatgtggaggcgaatgtgttcatcatcaaggatgatagatgtcctgattttatggagcagtggacttgatttttatggagttttcctgaggttgatggtagtttgatgccatgtacccagacaggtcaatttggtgttccccacaagacatcctttcagagtcagacattgactgtttccttcctggctttattttactaaaaatgctttttagttttttattgtttgtttttttcttttcttttcttttcttttttgagatagagtctcactctgttgccaggctagagtgcagtggcgcaatctccggtcactgcagcctctgcctcctgggttcaagcaattctcctacctcagcctcccaagtagctgggatcacaggcatgtgccaccatgcctggctaatttttgtattttttagtagagaccgggtttcaccacgttggctaggctggtcttgaactcctggcctcaagtgatctgcccgcctctgcctcccaaagtgctgggattacaggcatgagccactgctcctggctgatagtttttattttaaaaaatatttttatatttatttcctcatctccatggttagcaagagatatttttgttttgttttgttttgttttttgagacagagtctagctctgtgtcccaggctggagtgcagtggtgcaatcttggctcactgcaagctctgcttcccgggttcacgccattctcctgcctcagcctcctgagttgctgggactataggcccctgccaccatgcctggctaatttttttttttttttttttgtatttttagtagagatggggtttcaccgtgttagccaggttggtcttgatctcctgacctcgtgatccacccgcctgggcctcccaaagtgctgggattacaggcgtgagccaccgtgcctggccgagataattattttttagtgacgatttagcaacctgaaaaccttgggtctttgggatatgacctcagtatcaacacagaatatttgaatgctggttaatatatttgttttaaactgtgatagaattgaaatcttgtagccacattttgaaagtttattcttcattaactagtcttttctcacctgattttctacaagagagaattttccaaaaggttagttgtcgttacattaagaacttgggttttgtttgacatgaaatgtttctacaccagcaggtctcagatgaatgttcaggcgtgggtccttaatttatactccccagttaatgcagacttataaggtggaaaataataaatgcaaagtaaactaatattagccagtgcttggaatgcattttgtaaagtgtgcagcaggccacattttaataattgtactcaccatatgattggtgtggatttggatgatgattgcagtgggtgccttatgagttctctgctgatctgtatgcgttaggtattcatgacacagtagtgatttgaggcacattttgtggagtgcctactttatgctggtgctcttgtagatcctggagattcagcagtgaatactgcagtcaaaaatctgaccttatggaacttgttttcaagtggaaattgggtgggaggagacaattaacaagacaagtaagaaacgtagagtatgtcagacggtgataagtgctgaggagaaaataaagcaggggtgccccagggagtggcactcacttttagatagagtggctgaagatcccattaaagagatgacatttgcttagctagctgtggtggtgcacgcctgtagtcagagctgctcaggaggctgaggtgagaggatcacttgagcccaggagtttgaggctgcagtgagccgtgattacgccactgcacttttagcctgggcaacagagcaagactctatctcaaaaaaaaaaagggggggtgacatttgcacaaagggctgaaggaggttgagagagtgagccaagggggatatctgggggaagaacatatcaagcaaagggaatagcaagtacaaaggccctgaggtacatgtgtatcaggcatatttgagaaataaggaagccagtataattgggccacatttgatgttgatattttttcctctatggatgctttattttatttttttttgacatggagtctcgctcttttgcccaggctggagtacagtggtgcagtcttggttcactgcaacctctgcctcctgggttcaagcaattctcctgcctcagcttcccaagtagctgggattacaggtgtccaccaccatgtccagctcattttttaaaaatttatttattttagtagaggtcaaggctgaccttagcatgagtgattcaagatactcaaagtgaggcagatgagtccaaatagaatggatgcaaaaggaaatttcagccaatgagtttgtatgtagaaactattggacaatgagtaggatttatttttatttatttatttttttagacgaagtctcgctctgttgcccaggctggagtacagtagtgcgatctcagctcactgcaacctccgcctcccgtgctcaagcgattcttgtgcctcagcctcccaagcaggtgggactacaggcgcctgccaccacgcctagctaattttttgtattattagtagagacggggtttcatcatgttggccaggctagtctcgaactcctgacctcaagtgatcacctgcctcggcctcccaaagtgctggaattacaggtatgagtcagcgcacccagcaggatctttttaagtataatcttttttttttttttttttttttttttttgagacggagtcttgctcttgtcgcccaggctggagtgcactggcacgatctcggctcactgtagcctccacctcctgggttcaagtgattctcctgcctcagcctcccgagtagctgggattacaggcgcctgccaccacgcccagctactttttgtatttttagtagagacagggtttcgccatgttggtcaggctggcctcgaacttctgagctcaggcaatccgcccgcctcagcctcccagggtgctaggactataggcatgagccaccactcctggccagcataatcttttctgattattaaaataatacatacttatgggccaggcgcagtggcctgtaattttttgtattgttagtagagatggggtttcaccatgttgaccaggctggtttcaaactcctgacctcaagtaatccacccgcctcggcctcccaaagtgccaggactacaggcgtgagccaccgcgcccagccacgttgtcattccacttagttaaacacctaggagtgggattgctatgtatataataagtatatgtttaactttataagaaactgccagactgttttccaaagtggctttgcattgctaccagcaatgtatgaggcattgcataattaaccctggcttgtatatgaatgtgtaccaggcagatgctgggtggtggctctggaacacacaggaggtatgggtggtaagggttgtttttccaccatcagtatagtgtgccttatgccacccctctgtgactgcctgaccctggggcttttcttaagccagagtaagtagccccagtggatcccattttgtagcctctttaactaaattctggatgagtgaactaaggacccaggggctttcatgagtcatagccattttatttgcattactttaaaagttaagaatattaaggcattgtttccaacagatccttaaaccaatttgatagatttgggggagggactgagtgggaaaactgtatgctgtgctaggatggatgttctgtgtttcttacctgttcatagtttcatggacaaatgtgaggcaatgtggaaagctaaaatagatgctaaatctgaagccagtattttgcagttatttcctgtctttctaggtactgggcccacacattgcatgggctttatcgtaaccattaattttccagccttccagggaaacagctttagaccttagagatcacactgctcaaaaagagagagagagaaacaggtgacatggagattggtgctttggggcttttctttcttctggtgtagttgaggctcctagggaggaagctgatttgctttgtaatctttggaaaattgatccttcatttccttgcagagataggggctgtgagggaccctagaacagaagtgccacttctttgcaactccaaatgtgagaagtatgttttacagtaaaaccatacttatgttcatattgagagattgaacataattaaaacaaaaggatcaaaaagcaagacttactatgtgcaatgcattgatattttgtttattattattttatagagttgaggtctcactacatagcccaggctagtctcgaattcctgaactcaagcaatcttcccatcttggcctcccaaagtgctaggattacaaggagtgagccactgtacccagccatattttgttgtattctgtttaatttttttaaaaaactactagttaccactcactaacttgcttacacaacccacagagtagagatctactctaagcctctcttttcccattttacagaccgtaaaacgaacccaaagggagccatggacttggagtctttctccacgctattgagtagcagaactggtactaaaatgtggctccacctcactacaggatggtcaattgtttccctaattctgcctcacatttggaagtttcttatcagacttggctcaggcaaggatgagcctgatttttcctatctttctacccaaaatgatgatgattttcccaagagcagcaacctatggaccgccagagatggatgcaagaggaagggtgataaggtggcacatcatgcccagcagctaattaacactctggagaagagaagttggagaccctcactgggccttttggcctccagctacgttttttttgttgttgttttttgttttttttttgagatggagttttgctcttgttgcccaggctggagtgcagtggctcactgtaacctctgccccccagattcaagcgattctcctgcctcagcctcccgagtagctgggattacaggcatgcgccaccacacccagctgattttgtatttttagtagagacagcatttctctatgttggtcaggctggtctcgaactccagacctcaggtgattccacccgcttaggcctcccagagtgctggaattataggtgtgagccaccacgcccggccccagctatgctcttgagccacactctagagacgccatgaaggactgtttttgtttattttcgttggaggtggggatgggtaagacatacctacacagagttatttttctacgtaactgagtacatttaaggaatcctgagcagagttgataagggatttgcattgttgttagcattgctgtgatagcaaaagacagggtcttactctgtcacccagtctggagtgcagtggctcagtcatggctcactgcagcctcaatgtcctgggctcaagtgatcctcttgtttcagcctcctgaatagctgggactccaggcatgcaccactacacctagctgagttttttaaaaattttgggctgggcacggtggctcatgcccataatcccagcactttgggaggccaaggcgggcagatcaattaaggtcaggatttcgagaccagcctggccaacatggcgaaaccccatctctactaaaaatacaaaaaaattagccaggcgtggtggcgtgcgcctatagtcctcagcttctcgggaggctgaggcacgagaatcgcttgaacctgagcggcagaggttgcagtgagccaaggtcgcgccactgcactccagcctgggcaacagagcaagactccatctcaattaaaaaacaaaaaaattgtagagatggggcttactatgttgtcaactcctagtctcaagtgatctcctaccttggtctcccaaagtgctgggattataggcatgagccaccatacctggcctggattgtgtttctaaagcctggcccatgaggagcatcttgtgctttaacaattcataattatggtacctgacatgtgctttagtactggtcggcggaccatgaatcagtagcttcttttggtattactcttattcaaaaggtcttttcagtagactagtgtcaaccagtctgcatagacctagagaaaaggcttgtgtggccagacttctcagagctccatcttctggatagagcctggaatggttagaatgtactcatatttacagttccattgcctgtgttgagtttctggactcttctcaatacgtgccttcctggaggcttttgtggtgatgagaaggtagtgccaagtaatcagaaccttaggtttagattctctgctctttgcatatgggaaaacttactgattcctagccattgagttcagttgaggcccatagtcgggtactctctaaaaggaagagattaacaccagtttaaactctttaaaagaggctgctttataaatagaaaatattagttaggcgtggtggcatgcacctgtagtcctagctgcttgggaggctgagacaggcagatcccttgagcccaggagtttgagggtgttttgagctatgatcgtgtcattgcactccagcctgggcgacagagtgagaccctgttgacttttttttaagaaaacagtaaaacgtttaatttttttaagaaaaaattaaaaattggccaagtgcagtagctcacatccatagtcccagcactttgggaggccagggtgagcagatcacctgaggttaggagttcaagaccagtctggccaacatggtgaaaccctgtctctactaaaaatacaaaaaaaaaaaaaaaaaaaaaaaatagccaggcatggtgggtgcctgtagtcccagctacttgggaggttgtggcaggagaatcgcatgagactgggaggcagaggttgcagtgaactgagatcacacttcagcctgggcgacagagcaagactccatctaaaaaaaaaaacaaaacaaaatgaaaaaacaactggccgggcgcggtggctcacgcctgtaatccagcactttgggatgctgaggtgggcggatcacgaggtcaggagatcaagaccatcctggctaacatggtgaaaccccgtctctactaaaaatacaaaaaattagccgggtgtggtggcgggcgcctgtagtcccagctactcaggaggctgaggcaggagaatgacgtgaacctgggaggcggagcttgcagtgagccgagatctcgccactgcactccagtctgggtgacagagcgagactccatctccaaaaaaaaaaaaaaaagtaaaaattcagctgggcagtgccagatatcatgtgccctagaggcagctgtatggggttcacttgggagaagtggcttattgtctctggccctgggtgaatttcctaaccatctctaatcaccttcattgtttgcaacagggatagtagtgtctacctcaaagaaagtgtcaggaccaaatgacataagaaattcctgtcatgagcctgatacataataggtgctttccccacattagaggacagagggcacatctcttccagatccatcctcactcctctctcagttagagtcatgggaactgaaggagttcccagtaaaatccctgtacagatactgaaatgtaactcaagccctgtaagtaatgctagtagagactgtctaatttgtaaattagacaaaacagataatgagtgtgagatggcctgaactggttaacagggtgcatccaaaaatgtgcttcgttgatgcggcatccagtgcatggctgagtgagtggatgcgagctctgattgccccaagagcataactttggtttaaaggtgtgtaccagcttttggtgatcaggatagaactgataaaaatagtgacctagaacactgtgtatctttttaaatggagttaaccagccttgatcagttgtttttagatacagatgttaatcattaaagctagacccaagctccattgctaacaaggttaatggggctcgtctttggccttgggcaggagcagtgtgggtagacaacctggacaagtaaataatgagtcttactagataatgagtaagcaggttttccctgtatttaaatgcattttataaaaatataattaatggggctgggtgcggtcgctcacacctgtaatcccagcactttgggagaccgaatgggcagatcatgaggtcaagagatcaagaccatgccagccaacgtggtgaaaccccgtctctactaaaaatacaaaaattagctgggtgtggtggtgtgcacctgtaatcccagctactcgggaggctgaggcaggaaaatggcttgaaccctgagaggcggaggttgcagtgagtcgagattgtgccactgcactcccgcctggcgatagagtgagactccatctcaaaaaaaaattatatatattaaaaaattatatatatatatttattttatatatataatatatattatatataatatataaaattaatgggagacctgggcatcatccacttaaagcttgacactcttattagaaaatggtaagatttaatccaaatattaggcttgaaattgtgatttcacctcaccatggcatcagttttgcctgcggcagtggctttctaacaccgtagtgggacctctgcctttttagggcccctgaacccattccctgcctgtctgcatctaaccccgccccatgagctcatagtgtttttgtttttctgccggagaaggcgggggccaaggtgggtggcatgggcggagtcccgcaagaactcagactgtttgtctttgtctttctgctgaaggagcagggtgagcagctctaaggcacttcccacgctacttcgaacccccatgtcatcattttgtttgcttccagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggtaagtcccagctgctggaggggttgccacactggcgaggagatgtgagagatcgtggccatggaaggccctggcagccatccctggagccctcactccctcccactctgtgctttccctccctctcctccttctcctcctcctggccctcagcccagcatctcacaccctcagttttcaatccctggtaagattgctcaattctgttttgttgtgtggatttgagtttgattttggtagaagtgtagttgtgttttatgttcaggtgtctcttgatcacagtaacccatagtcccccactggggggacggtgggggaagactttgggaggattttacccagaatacttgccgcctgctttttgtcctccaggaaaccagaagcccgggtaattaggtaggccggggagcagcgttgagtcagatggaatgcaggagtgggaggcctgtgctgattagcccaagccctttgctgttacagaatgtccccaaaattgctatatgaaagcaacccttcgattcacatatgataattttttatttctttttataatgtattttataggggacatcagcagccaccagcatggtggggtctttgttggggagtgggggagtcttttgtaaatcaagtaagaatccattaaagaaattaattttaaatgtgcattacctggttacataaaggactctagaacaacttaggttcttttgggactgttgaaacattgtctttaaggacagaatgtactgggtgcctttctctgtactctgaatatgcatgtgtattgcggtggggatgggggagttgggggccctcacttggtccttctctgttgtttttttccaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagaggtgagtgtagacagagggcaactctgggctatgtgggaggggaagtgttgggggttttggttacagcccagttccctggagctaaggactgaagtggatttagtaggtaccttgtcattcagtggctaattcccacatggcatactcagcctctctttgtttaattgactctggttagatcatgccagtttgggcaaacagctgcactggcagctgtaagagattcactcactcttctatgactgctctgtgctaggctgtgttctggagatgtagcagtgactaagagaggagccatccttttacctcaggttgttcaccagtggtgggggatgaaatgagcagttgggcatccctgaaactcagcaatccccctaagcagggccatcctacccttgcaccttggcaaagcttgtgaaaatataaatagtatatataaagtaaagtacatgtaatgtagctaagtaggttgacgtagtcccatggaatttcagttcctattttcccagttgccagcttttggagtcaggggaacctggttgtactggaggctaggtggtaccactgcctagaagagggcagtgaaggctctccacatacagggctggggagcaggggctgatcttggatcttaggttctttttgctgtagaaaatagtggttgactggtcccttaattttattttctaaaatcaactttcttgaggtatacatgtggtaaaatgcacccatttggagtgttcagagagttttggcagatgtttacacggtaagccaccaccacatcaagaagtcacttttcattactgtagaaagtttctggccgggtgcggtggctcatgcctgtaatcccagcacttcaggacgccagggcgggcggatcacctgaggtcaggagttcgagaccagcctgaccaatatgatgaaaccctgtctctcctaaaaatacaaaaattagcccggtgtggtggcatgcgcctgtagtcccagctgagacaggagaatctctagaaccgggaggcgtaggttgcagtgagctgagatcgcaccattgcacctgggcaataagagcgaaactccatctcaaaaaaagaaaaaaaagaaagtttctggattttatttatttatttatttatttatttatttattttttgagtctttcttgttctgttgcccaggctctggagtgcagtggcacgatcttctaggctcactgcaacctctgcctcccaggttcaagtgattctcctgcctcagcctcccgagcacaccaccacgcctggctaatttttgtatttttagtagagacagggtttcaccctgttggccaggctggtctccaactcctgatctcaagtgatctgcccatctcggcctcccaaagtgctgggattacaggcatgagccaccatgcccggccttctgaattctgataagacatactgatttattggtccttatctctttatagccataagttagaagaagaatttgagtggctaaagaaatctgaagtcttgtactacactgtagagaagaaggggaatataagttcccagcttaaacactataacccttggagcatgaaatgtcaccagcaacagttacagagaatgaaggagaatgcaaagcatcggaaccagtacagtatcctttgttcacgggcatctctgcatttgagggtaagaggagaggaaatgaggaagtcccttggagcttggagagagaagttaggtttttatagtcatggttgagtttctcctacctgggttattccaggacctgtatgataattatgggcaaataatcacttccctcagggcagctactggcctaggagtgcagatgatgaggagtggggtataatgggtttctgggaggtgaggggtgcctcatgaaggggccagcttgcatcaggtgggctttagcctaggtaacctagaggaagagggcaaggagctgctccctgttttcagacttttcagaagtctgaaaacattgctcacctgccaagggctggggtgtttgggtgaggagactgacctgatcagtcctggttcaccagaccaccactgggacatgagctgtgcataaggaaatatttgttttcttttctcttttctttttttcctctctctctcttttttttcttttttttttttttttgagacagagtcttgctcgtcccccaggctagagtgcagtggtgtgatctcagctcactgcaacctccgtctcccaggttcaagcgattctcatgcctcagccacccaagtagttgggattacaggcatccgctaccacgcctggctcatttttgtatttttagtggagacagggtttcaccatgttggccaggctgatccaaactcctgacctcaggtgatccacctgctttggcctcccaaagtgctgggataactggcatgaaccaccacgcccagccctcttcctccctgcccctcccctcccctcccctttgtagaggtaaggtctcactgtgttgcccaggctggtctcaaactccggggctcaagtgatcctcctgcctcagcctcccaaaatgttgggataacaggcgtgagccaccacgcctagccttttatctattttttggtctcttaaaaatgtaaaaaccattcctagcttataggccataaacagcaagcactgggccatagtttaccagtttctgctgttgggagcactgattccttgaatgggaaataatgagtcaatggtctgtgcaccagagacactcattatttctggttattgtttctagacctttttagtgcacacagctgagaagcagacgtttaaagagcaaagtattttcatgagtttatactgatatttccagttcacatttaaggctacaggatttactgaactttcttgatgttctacttgtaattgaggactttgtttttggaccctagtcctacacttagctaagagttcagaagatggcatgtgtgtctcccaggcaggaagagcctaggcctctgttgagtccgggtgcaggctgcttccacgtcagttccctgacaagaagtaaaggtgtctcttagctttatagtcagctctggactccctgtgtcggggatggcaggactaatggagtctcctgtgggttcaggcttctctgggtcactgcatcaaggcactgtaccttgagagtgccaaggacccatgcagtagcacttccttttgggggtattattcttaactactcagaatttatcttactggaaaacctgacttcccgctacgaggtgccttgtgtccttgacctcaagatgggcacacgacaacatggtgatgatgcttcagaggagaaggcagccaaccagatccgaaaatgtcagcagagcacatctgcagtcattggtgtgcgtgtgtgtggcatgcaggtgagggggatgctagggctggctagggcatccagtggctgtcacttccccaccctggtatagtcctgtttgctcaaaagattccaggccaggtgcagtggctcacacctgtaatcccagcactttgggggtcaaggtgggtggatcacctgaggtcaggagttagagaccagcccaggcaacatggcgaaaccctgtctctgctaaaaatacaaaaattggctgggcgtggtggtgcacggctgtaataccagctacttgggaggctgaggcatgaaaacagcttgaacccaggaggcagaggttgcagtgagctgagatcacgccattgcactccagcctgggcgacggcgagactgtctcaaaataaaaaggttccagatttgaccctacatgagtctgttgctttttggttaaaaaagaaagcatgcatgcctgcatgatcctctctcagattggtctggttggctgagtccagaatctgtggatagtagtagggaggaaggcaaaagggtttggtcctctccagtgacccagatgttgaggtggggtgctggggcacaatgaccaaacccaggttggatggctgcatcccaggtgggggctgatcagagagcatagtggacagtggctcatgtgcaactggtgtactttatctgatctgggctgtcacatgccgccaccaccacaccaccccacccccgcccggggtccagggtttgagatggccctcagcccctgacttgctggtctctctcctacaggtgtaccaagcaggcagtgggcagctcatgttcatgaacaagtaccatggacggaagctatcggtgcagggcttcaaggaggcacttttccagttcttccacaatgggcggtacctgcgccgtgaactcctgggccctgtgctcaagaagctgactgagctcaaggcagtgttggagcgacaggagtcctaccgcttctactcaagctccctgctggtcatttatgatggcaaggagcggcccgaagtggtcctggactcagatgctgaggatttggaggacctgtcagaggaatcagctgatgagtctgctggtgcctatgcctacaaacccatcggcgccagctctgtagatgtgcgcatgatcgactttgcacacaccacctgcaggctgtatggcgaggacaccgtggtgcatgagggccaggatgctggctatatcttcgggctccagagcctgatagacattgtcacagagataagtgaggagagtggggagtgagcttgctagctgctccagtacttgagagcgactctgtgtcccaggcacagctgtgctgcgtcagggaggaagccagtatggccaggtggtggctcctgcagcctggagctgatgtgcagtggcctctgtgagccccagcctgagccagtcccagctgtgcttggagtctttatttattttaactatttcttcaacattccacatttgatgatgatacctctttcttccctgagtgtatatgttctaatacaaatctttttgtttattgt

SEQ ID NO: 38311 - DNA, 10850 bp, Homo sapiens
agctcgtgcgcctccccgtgggtttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggaggtgagtgaggtcggcggggggcttggggaggcgagtgaggtttcgctcgtggaaccgaggagtcgagcccgtcctgggagagcgttgggggtctgggtctcaggtgtggcaggtgagcgcggccggccacgggcggtgcagggcaagtccggaggcaggagtcctgcgggtgttgggcgccgtgctgcgctgtagggcttctttccacaagggaggagtcctccgtgtggcttcttctcctccctacccctccgcccagatgtggacttttcctaacgctctggcgtctctgggcttgggtcactggagtgggggcgggggcagcggctctgttcccagcttcccccaactaaatccttaaaggaccctaggttgttagggccagacgggactccggagatgactcagccttacccctcattccataagtgagaacattgaggcccacagaaaggattcaactcattcaaggtcgtgctgttagtgagagtctgagttgagaccagaacccagttcctatcccttcaggctttccatgcccgaaacaagggctcctcccaccgttgagcctcagtttatatgaagtgaggataataacagtagtttttccattagattgtgaaggtccagtggtgtaattaatgtgaaaactttgtaaactctgcagagacgtggtggtggtagttatccaactcttccaaaactgagtgatgtcagcactcagttttacttactttgcatctgtcccggagtagaatctcagtgcttgacaaatagcaggcccttggtaaatgtttgttgaataaacgaggactcgtgtttagtaccttcagtagttgcccgaggagcattctttctcttctgtttcggctatggattacaagctgactatgtttgagggaattcctgttaaataaacttgggtaaaagaggccagaatgatggctttgtgtgtgttatatatttatttttaattgcagatgacaggattggacattgagaaggaccagattattgagatggcctgtctgataactgactctgatctcaacattttggctgaagtacgtgatgccatgtaatacagtcatactttttaaagggcactggaaatataaccatcattttttccagcttctttatttaaaaaataagaaagttgaggtctatatgggttaaggtaatgtgctaggtcatggtaggggtggtactagaaccaaagtaatccatctcacagcctagtgaaaattaaaaattaaacattattttttaattaaccatgccagaaatttacagaaacataaattctgtcgtttactgagcgcttactgtatgccagctacagtttctgtgtgctttatatgtctttgttcttagttctcacagcaactataagttagttattgttataatgctcatttgatggatgaggacacttgagcatagagatgttgggtaatttgtctgaggtcccagtggctgtttactgggggagccaagagtttaactcaggctgtctcagtaaggtgctcctaacaagtaggacagccagctgtcctcccatcagatttggtgactcgtgccaatgtttgcgtctttatatcataaccttgactttaacttgactccatatttacaattctgccttttcaactaggacatgtgattcttctagatcagtattaagattttagaatttctgttagtgcacacccgtaaagtgttctgttgttgacagattgggcatgattaaggtttttgcatgctacttccaactgaaacatttagcaaaacaaaacacacctgctgcatttcagccactcatgaaacatttaataaggatgtgacaccatctggtagggggtgaaatccctgaccctgaataattctgttttatactgtcagcagtattcagagccagaaactccagaataggaacaaagtagggatgtttgtggaaaagagagtcttgttaaaataagttcctagagggtagcattgatatgttactggcactggatacatttcgtaaatctgcagttaacacttttgtttgttttgctgtgtaggtaaaagaggtgaggacgtatttctagattaatgactgcgtttgtggagtaccaggcttatcctccccacatatcaactgtaggagaatcatgagactttgtacttctcatcataacaacttttttaactttgtataaataaagccctgagttttagatttggttgtttttttctgttacttgggatttattggagatcaatagtgaagagaagtgtctttattttaccagtctaacttacccttggccgaagaagagtgtttcctttagactgttgatataatgtgaaatactgacagtttaatggacccgtaggttgatatgtaccctggaggaaatttgggtatgtattcacacagctgcagatgaatgcagcatttgtaaatggactaagtcagatgaggataaagatgttaaaaaaaaaaaaaaagcttaggggctatcagttctgcagtatgttttattcttttataagagtctgagaaaaatgttttatgctggtagaagagcaggcatcctactctgaaaatttttctgtaggtgtggtcccttggcttgctaaatagggatctaaaatagtttgtagtagtttgatttttccatcattgttagtattttttttaatagtatgagtattttttttcattttcataggtttgggttttctttttccttcgtgactatcataaaacatctgttatccaagcaaaattttttgtttcttcgcagagattaccaacaccagttttcttgtttggctaaatctcctttttagtagtaggatgtcaggcgtattttaattaaattctagccatttctttcagtgattgtgaactgtttttaccaccttagtagtaataataccttggatttatggaatacttttctatcagagagttcaaagagctcatatctataatttcttttatcctgttaacatttctatgagggaaggggtacagtttattattatcactatcttacagagggagaagctgaggtgacttgctttaatgccgtagctactgttaactgccaggacttatctgagagactcatacttggatgttctatgaaatggagctgagaatttgagggctactttgtgttttggatatcaacaattacctctttaatttttttttaaatataaaaatactgttaaaacagtgtaactatccaaagtatgtgtgtagtgaactattggatttttgtcctgttctattgctccttcttactccaagtttatgtattgtcttgatattttgtatgtttatataaatgcgtgttttttttaaaacaagtgtaaatgaaatcatacctatacatacatggttttgcaattgtttttttcacctgcaatatagatactttttttttttaagagatagggtctcaccctgtcacccaggttggagtgcagtggcatgtagctcactgtaacctcgaactcctgggttcaagtgatcttcctgcctcagcctcctgagaagctaggactgtaggggtgtgccaccaggcccacctaatttttttttttttttttttaattttgtagaaatgaggtcttgctatgttgcctggactggtcttgaactactggcctcaagtgatcctcccacctcggcctcccagagtgctgggattaccatgcttggcctagacacttttcaaaatgaactcataatcaagggttgacagacttttctggaaagagcaagttattaaattgtttaggctttgagtgcagtcatatgttcttgtcatatgttcttttttttttttaaacaatcttttacaaatgtaaaaatcattcttagctttctagctattaataaatagctgaagtgtggggccatagtttgctgacccttgatagatatctgtgtcatctatttgtaggattagagttttcagtggtgtgtgtatgttcgtatgttctattttgccttaatgaacagtgctggaatgaagggggaacacttaaagtatccttatctcttactttctctgatatgtatatttagtccttaaaacagcttaagctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattcttgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggtaaaatccaatcctgtgtatatcttatagtcttccatatgtagtggttcaagagactgcagttccagaaagactagccgagcccatccatgtcttccacttaaccctgctttgggttacacatcttaacttttctgttcaagtttctctgtgtagtttatagcatgagtattgggaaaatgccctgaaacctgacatgagatctgggaaacacaaacttactcaataagaatttctcccatatttttatgatggaaaaatttcacatgcacagaggagtggatttagtaattgttaaccttgtgtcgtatttgttttacctattttttgttggacattttaaaggaaattgcaggcatcaggacacttcattcctaaatacttcatcaaacatctcctaagataaagacattttcttatgtaatacaatgtcattgcattgaagataattaaacattattcagtatcatatgatatctagtccacattagatgttccccaaaatatttgtttttgaaccaggattcagtcaaggctcgtgcatttcatttagttatatttctttagtctcttaatgtaaaactttccacctattatttttcccctgtgtcattgactttctaaagagaccaggcctgttctaccaggatttttaaaagggtgacattgccagagggaagttaatgtttctctgaaggtatatgtacgtttgtatatgtaagtcgatgtggtagctaatactgttcttaaacatttataaaaataagttttggcattaagtactagagcatatattgtgtaaatgtttccgccagccaatgtggctgatatctgttttaaaggtctcatttaaaatttagtgtttttagtataagttactttttggggacataaatatgcatatgatttgtttaaaaatttggattgtaaataaaggtttatctacctatgtgattcagttaaatttttagtgttagtggtgtgaattttgtgacactgggagaaagtttgcatatcaggtatgaccttagaaagtaacaaatagatttgtgcattacatcaagcatgtggaatgatagatttgtccttctgttcatgagaggtcatttacaaatttataaggagctaaactgactaagtacttggaaatctgtacttgtaagctaatcacatttacccaaacctgatttagaaatatagaggtgcttttaggaattgtttgaattttaaaaaatcatctccatttcaaatacaacttatgaattttgatatcctgttgtataatactagaaatatagagatgcagtatgcttcgtgtctttctaggaaattcagttcatgaagataagaagtttcttgacaaatacatgccccagttcatgaaacatcttcattatagaataattgatgtgagcactgttaaagaactgtgcaggtaagggctatatttaggatccattaaattacctcatttagcatgttttaattgagaatttgtggaaagtaattggatagagctgtagaactaaggctaccaagtgggttcatatcttcctcatcccattcttgcttgtataggaccttaacttaccctggactggtgagaattgggagcaacaacgtcagacatgttcccagtaaataagccaatgcctggcacaaaataagtgctcaatacattttctggattaactaatattatgtggaagtcttgtgactgggaacatatagatgaaaagctcttaagtactttagaaaatagtggatcgacatatgtgtaaaaaaacgcaccctgaaaatatactctatgatgactcctatagtgaaaatgtgcgtatggactagtgaggtcacaagggaagcagcatctaactgtgctggagcaagaggaatggggagtcagagaaacctttacatagcaaggaaatagctttgaaattgagatgtgaagaagagtggaagtcttgcaggcattttattgaggagagagcattcagagagagcagacagaagtataagaatgtgagggagcaggaagctaaggcaaaatgtgttaaatgaatcccaaagcattcattaatgctggagtgcaaagcatgaggttggagaaggtgggaggtggttctagggcctcaagagcttgcacaccatgccagtgaagttcactatgatcttgcaaggaatggggttcctttgagaaagtgtaggtagaagagtgagtgataacgatcgttctgattcgaaggtggcaagaaaagtggtagaaagatagaaaggaggctttttttttttttttttttttttgagacggagtctcgttctgtcgcccaggcgggagtgctgtggcgcgatctccgctcactgcaagctccgccttccggattcacgccattctcctgcctcagcctcccgagtagctgggactacaggcgcccgccactgcgcccggctaattttttgtatttttagtagagacggggtttcaccgtggtctcgatctcctgacctcgtgatccgcctgcctcggcctcccaaagtgctgggattacaggcgtgagccaccgcgcccggcctgaaaggaggcttttctgccatcttggggagaagaatgaactggagaaagggcagggcatggaaatgaggggcttgtatgataaaaatgtgagagggtcagttgacagacactcagtgttcgaatgaggtggtgtgaaaaggaagaggtataatgttattctgatgtttgtagtttgagcagctttggtggatgatggcagtgttcaaataaaaaggagaagaagaagagtagatatggtggatggggcaggggaggtgttgacaatggtgggtgtgttttgatgtatgttgaattagaagtgtctggtagatttttagatggagatatctagtgggcagttgcatatccatgacagaaactctagggagggctgggctggatttccagatttagcaatcttacacactgatgagcttgctcatagaaaatatatagaagaaagagaggagagggtagaagatagaggccccggcaaagaagcaacttgagaatcatgactcaaatgccattttcaatgttaatggattacttgaaggaggtaattgttcagtatatttgagacagcttcctttgagagttccatttctgctgtgtatagacgctggtatccagaagaatatgaatttgcaccaaagaaggctgcttctcataggtaagtttgagttctaccaagcgttttccagtctgacacacacttaactcccaaattcctgactgcttgaaataatgtcccttaactcttttttctcggggaaaagataaagttcaactagcataaacataacattcttttactgttaggaattctggtcaggattccagtgttccattctgagagggttatatagcctttattgctgtttcaaaactcttagatagcttggtttataggaatgatgaaacaatctgtaatctttctagtaatgaaccgtgttaactttcttcccacagaagatatggacttgcagccttttgaaattagaacactttttgtgtgcaattctataatacagttgcctactttgacacttgttatagtttttctgattgtttctcttatgtctgtagccttaggtacaagtagacaaggaatttaaagatcttgtatattcatgtgtcctgtactggttcttttctttttgattttgtagtctttcaggagaaacatgaaacctgatgggaggtttagcagctggcttctaagggtagcatttattaaaccatttactgaacccctatgatgtaccttgcacagttataggcaaatagagaaagaccaatccctaaagagtctggcattcttacattattttattgagtgtatgtagactgtagcacaggcatacaggcctagactaccttatctgacacaactggggtatgttttgatttcagaatttttcagattttagaaaggtgttactacatctgtattgtttattatcttgtagcatccctaacaaggtttgagaagcagcccataataaaacacataggtattctgcagtgaaacgtgtatattcacaccaaatggcataagtaatgatgactgtcaatagcctcacattaagattgctcaggttttgctacataataggttctgtaagtactgtgggttttcaggtgtgttttggatttcagttttgtggataagatattgtgtgcctttatttagccagaggctataattttggcagcttcggctctgacatatatccaagtcctggaaagaaagcagatggttgccttagccacacaaataattgtcataaaactcttgcactaaaatttgtgcagggaattctctagaagtggcccttggcccatgattcagagtttattgatttacttgcacactgttctaataatcttggttacctgatttctcagaatacaacagatgagaaacaacatattggaagaaaagaaaggctcttagatggaggcaggctgccactgattatagcacaaatcaccatgagagaggaggtagatcctctggtatggttaggtactgtttgataattgatgtttattatgatgactgagtcatgacttatgttcaagtgtgtcagtctgttttgttgagggacatcatcaagtattgggcaatgtttctcaaactgtgttccatgaactgtttataagtattctacaaatgtggtcgattaagttttagaaatactaaaatttattaattttagaaaattaataaattagaaatataggacagcttccttttgggaattcataatacacattagtatattaaatgctttgcaactttttatttcagtaaaaagtttactctagtttttctaaacttatttgaccgtggaattattttttctccctgtggaacatgtcgccatcttttggaacaatttgggaaactttaatcttctatattttacaaatttttttgtcaaaagtttttaaaaaacaaagcatttaaagaaaattgcttttctgaaatgttctacttttgatgatgctagacagtgacacttacagtaacatccattgttcttaagtcgttttttaaaagttgtacttttaaaatgattttcatctcctggttttggacagttcattcattgtggtatgtttgcttatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaa

SEQ ID NO: 38312 - DNA, 33329 bp, Homo sapiens
gcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcgggggtgggtacaggaccacgtccgggactgtggctcaggagagttgggaaaggaggagggtgtaatgatggtcagcgctgggggcctcagtttccccaacagtaagaaaaaggggttggactgagtctgtagagttgggtcatcagaaaaagggggtggcattatggggcttgggatttgggtttttgcttccaagaatgctgttggacatctttggttcatataggtgtgattggttttcttgggggtcctgattccccaaccctcttgctcttcctccacccactccaccacggcttcttctcatcttcacctggagttgccaggaaggatccttttctgaaacaagtggggtggagacactggtagtggttagaaatttgagctttgtagccagaaatgttcatgtccaccaacttctaactatgtaaccttggattaattatcttctcagaaccttagtttcctcctctataaagtggaaagaacatctgcctaatgcggctgttggaagaattaaaagagatattgcctgtgacttcatcttagtgatgtgaacagtctggagctagctagcggccaggactccagttccactctgcttattagcggtatactatgggcaagttacttacattctctgtgcctgtttactaatctgtaaaatggggataaaaggaggttttagaaaacaacacatagtaatacctctaagtaaatgggaggtaaatttttaagaaattgtaagactgctcttcattcttcataccttaagggttctctaggtgtgtggtagctgctgtgaggcacttaattttaaaaagaaaaacagacaattcctgctcctaagtactttataaagtttagactaggaaaagattagagtgtcagggttggtgggagtcacgaggtgtgggccggatatgcttggtaaaggaaaaacatgaggaataacattgggattggagaatgagaaagttcctcttgtattacggggacagcaagtagtctcatgaaaatgtggttggaattattccataaatttaaacttgtctaaacttgtttatagttgcactaaatataaatttgtacctagttggatcctgctttaagtcagcctgttatttaaaataaatctgtcatggctgtgtgcggtggctcatgcctgtaatcccagcactttgggaggctgaggcagggggatcacctgaggtcaggagttggagactagcgtggccaacatggtgaaacccccgtctctactaaaaatacaaaaattatccgggcgtggtggcacgtgcctgtagtcccagctgctctggaagctgaggcagaagaattgcggtacacgtctgtagttccagctactcgggaagctgaggcagaagaatcacttgagcctggaaggccaaggttggggtgagccaagattgcactactgcactccttcctgggcaacagagtgagactccatctcacaataaataaataaataaaaataaaataaaaatctgtcattttacataactggggaatttatttgcattaaataaattctgtggtcaatctctctgtaaagagcatgtttttttttttttcttttttcttttttttctgagacaaggtcttgctctgttgcccaggctggatggagttcagtggtgtcatctcggctcactgcaatctccgcctcctgggttcaagtgattctcctgcctcagcttcctgagtagctggaactacagatgtgcactgccacacctaactaattattgtatttttagtagagacaggtttcaccatgttgaccaggctgttctcgaactcctggcctcaagtaatccacccacctcagcctcccaaagatttgggattacaggtgtgagccaccacacctggccaaggacatattttcgaggtaaataaattcaggcttacatgcggtattttccaggcacacttccattgggtatagcaaggaatatatatcttactatcactttaaaataaagtacccaagacatgtccctgtcaactacagcaggatacgatatagcatcatattcagtgttgagtggttaagatgagttgttttagggttccatttactctaaagaacaagggctattgtgggcagaatggccagggatcatgatgcaaagtttgggtctttgaaggcagcaaatgcttttctcatgtgtgtaggtactgtggaattaaagagaggctaaaaatagcacctcaaactctagggtgcagtattatgggcatcacccaatctgcatgtgaatttccatatgaattccccactacccaaaggaggcttcccagtgggggagttgtagaaacccccttcctttccctcagattctaccagcaacctgggtacccagctcaactcaccctgatgtgaaaggaagtggataaacaggtgaaaagaggcagggaaactttttttgtattttctctccaactcatcctaggccttggtctcggctcgccttatttccccagtagagctggatatgattcattagctcaaaagtgtgacatctacagttctgaggtactttatagatttaaaaggctatatggactggtttgggagttgaaccatcatgtataataatgaacttatgaggccaggtgtggtggctcgtgtctgtaatcccagcactttgggaggccaaggcaggcagatcacctgaggccaggagttcgagaccagcctggccaacatggtgaaaccctgcctctactaaaaatacaaaaaaaaaaaaaaaaaaaaaaaattagccgggtgtggtggtgcgcagctactcaggaggctgaggcaggagaattgcttgaacccgggaggtggaggttgcagtgagccaagatagtgccaccactctccaacctgggggacagagtaagactccgttgcaaaaaaaaaccaaaacaaaacaaaacaaaaacctatggaaaaatgtgtcatgagtgaacttgaaggaattagttgtctcttggggaggtttatttatccagtgtagtatattttcttttctttttcttttttttttgagacagagtcttgctctgttgcccaggctggagtgcagtggcataatctcagctcactgcaagctccacctcccaggttcatgccattctcctgccttagcctcccaagcagctgggactacaggcgcccgccaccacgcccggctgattttttatatttttagtaaagacggggtttcaccgtgttagccaggatggtctcaatctcctgacctcgtgatctgcacacctcgacctcccaaagtgctgggattacaggtgtgagccaccacacccagccctttttttttttttttgagacggagtttccctcttgttacccaggctggagtgcaatggcgggatctcggctcactgcaaccttcgcctcccaggttcaagcgattctcctgcctcagcctcccaagtagctgggattacaggcgcccaccaccacgcctggctaatttttgtatttttagtagagacagggtttcactatgttggccaggctggtctcaaactcctgacctcaggtggtccacccggctcggcctcccagagtgctgggattacaggcgtgagccaccacgcccagcctatccagtgtaatgtattttgtttgactcagactcagtcttttattgaaatcagtttttagcaagcacctactattcttgaatattgggctggtaaaaggataagaaggaaaagaagggtaagattcaggcctcaaactatcagtatagttaggggaaataaaataccttatatggggaaataggaaaatatcagtgagtgttataaattgtaccatagcaatttagaacaaaagagtgaaaggaatgccaagttaaaggagggaacagagccagatgcagtggctcatgcctgtaatcccagcactttgggaagccgaggcaggtggatcgcttgaggccaggagtttgagaccagcctagccaacatggcaaaaccccgtctctactaaaaatataaaaaattagccaggagtagtggcatgtgcctgtaatcccagctactcaggaggctgaggtgggagaatcacttgagcctgggaggctgaggtttcagtgaaccaagtttgcaccactgcactccagcctgggtgacagagcaagactccatctcaaaaaaagaaaaaaaaaatgacggaacagagcaaggctggttcatcaggggaaacctacaagctgaatctcaaggcattctttctacccttctttagtgtgaatggacatggattgattgagagaggagaggagtataataaggagaaaaaaagaatcaaagccagaaactagtaagctatttatgtggtacagcaatataattagtttaactataatagaattccctgataagaatcctaggttcttgtcacttccttttagaatttctgggagagggatcgcatatagtttcattatctcaaggtgaaaaatacagtgatttctgaaacctgaatgatagaactgagggattccctcttccttagagtcatactttctccttttagtttaaactgatagggacatagtttcattgtgattcagcattatcggaatggtcctgaggatgcttttgccccctcagattctgaattggtaggctctgtcctattctacttggtttgtttaaaatttagatagtgtttaaaatttagatctatagatccatccatctacctatctatctctatctatctatgtatctgtgtatctttgtgaagtgctagtcatttgggttatgtatttggtgagtattcaatatacttttactgtagattattaaataatgaattctgaggactatagggagaaagccagaacatagtgtaataatctgtgtctttcattagagatcagaaaatgtaatatttcttctgcattcattcaaaaaaattattgagtacctattatgtacaggttgtggtagctactagggatatagcatgaatgagcagagcttgtagtctgaagacagacattaagcatctcattatacaaataattatttaattcatgtgtgataagtgttgctgattaaaaaacccagatgctaccaatgcatatgacaagagtgctgatcttgagtatgactggggggtaggtagaatggtcagtgattaaagcagacacctacaatttgagagaacacaggcaggggagggaaggtatacatgtaaagaaatagcaggcatgaagactgagatgggaaggagtttgtggtgtatctgaggtctagaacacagcacagtgagcaagaaggaaacccgtggtctgagcctaaggaagtacacaggtgccaggtcatgtgggccttgtagggtatgttaaggattttagactttgattttaaagcagtatgacgttagtgaaaggtttaattctgtggaatgacataatcagatttgtactttaaaaggctatgctggctatgtgacagaaaatggagagggtaggggctggggagggtaggggaagaagatatgtggggagatgaattaggagactgttgcagtggtgtgagagacagtggtgtctaggctatgtgggggccatcatgatgtggagaaatgggtggatttcagagatacttaggaggcagaaattacaggcttggaggttaattgaatgtggggagtaaggaaaaggtagtgatgatttccagggttttaataagagcagcttaatgaatagggttgtcatttactgagctggagggaggagtctgtttagtgggcgaagatcattaactcagttttgaacgtgttgattttgaggtgtttatgagctttctaagtggatatattgattgcctatgtggttgaatatacacatctagaggactggactagagataacacctttgggagtgtcggcataaaaatggcatttgaaattatgacatgggtgaacatacctgaagaatgagtaggaacactaagagtttaagattaaatagagggtaaactctcaaaggtgactgagaaggaagaattggagagataaagaagaatgaggagagcatgatgccctgtaaatcaaggaaaagggaaggggtggttatttgtgtcaaatcctgctgagagaattggagatatatctgtcaacactggcagtattggtgacactaacaagagtgaatttgatggagtccttgggtacgaaagtgagatcagagtgggttgaacagggattggaagatgaggacatgggaagagtgaacctagacaactgctgaagagtttggccttgatggggagataagaaagagaagtcactaaagagcaatgtgggactcagagactttctttcatttctctttctctatttttttttttttttttttttttagacagaggctcgctctgtcaaccaagctggagtgcatggcacaatctcggctcactgcaacctccaccatcccaggttcaagcgattctccagcctcagcctcctgagtagctgggactatgggtgtgcaccaccacacccagctaattttatacttttagtagagatggggtttcaccaggttggctggactggtctcgaactcctgaccttaggtgatctgcctgcctcggcctcccaaagtattgggatacaggcgtgagccacggtgccaggctgactttctatcatttctttccattcccctgtccctccattcctctgtcctgccttcccttcttccttgtccaagatgggagagagctggacatgtttaaatgttgatagtaagggtcctttagagaaagtgaagattctgtaggagggagtgggaagcagacaaggtcagtttccagaaaaggcaggatagatgggatctagggcatcctcagagagatgggccttgaaaaggacaggtgccttccccaccttaatgggagggtagaaggagaggttgcatgtaggggtaggcaggttagagtttcagctcgaaggcttctgttatccaggaggctagatcttcttttgagagtaaagagtgggagagagatcagagtttctgggagagtggagaggatttgaaatagcggttgtaaaaaggagagaatgagcagacagaaaagtgaggagtacggtttgggattatggatttactttggaattaatctgtgttgttaattttttgccagcagctcctgacttcctgggtgcaggcatgatcaaaggaaatggctggcttcaagatggttagggttctgctaagtagttaggatagatttgagtattaagagttctaagtataagcaaggaccattgattttttggtcacttggcgaggtgttgggaatacaaagatgtgacagtttccattttaaagggacatctgtccagaagagaaacctaaacatatataggtggatatcatgctttaagaaaccatgcatcagggtaatgacgcatgggtcccacattgctctttagtgacctctctttcttatctccccatcaaggccaaactcttcagcagttgtctaggttcactcttcccatgtcctcatcttccattccctgttcaacccactctgatctcactttcacactcaaggactccatcaaattcattcttgttagtgtcaccaatactgccagtgttgacagatgtacctccagttctctcagcaggatttgacacaaataaccaccccttcccttttccttgatttacaggacatcatgctctccttatttttctttatctctccaattcttccttctcagtcacctctgatagtttaccctctacccagctaacactacctatttcatagagttgttatgaggattaaataaggaagttggaacatttggaactggtaagtagtaagtacctcatcatcgtttggattattaatcatttcctttctgtcctcactgttgccatcatcctttcattatacctgatctatggaagtagtgtaatgagtctccctgcctcctcaccctacatatcacggcctaaagatgtattcctcaaactgcttttcatgacaccctcctcataaatcttaaagaatttctcactggctaactctcatgaccctcacggcctctcataaccttgttctaacttagccctttaatagccctactttcatagactactgaatactctccgaataccacataatcattatcactttcaccccatgatcatttaattcttctattttcgaatcctcttctcttcctcaatatagggcttagttcatatcctgcttccttcatgaactctttcctaatttctcaaaactacattgatatcttcctgaaccgaactgttccacacattgaacactcatacaggctctactgtattgatttttaaaatagccagtcacccacttatgaagattcaacttaaccaactaatgacacttatccaactaaacctacttagagcacttcaggttggcagcatggtagctaggtgaaatagcatatatcagtcactgtgtgccagacagtgtgctgagtgattaatgtatgctatttcatttaatacagtaactgtaggacccctgattttgaaactgaaccttagcgaggttgggtcagctgcccaaggtcactagctagtgacccaggcttgtattaatacaatattattacttctacttaagaagtgataataggccaggcatggtggctcatgcctgtaatcccagcactttgggaggccgaggcaggtggatcgtctgaggtcaggagttcgagaccagtcaggccaacatggtgaaaccccgtctgtactaaaaataaaaattagccaagcatggtggcatgtgcctgtagtcccagctgctcgggcggctaaggcaggaggatcgcttgaacccaggaggcagatgttgcagtgagctgagattgcgtcactgcactccagcctgggcgatagagtgagactccatctcaaaaaaaaaaaaaaaaaagtgataatagaaaattttcttctatggctggtattgctcagaaggtaattctaaaaaagagttttaaaatgttctgttcatggccaggtgcagtggctcatgcctataatcccagcactttgggaggccgaggtggatggatcatttgagttcaggagttcaagatcagcctggccaacatagtgaaaccccgtctctactacaaacacaaaaattagctgggtgtggtggcatgtgcctgtagtcccagctacctgggaggctgtggcatgagaatcgcttggattttatattttaaagcagaaattcttccttttctccctcttttctccttttttccatttcttctcccacatgactgaccatttgtttcccaggagttaccactcttttattattcatcacactgtataactccttgtctgtgtaactgcgagaggttctcaaagccccagaattgatggcattcttttatactttttatatcctcagaacttcaggatttttatagtgcctagtaaatagtaggagttaaataactttgaaagaattaagggtcagcaggacttagttccttgcttggggcacgaaggaaaggaaatagataaggatcaaatgatttgggaacttggatttattatttgcatagcatgagtttctttcattattaaaatgatctacaaaagcatatttttccatctgggtacaaactatttagataacaaagattttcttcctttgcaagtgaacctagtaccaataaatgttagctgctaattactttattatcattgtttttattaatgttaacatctgatcatatcaaacaaaatgttaaaaagcttataataaatgttatttttgtaaggtttttgcctcaagttgtttgcaaagtctgaaaatactcagattgtatttttctgtcttctttttgttacagaatacttcagagagtcagagttgtgccagaagtctcttaatggcagatagaatgcaaatagttgtgattctctcagaattttttaataccacatggcaggaggcaaattgtgcaagtaagtaattctttcattttcatgttgcagttatggttcagtagtacagatgtcagattttattttagtgaattttgggatctttgaagctggataatactttttattgctaagtttaaataaactgtcatggacaccatggtttattaatggcaactgagcaaatagcgaaaggcagaaaagtgtagcagttactatgagctttggatttagatagacttgggtttgattctaagctctgccacttactagccctaacctactagctgtcagatatgggagaaaaactttgcctcttggaagttcagtttcttcatctgtaaattggtggtaatgatagaacctatcttatatagtcgccttgagaatgaaatgaaataaattgtgtaaagcacttagctcaatgcctgacacgtatttagtgttcaagaaatgttaactgtttagtataataataattatgatgtttacagtaatctgtcaagtggtgtgtggcaggcggcggggtgggatgatgacatctgttctaccttctttgcaggtttgtgtgtaattgtgtaataaaataagatctatttttagatattctttggaaaaattaaaatcacttccaattcagatgatgttttgaataccaactatgtgctaggcagttcttatttttcaagtcttataatttaatgagtgagaaagatatatttacaaatacagcctaggacagacacataaatgctttaataaagttatagagtccttggaggaagaagaaaataaatcttactggggagaatttgaaatgacttcctggaggagctaccttttgaacctaggcctgtactattggacatgatttcaataagtagagatgacgccagtgaggcggctcacgcctgtaatcccagcactttgggaagccaaggcagaattgcttgagcccaggagtttgagaccagcctggggaacatagtgagacccccatctctacaaaaatatatattttttaaattagatggacatggtggtgtgtgactgtagtcctagccacttgggaggctaaggcaggaggatcccttcagcccaggaattcaaggatgcagtgagatatgattgtgccactgcattccagcctgggcaacagagcaagaccctgtcttaaaaaaaaaaaaaagtagaaatgagagaaggacattgcaggtagtcacagaggtataaaagggcaacagatgttccaggaagcatagtgggaggtaaagttagcaagggaaagtaggaccttgactgacagagtagtatactatttgggccaacattttttatactgcttagaatatcagcatattattaagaaggggttatagaccaggcatggtggctcacacctgtaatcccagcactttgggaggccaaggtgggagaattgtttgagcctaggagttcaagaccagcttaggcaacatggcaaaactttgtctcaacaaaaaataaaaaattaactggacttggtggcatgtgcctgtagtcccagcaacttgggaggctgagatgggaggtcaaggctgcaatgaatcatggttgtgccactgctccccgctctgggcaacagaacgagaccctatctacaacaacaataacaaaaaaaaaaaaaaaaagaaaagaaaagcttatatagtattctcctattatgattatatagtattctattagccatggtttcacttgctgtagtttcagttactgcagtcaactgcagtccaaaaatattaaatggaaaatttcagaagtaaaccatttataatcttaaattgtgtatgattctgagtagcataatgaaatcccatgccatcctgcttcatctacttgggctgcgaatcatccatttgtgcagcatatctatactgtagatgctgcccctcctgtgaggcactcaggagcatcttggttataaggtcaactgtcatggtatggcactacttgtgttcaggtaacccttagtttacttactaattctttaataatagtaacataattattagtttttgtttttaatctcttactgtgcctaatttataaattaaactttatcatgggtatgatatagaaaacagaaaaaaccatagtatatagaaggtttggtactatactagaaaaaaaaacatagaaatagaaaaaaacgtagtatatagaaggtttggtactatacttggtttcaagcatccattgggagtcttggaatatatcccttgaagataagagttgactactgtatgttgtagtatctttgggatttacaatgcacctggaatattaaatgcattgagatttttttaaaagggtttttttttggctcagtggggaggctcacacctgtaatcccagcacttcaggaggacaagatggtagtattgcttgagcccaggagttcaagaccagcctgggcaacattttttgtagagacagagtctctacaaagaaaagaaaagaaaagaaaaaaattagctgggcatggtggcaaatgcctatagtcccagctgcctgggaggctgaggtaagaggagtgcttgagcccaggagttggaggccacattgagctatgactgtgccactgcactccagcctaggcaacagagcaagaccctgtcttaaagaaaaaggttttttaaacatcatttaacctagcactttctaagcctttaaaaaaaaaaaaaaactacaaagatccttttttcatggaacctcattggaagagagagagaccagtaagaagtttactgctatagtttaggcaagaaggaaagaaaatgtgaagtagggaggggccttggaaatagaaggatagattaaaaatttgtgtacctataagtcattaagtagcttagcttttatcaagacttgtctttttgtttagttcatatgaagaaaaactaaaatgggataagaagccccagccagtttttttcccttgtcagtatactatggtatattgaatactgacttttaaaattttgtttccgaagcttgactaacacaacttttttttttagcatatcctttacttttcagagtaaaattttctagtataaatatgattgaagagcatttgcttaacatatgtagacctgtttttaagtattcttaagctttttagaaaaatccattaacatagaaaaatatgttaattataaataatttaaaatcagttaattggaataagtggatatatactgggattcacttctttattttttaattttattttaagactagtcaagtgcagcagtgagaagaggggaaagagtagaacaaggagttcgatctgtaaccaactgtgaacaattaattgagataactcactaccttcagatgagccaggggttcacttcttttgacagatgtgactaaatttatatacttagaagaggcagggcattttttttctttaaaaagtgtttttgtttgtttgatttttgagacagagtcttgctctgttgcccaggctggaatacagtggcacaatctcagctcactgtagcctccacctcttgagggctcaagtgatcctccagcctcagcctcccaagcagctggggctacaggcagcacgaggatgcctggccaatttttgtgtttttaatagagatgctgttttgtcatgttgcccaggctggtctcggattcctagactcaagcaatcctccttccttggcctcccaaagtgctgagattgaaagtgtgagccactgtgcctggcttaaaaggtgttttgtaaaaaagatttcactaattcgaagtacagaccttttttccccagttagttgaaaagaaaacgttttaccgcatactcagtatggcaggtataaaatgctttagaataaattcttagggtattttgttcttctgtgaggcatcctatcttgaaaatattccttacattgaacttctgaggaccaaataaaatgctaagcaattagatatgacttacttaaaagactcttcccaattaaaattaatttggcccagacatatggtctcaggtaaaagaagcgaggtacagagaagtatgatattttgtgttctaaaaatacatatgtattttgagggagggcagttggatagctgtgtgggcaggaaagaaaggaagatttagttttcaccgtatttgcatttgtaccctttggattttatgccatatacatttaatatgtattcaaaaatatatagaaatttaaaaaatttaacagaatgttcaaatctgtgatgagtatttgtatgttagatgtggttagagagattagctatttcattttccagaattacgcattaaaaattatcatcattcatcatcccatttatgtggcagaaaagtggaagagtaaatcccatttgtgaagaaggaaccctcatgacctagtcacttcctaaaggcctcacttcttgatattattgtattggccatcaagtttcaacatatcaattttgggagacacattcagaccataacaggggctattagaatttttgtaaaataatattattaaataacagaaaaaaatgtaaaaacatgaaaggtaaaatattactagaaagaatattattaaaatgagtatactgcccaaaactatctttctgttctgcttaatttagcttgaaataggggtggcatctagtctctgcagttattattcatgaaaggaaggctaggaatccaagagaggagagaatgccatccatgtactactcccatcccttttcttctcagaattcctgtgtcttcaaatggtattagtcttggtaggaatctggttattggaaattgatggaaggtcaaaagaagtgttaagagtgcaactttttctactcatactacaaataacatggaaactagctgtttctgatggagaatgactgccaaaaagtaaagagagtatattaaaggtttctcagaattttaaaggtgtgtattgttgacatagggatagccttgttattgagacccttcttgcttatcttgtgcatacagcagttaaataatcagcagaatgaccagatttgatgagttcatgactgctttagtgttttggttctttggtaagcagtatccagtatgaagcattattataatgagataggcctcaaaattatcagttcagatatttgttcttacacactgaaaactctttctttatgagcaacctatatcttcagtgatacaggtgatctgggtgataattaatgagcataatgatgctgttgaaccactgtgtaatcccgatgtatattctgattcatcagaggaaaactaactttcagttaacacatacaatgtatgtcttgatgctttaaaaagcaacaacaatagtacttaatgattaaccagaaggtcaattaaccaaaacatttttttttttttaagacggagtcttgctctgtcacccaggccggagtgcagtggtgcgatctcagttcactgcaagctccgcctcccaggttcacgccattctcctgcctcagcctcctgagtagctgggactacaggtgcccaccaccacgcccggctaactttttttgtatttttagttgagacggggtttcaccgtggtctcgatctcctgacctcgtgatccacctgcctcggcctcccaaagtgctgggattacaggcgtgagccactgcgcccggcccaaaacctttctttcccatattttatccagagggaaatgtactaagcgttataatcatattatttgtatcttataatttaaagtatcttagttttcatatttgttaaacttaattaggtcatttaggtacaaagttgccgtagtttatttttattttctgaagcttaccctaaattggtgattatctctgctattttctataaaactagttttgaaaaacagcaaagatctttgtaaaattcctaagagatgccaaatgctttatttaaagatgcataattcctgttatgataatttagtaggtttctctgtgaggtcttaacttgaatccttaatacctttaagaatgcctcttgaggccaggcacattggaggctgcaatgagctgagattatgccagtgcactccagcctgggtgacagtgagattcttctgtctcagaaaaaaaaaaaaaaaaaaaaagattgactcttaagctgatgcctgagccttctctgagaaagccactctgctaatctgcccttgatgaggctccattgattatctaagatgaaggaaattcataatgaccacttcacttagtgcttaaaggaagctttattattattaatattctttaactcaccaatttctaaaacatacagcttctcactgtttataatcttaagctcccaattcctgcaaaaagataaaaaaggaatttactagagatctgttatttcgattcagaaagtcatggctttttaataatgaagactttttaaccccattatataaatgaactgctttatgctttatgttaccaccatctaatgatcattgaaaaagttttgatggtaatgcattaatgtaattattaataaaagaaattaagttcttttgttcttcagagaagctttctttataaattgcttttgcaaaagaaattatttgttttaattaggtatcttgcatagaagaaatttgctattgctctctcatgataatgcactttatactacttttgctggcagtatgtggaccccttttatccctatattgttatgtcagttgtcacgacatagctcattataacacagatgtacaactgttgtgaatgaaattgtgttcccttaacttccctgcaacacatcaactacaaaaactatataattgtttttgtaaacatgtacaaaaactatgtaattgtttgtttttatttatatcaactctgcctcatccctaaaaggattgcgggctacttcatgatgatattaaactagcattaagaggggcaatgagacaagttcttactctttcatgcaggttggaatgcagtggcgcaatcacagcttattgcagcctcgacctccccaagctgaagcaattctcccctctcagcctcccaagccgctgggaccacagatgcacgccaccatgcctggctaattttgtattatttgtagagacaggttttcaccatgttgcccaggctggtctcgaactcctggactcaggcaatccacctgcctcccaaaatgctgggattacaggtgtgaaccaccatgctggcctatttttatatcaatggcttattaacttgtggtatgatcatcagcatatcacctatttctgtggcttagtttcctaatttgtagtgatccctcagattttttaaataagggtgagaagttagaatgagattcatgttctggagaagataaagcttcagagaatgtagagtatgtgagttcagagaggggacaactcctgaaataggtttaccaagaggatcctgtgtacaatgggtgcagaaggagccctgcacaagggggctgtacaaggaggtgaatggggctgaattccagcttagcttctggaggcaggaatgaccttttgtaatttatctacccagagggaatatctttttctgatttgcacaaaggagctttactgtgctgtctgcccctgtctaccaggtttaggtttcatctcagttgctaactctgatcagttggtggggactgcctgaatccctgtatggtgtaagatatctatgggtagtggagggagtaggcagtggcatgtatttgtagattccgagtcttgaacttttaatggtttagaatgtagatataaatatgtttattttgcagtgtttgagagtgcaggctcaagaatcagactgagtacagagtctagctttttacttaccagttttatgtccttgggcaacttccttaatttatctaaacctatctctgttccttatttataaaatggagataatgataatttttccctcatggaatcactgcaagaattaaatgggcaaatgtgtttaaagtgcagtgtaagcatagttcttagaacatagcaagtatttagtaagtgttaactttcgttgtagtaattgttgtctgtcagagtacatggatgtcccttagtgtgtcatatcctagtgtctacctagtccgtctctcttttctccacaaattctacttgccttgctgcctttctcctgggtaattgcaatagctttgcatgttgtctttccacttccagttgagagagatcctatctgatggccctgaatttctaaataaggtgggcataatacaaagccatctgttgaaattaaggggaacaagagtagggctgggactagagatgagaaaatatgtggaacatcccttgcagagcaattaggagggcatctacaaggatcattttgttgccccgagatcagaacacatgaatttgaattgagtcccttcattatcattttagaatttctgtagtagtattctgtaaccagactgagagtacagaaagtagatggggactgtccagggatgaaaatggctgtgaatatgtggaagataaagagggcaaggattctaggagagtcagatggaaacgactgaccacaagttccaagatctggaaccaggcagttgaacctcgattggagatagcaggctgagaacacaaggagaggtaaagacaaaggtttacctgaggataaagactaggttccctggctgagcgcagtggctcatgcctttaagtaatcccagcactttggaaggttgaggtgggaacatcacttgcgcccaggagttcaagtctgcaatgagctggcaaattgtgccactgcactccagcctgggcaaccgagcaagaccccgtttcttaaaaaaaaaaagaagaatagattattccctgaagaagggaaaatggatacataaattgtgatatacacatacatagaaaataaaagggatgagtgaacttgagctaactctaagcaagaatagccagttgcagagaaataccatttatgtaggatttttaaaaatgtaaaacaattttgtttctagactttacttgaagcccccacgtcagtattttaggcaaaattctcaccagtttgtttctctgggctcccaactcgtgatggattagaaagagcgaattttaaaagttaccccattaggtacaataaatgactcattagtgaagttggaagatgcagagaactatgaaatttgacacaaaaaatgataaggcatatgagtttcggtaaaattaatgcagggtaaacagtcttatgcctaaatagcactgttaaggcagcatttgatagctgatattccgtgattatgaccttgtgccatcaaaagtccatttgaattttatttggtatatttttatgaaaagagagtatgtgattattttaacatgttcatgaaaatggttatgacttttttaacttttggaaaataaaaggagtaagcttcatatatttggaaaattcatgcttgtttgaataaagaattactgtagtgtgaaacgaagctgatagcttaagatataaatgacaacatagaattgttccttgagttatattaatatactttttgaatttttttgacagattgtttaacaaacaacagtgaagaattatcaaacagcacagtatatttccttaatctatttaatcacaccctgacctgctttgaacataaccttcaggtattttatatataatatttaaaattaaaatgctgccttgtacaaaggaataatgtgcagttccaagtttttagagcactaattattgatatttatctaaattcatgatgtaaaggagttagtggacctggatttctgctcttaagtaagttcttctacttacaaatcatgaaaacctcagttctctcattgtaaaatggagataatatctatcctgcctatcttaaagtattttgtaatgagaatctggtgagataatgattgtgaaaacattgattgaggtgtgtgattgtttaattaaaacacaatggttttcaatctgacttacgtaggtattttgcagtgtagtatgattctgtctataggaagtttattctttgcctgaaatttgcttaagtatgttttacctaccttaaaaagcactgtttagtaagataactttgagtattgaattatgataataaaaggtagctttaagaatcttaaccttgtagattattgccatctctatctctgactcttgaattttggtattggaacttgcccggtcgtggtgaaggacgaggttggaactctggttaaaatgtagttttgaaacttacataacaagtaagtaatccccatagtagatgtacacatgcttagggtataagcatgtatgatttcttctgtaataaatgtggtaacactgaattatgaatttccttgagaataataaaaattgggccaggtgcagtatctcatgcctataatcccagcaccttgggaggccaaggcaggcaggtcacttgaggtcaggagttcgagatcaacctggccaatatggtgaaaccctgtctctactaaaaatacaaaacttagccaggcttggtggtgcacgcctgtagtgaagtagaggttgcagtgagttgagatcgtgccattgcactccagcctgggcgttgcagagagactctgtctcaaaaaaataaaataaaaaaaattaggtgaacatttctcagaatttgttctgcagcatgttaatagatgtcctatcagaaagggtttagtattccattaaggttgggaaatgctttactacaggacttcagagcctttagtggactgatgtgtgttgtaacactcaaatagcaatttttctataaagtcatcccttttatatatggcttcactttccacagtttcagttacctgtggccaactgcagtccaaaaatattaaatggaaaattctggaaataataagttttaaattgtacaccataaacagtcttcttttcatttaacttagagtacttgtatgagtttggtagatttctagaagtagaattactatattggcagcctaagaaaaagacactagagaaaattatctccaaatatgatgagtttattagggaataagaaagaagtatggtaatttggaatgcactggcaaaccaccagtacatccagtgagggaagggtaaagggaagcttttattagcaaaaagggagaggttcacacaagctgcttggaaactgagttcattggttcctgaggctcaaagccaagttgtcagttcattggtggcgatgccattactgggcaagtgttcttttgagtgcatcttatctgaattactgcagtcctaaagaatggcagtgataaaccatgtgaaagcaggagttgcaatgaagggcgtgaaaggatttcttgtggggtttttagaaagtctttggaaacaaggactctttttgtctctattttgtcttggtctgtcaaaaggtgatttcatcctaatgtctgcaactttcacattattaaaagatatgtgcattttaaatttgaataaaaattgtggccaggtatggtggcacctgcctgtaatcccagcactttggaaggttgaggtgggaggatcatttgagcccaggagttagaaattagcctgggcaaaatagcaagaccgtgtctcaaaaaaaaaaaaaaaaaaaaaggttaaattactccccatctagattatgtgcacaattttagttaaatggattatgtgctcaatttttttttttttttttgagacggagtctcgctctgtcacccgggctagagtgcagtggcgcgatctcggctcactgcaagctccgcctcccgggttcacgccattctcctgcctcagcctcccaagtagctgggactacaggtgcccgccaccacgcccggctaagttttgtatttttagtagagatggggtttcaccgtgttagccaggatggtctcgatctcctgaccttgtgatccgcccacctcggcctcccaaagtgctgggtttacaggtgtgaaccatcgcgcccagccctgtgctcaatttttaactaagtgcacaattgttctgtgaaaaacaagcaatgggctatttcttgtagcagactaaggagagacttagtttttctgtcaagcagatggtgagggtaacattgttgggccaacatcagtgtaattactttgatttttctcttttctctttcatcccaatgttcagttaatattctttcttcatactacaaagtaaagaataaagggcatagaaagcaaaggtgtgaactgactgtttagcaaacttattcttgaaaagacaagtgtcagtctagaagtacaaaatattgagatttagtagcataatattttatgtacctccactatcctcattttaggttatacaattctttggtatttggccctttttgttgactagaaaggcctggattatgagccttgtgataagagagttgagtggggatgcagttttggtgccttttccctttccatttaaaaagttctgtctcagtaagataaactatggtgttcaagtcagcataggcaggaacctattttatttattcagtgagagtaggatagataagtgagggtttgtgatgatgagataatttaggaaattttgtatttagttactagtcatttggcatatgaattattgttatcctcagttaacattagctaatgcagcagttttgaaaatttagaggcacctagaaagttccaaacagtttgccatctgcttcacataccgggtctctaatccttcggacttataatacaggtagaggtcgttttattttatagatgataaaactgagactcagagtgatttagtaacctactcaacatcacagcttagcactttaacacaccatattgtttcccgtcttctagaagcgtaaatagcttacattaaagagatattgtatataatgtttattgtatatattacatgtgcctttgtcattttaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcagtaagtactttgcttctgatgtgatacatattttagagtgttattgaatgtaccttcagtatgattattatttttggtgatagggtggaatctgcatattctgtcctcaaccaaaaataactagttataaagtagtaaagttttagaatatcctggtctgttaaaccaaaatggatatttccttagtagtctcatggttaggataaaaataaaacagaaattaattaggtacttcataagtgagttgatgctttggtacattttaatctttttaaatttgaaaatatgtgccatttgcagaggtgtaggtattgttatatgtttatatttcagtttcttgtgcacttgttgctaatttaagaagtttctgagctgggcacggtgactacacctgtaatcccagtactttgggaggctgaggcgggcagatcacgaagtcaggagttcaagaccagcctgaccaacatggtgaaaccccgtctctactaaaaatagaaaaattagccgggtgtagtggcacacgcctgttatcccagctattcaggaggctgaggcaggagaatcgcttgaaaccgggagggagaggttgcagtgagctgagatcgtgccagtgcactccagcctgggcgacagagcgagactccgtctcaaaaaaaaaaaaaaaaaaaaaaagacgtttctggatttcactacatgtttcagaagccattcctcaatcacttcctattccattgttttattttcttatatctattaccatctgaaaatatttatttatttatttttagtctgtcttcctcactaaaatataagccacatgaggacaaggacttaggctttttttgttcactattcagtatttaggacagtatttaggacagtctagcatataatgggcttaataaacatgtattaattgaatggtcaaaaaaaatttttttttctccattttatagcctgcctttacatagggtgccactagatggcaatcatgcctttttaggcactatgatgctggagttttggggcattagaggaaactgagaaattattggctcaaagtagagaacttgaggtcagaattaatgagcttaagaattgagaatgtgtgaattatcacagcagctcagagggaactataagaaccaataatattcgagatggtaaaaagtacttaaaatgaaatgtacagtgtggctttttgtttgtttttactgctccattcctattgcctaaaacagtacctggtttctagtaggctctcaataaataataaatattttgtaaatgaataaaacagggcctaactatattcctcttcatataagttctttgtttgaatgtacaaatggttgacattctagaatactttggtcagtattatggacttagaatatgaaatttctgtatggatataaatttctacaatgactgtattttgaaccaggtttttttcctggcagaagaagttgtcctcaactatcagtaggtttttagaggtatgtattgagtctaaattctagattcctgtttagttattagcaaaataattataagaaattgaagacaagttaaatataaaatagaaagatattgtttgctcttgttccagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcgtaagttttttacaattatttattttatagataaaagcctgtattttaaaaatttaggcctgttttagaaatgatagctactctgagaactcaaagtagattagcctaaaaggactctctgctttaagttttacaatcatgcttactagtgaaagagatctgtgaaaattttataagtgtggacaataaaaagttaaaacagggctaggtgcagtggctcatgcctgtaatcccagcactttgggaggatgaggtgggcggatcacgaggtcaggagatcgagaccatcctggctaacacggtgaaaccccatctctactaaaaatgcaaaaaattagccgggcatgatggcgcatgcctgtagttccagctactcgggaggctgaggcaggagaatcatttgaacttgggaggcggaggttgcagtgaaccgagatcgcaccactgcacgccagcctgggagacagagtgagactgtctcaaaaaaaaaaaaaaaaaaaaaagttaaaacacagtgtctttcagatgattaaattgagaaagctagattacccctggaataaggttggcaacaacagaagaataacaacagaggctttgcactcctaacatggcaatagcagggagatacagacagctcttagacccatcggagtcatggtagaaccacctaagtgtggcaggcaggaagaaactatagctgacataacagacagtttgtttgtgaacaaattggaatcgtagttccaaggagattacttgatataatagtatatgctcaatacatattaattccctttctttctccctatgaaataggccagagcaaaagaagcactaactagagatcccatccagctaaggaagagtggcttctaagtcacgtggctttcttgtttattatcagaatgaaagtacaggcttatgccttaataattttagtttttaaaaaagagaactgtttaggggaaaaggttaattttcttttctctcaaatactatttgtagtctaggaatgtctgatataaaaattcttttccctataaatttcgatcactacttcatctaacttcacttctaatatatctaatttttttaaaaaaaggttacctgtagatcagtttgaactgaatttgtaatgttttgtcaccttaaaatgctagctactagaggggagagtctttgtcatgggtgtatttattaaaggttttttgaaggctgccagcattctgtaaatatgcagtagctcaggtccttaaagcacttacttagaataatagcaaaatattgtgggcacctcaccattgagaaactatttttcagagcttggtatacttttaaagtttagcatcttatttgccttgctaatctatttaactttatggaaagtatttactgcttctgatcaggattttttgtttgctgtcaaagtaaaagtcactaccagtgtcactatttgctatggaagccacaaaccttgtagtcatttcttaattattttctttcttttatttttccattcccacattcccctctcatccccttttaattcattagcaagtatgctgccagttctgcttagtccgtctctctccctccactggtaaaccctagcccaaaccatcttcatctcttatctgtactaacgcaagagccccttaactggtatccctccttccatttcttgatctactaaaatccatacgccacatagtggctagaataattttttaaacacaaattcaccatgtttctctactaacttggaatgcttaatgtgttcccattgtacctagaataaatccaaacttactttccagggtctgctctccaagctgtacatgacctggcccatagccacctttctaaactcgtcacatccattctcctcattgctcatggtgctgtggacagtctggttcctttctgttcttctccactaccaagctcattcacactgccccttttccaaggcccttccctctttacttacctggcttcttgcaagccaggtcttagctctaaagttacttgctcaaagagaccttttatgactccccagtctaagaatacacctctccatttgttcttctgtgccgtctttctttaatggcacttaatcacttaaactaatttaaattaaataattggttatttaaatcatctttttcatttattctctactttatttgtttgtcttccctgcctgaagggaggagctaactgcattagaggtgttgaaattcaccgttagatgatccctgggctagaattttaaaggatgtggggatttatcaggtagggaatataaaggcaaggaagatgtaggtgtatgtactcattcgtatttaacttgtccagtttattaagtcatttgaattttgtcagaagctagatcacttctagtagtttttaacaaagtaattctcaaaaacccaaactattgatttggtttgcctcccaaatctactgaaggcttaagaagtagattttagtttaggccaatgtttttagtttaagttttccctttattttaagctgaagcagtacactcgtccaggaagtcatgttgtgattttccacttacagttgatagaaaccagagacaggccgggcgcggtggctcacgcctgtaatcccagcactttgggaggccgaggcaggtggatcatgaggtcaggagattgagaccatcctggctaacacggtgaaaccccatctctactaaaaatacaaaaaaaaaattagccgggcgtggtggcagacgcctgtagtcccagctactcgggaggctgaggcaggaaaatcgcttgaacccaggaggcagaggttgcagtgagctgagatcgcgccactgcactccagcctgggcgacagagtgagactccgtctcaaaaaaaaaaaagaaaaaaaagaaaccagagacattggtaggccaggcacggtggctcacgcctgtaatcccagcactttgggaggccggggcagacggatcatgaggtcaggagatcaagaccgtcctggctaacacggtgaaatcctgtctctactaaaaataccaaaaaaaaaaaaaaaaaaaaaaaattagctgggcgtggtggtgggcacctgtagtcccagctacttgggaggctgaggcaggagaatggtgtgaacccaggaggcggagcttgcagtgagccaagttcgagccattgcactccagcctgggtgacaaagccgagagtccgtctcaaaaaaaataaataaaataaaataaaaaaagaaaccagaaacactggttctcatccttggctacacatcagaattatctgcagagctttaaaaaagtacaggtactagggtcccattgcagagcttctaaatcataacccctacccaagttttgtgaagctctgaagtagggagactcttagttactcagtataaaatactctcactatgggcatgattgtttttcatttctagaacatgagaaacattcatgtttaactataagtacaaaacatattaccaagccaaatagccatgatttgttttattaaccctaatgactcagtcccattagcatcaaatcagaattgatggtaacgtattttgttagcagccatatgtgtttgtgtgtttatataacataaaactcacttttctttgaggatcattaaaattttttttttacaatacagagttccataataatatacaactcacttttctttgagggtcattaaaatgtttttgttttttttttttcccattacagagttctttcactgatttttttttcatctgaaaatagaagcagttttctttctttctttccaatatgtatagctttccttttctttctcttgccttgttgcgctggtgataaattagtggcatgatgtcaagcaagaccaggtattttcgtcttattccagatcttagggggaaaaatcattcagtctttcacagttaagcataatgattgctatagaatctttgtacatgctctttatcaggttggggaagttttcactgaattcttttaagagaaattcagatttggatttctaacttagacttttagatgtataattttgttattctaccttatagcactttcattgtctaagtacatttatttcacgtacattacatatttaagattgtgatgttcaagaagatataaatgatgttgttttatttgtactgcttctaacaaagtcatgtgcaatttctaacaaagttatgtgtttttaaggttggtagaaaaaagttttaattaggttttaattcttataaggctggaactgttaggattcaaacatagaattaatagataaatactatagattacataaaaatagtaaataatcatgtttgataattaaatttaaattaaaatataattcttttgatttatctagccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggaaataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtctcaaaaaaaaaaaaaaaaaaagaaaaaagaaagtactgtctgtcttaaattttgctgcaaataaaaatgtactttggattatttattgttgaacttgagagatagaaataacatcagatatattttttcttttttttttataattaattttttttttttttttttttgtagagacagtgtctcactatgttgcccaagctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataa

SEQ ID NO: 38313 - DNA, 60119 bp, Homo sapiens
ggggacactgagcgagggtagcggccaggtcaccggctgaggacactgctcctgaagcccggtcaggcggtcgcgccctccctggcggcccccgcggccccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcaggtaacagcggggccccggcggcggaaggggtcgggggtcggcgcaggggcgggcgcgccccgagccgggtgggcggccccggcgcacctgttgtagccgcctgggggtcccctgcccgcagttggccgtggacgttccccgccccgactccgaaacgccgagggcggcctccgcgcctcctgctccgggagccgcgcctcagcgggaggacggagccctgcgggcagccctcgcaccaggggctccctccgagcccgggcatgggccgggcctggggcggtccctcgagcccccctgacgggaagcgtggagcaatgcgagccgccgccgtcgtcgctgtcgtccccagtgagcctggcgcgtctcctgaatcgcgagagccaggagcacggttttgcccggctttgccccgtcatccccgtgtcccatttcaggcagggggcccgggttggatctttctcgctggcttcgttttttgtgtgttgatttgtttcagtccttcgcgtttccggttgagttacggaatctgcccacacgttttgtggccaaactttgtagggctgtgaaacaatgtaacattatcccacacaatagtctttcatactggttttaaaacacagtgattcagggtttgctttaaggaagctttgaggatcacaagagattattatctggtaggttgtaaaaattcaaacaaccaggagagtatcataggttccggaacaccagaaggaggaaagaaaaatggagacgagagaaaaaggataagcaagaaagtgcaggggcattaagggtgtggggggctgcaggattgatttggtattcaggtctggagattatggcccctctattaattccaaccgctgctccagacagtacttgagggaaatggaaggaagagccgttttgggggtcatggaagtgattactaatcttgccagtagaaagatttccactccatggatgacaaggacactaaggagaattactttcctcttagggaatcattgagaggttaattgaacttgagaagcatatattctgtgatggaaactgacatttattatattcttccaaattaggttttccccctctcagactatatggggactttttcagattaattgtcaaaacaagaaggtttatgtgtggatattgacaagcagcgtgatatatacagaacacataattcttaagctgaagtattaaggtaataaattaagggtggaaagtaaacacttcatggaaccttaactccctgttcctgaaatttagagacaggggcttcatttttagacagaaagtataaagatcagcagtactcctgtatccagtggttctcaagttctagtttacatatcattagcaaaatcacaaagcggtcttttcattcaagatacaaatagagtgatcagtatatcataatcaaaagtgacaagatagtgatttaaaaaacacctggcatttattgacaaaagaaaaggtaggattaagtctgctcaaacagtaaaggattagcattagtatttttttaaaaagaagaaacaacagtgcaggtctctatgctaaagtaataaggactgaagaagttttaagtttggaaaaaatggggatatgtattggtgaaacactttgtaatcatatagaatgattattttatcagcagctgttaagttgactttgaggaaattttgaattgaaatactttaggtgacaagtaaaggcaactgtgaaaagcaacatttgattttaggggacagggtacctgtgaaagaagactggttaggagtggaagtcaggcgtaaaggcactgaaatgtccgaggcagggacaatattcagtttctcttcctctatcaccttgtgcaatgtacctgttaaatgtttgttgaatgagtgagaagggctttagagaaattgttttggatatagggatacactttactattggagaaaacacccgagatcagaaagttgctaatgagataggggtgggggatgaatggtaaagacactctacctttttggagttttctaccattgtgttttatttcttttcacgggcatgttcagtatgttattagtggtcaaatgaaaaggaataaagttctatatatatttttttaagtctccaagctcattactagatagaatagttacattattgtttactttgctgatgtttaactaaatgtagcaaactgaagcattatggatcgggaataacaaagtaacaatgaagagacagatgtagtctttttcttatttaaatctcttgactacctcagaattcaaagtagaaataactttagtgggaggttaacattatttaatgcaaataggttgataaaaaatgtagcaaatgaacatgttattaatagttctgtcttctagccttactgtggtaagttgaaggaagttttcatttttgtttttgttggttttagggtttttgttgatttttgttttctttaccagagtgagggtacttttttctctatctgatactttctgaaactcttagggagttctgtcaaaggtggaaaacaatcaatttctatttttggtgttttcctctttgttctccaaacttgtcatggtctacattcaatttgttgcactcaaatggaatgtctatctctccgccctttactcgtccacagtctaaaggacactggccgggcgcggtggctcacgcctgtaatcccagcactttgggaggccaaggcaggcggatcacgaggtcaggagatcgagaccatgctgggtaacacggtgaaatcccgtctctactaaaaatacaaaaaattagccgggcatggtggcgggcgcccgtagtcccagctactcgggaggctgagccaggagaatggcgtgaacccgggaggcggagcttgcagtgagccgagattgggccactgtactccaacctgggtgacagagcaagactccgtctcaaaaaaaataaaataaaagttaaataaataaataaataaatgggactgcaggagcatgctgccccagtttctggaaagtctttcaggattaggctaatgcccactaaatgcacttcgctctcctactgggggtgctacacggtttagcatttagctctgtaggatgctttcctatagaattttatctcatatggatggatcttgtacctctgactggattaaatatgtttggagctaagtgcatgacttacgcttcttctgtgttgcttttagcacatggtggtcttcattgtgtacctgataatttaagtagggtaataatagagaggtcaaacctttagttaggggtcattgcattaatttctagctttgcccttttggaaaaccagaagctattattttgtcattgataacttgggataataaaacctgcaatggttgtctgatagtctagttgtgagaatcaagataaatgtgattatagattatgaatgaaaatatcttgtatgtcgtaatgaacttttttaatataaagggctgttattgacttaggcatagagcagacattgattccacattcacaatgtgttaggtacttcctgggctctggaattgcatgtcataaagggtaaacaggaaatgaccaggtgcttccgaagcagaacagcctgggctgaggcacgaaggccgggagaacaactaagccgtggtttattgtggctgaactggagaatacttcttcatgtgtattagcagaaaatgggaggaagtaagcccagaaaggcaaatgtgggccaaatcagaaggaacctaaggaccatgagtttattttccttaaaggtaataaggaggatttgggtcagtgactggatcagttttgcatttggaaaggatcactggcaacactcaaatgacagattggtagagagcctaaatgagagacaaaaaaattggagatgttgctgaagctcagtgaagaaatgaagagaaccaggagagcgatggtgggaataagaaggaggggccactaaaaaaggtagaattggcagatcttggtgatataggagatgaggaaggagaagccagggatgacagtggggtgatagactggattgttctgttattcattgaactctaaagaagaaaaaaattttttgaggagtttaagaagtggggtagatgtgttcagtttgagatgcctgtcatatacgttgggaggtcccataagtagtagtagttggacatgtgggtctggaacgaaaggaaaaagtctgagatgaagatagaatttggattaagcatttagtgattgaagttaaaatgtgatgattttctccagggatattatgtggaataagagggtaagggatagagccctgaagtatgcacattttaccttgtggggaggggctgattgtggaagaacccgtggagactaaagaccagtggtcagaaaagggagctgaaaatctgggaggattaatggaagagtacctactcctgaggagttcatgcattggcattccccaaaatgattatattttcctctagccaccgtagaacgcacaacacagttcatctattattgttttattaaagttcatgtaaaatgactacccattactttgttaacaacagaaatcttgatatttatgtttaaaaatattttttaaaacatttttaaacaaattttttagatatagagtcttgctatgttgcctaggctggtctggaactcctgggctcctcccgcctcagccttccaaagtgctgggattccaggcatgagccactgtgcctgtggctatttatgggttttttgtctacatttgggacaacaaatcaagtaaaatgtaactttagaagttgattatgattatgcctcaagcaaatacttaaaaaaaaaaagagagagagagatggataaaagttcattttgtgtatgtctcaggtaaagtatgttaacttggggagaccagcagtaacctgttctttaaatctcagcttttattgaatctcacacaaaatttttctcagatgtgtcactagactacttaaataagccagattagtatttttgcatactttattaactctgcttctactcagagtaaattagttttcggaatggaatgcagtcaaaaaatcatcaaaataatatcacaaagcactgagtggtccagtcatttgaacttctgacaatacctttgacttagaaacttatttgtagggagtggtatattaatactatacataaacattgattgagctcgggggggactttctgtatatacattaaaaaatatgtttttttaatagagacggggtctctattaagtgacctctattttttaagtgagacggggtctcactgtgttgcccaggctagtctcaaactcctgggctcaaattatcctccccacttggcctcccaaaaggatgggattacaggcatgagccactgccccaagcctaaaatttttttaagtaccgttagaatgtaaggattctttttaaaaaatttgattgtgcagggttggttattcaaccaatatgcaatacaatattcaatactgtatattcatcacttctcggccttttggctaagatcaactgtagtatctgttgttattaatataatattgtatattcaaccaattgtcaatacaaggctggttgtatctgatatgaaccaacattgagttaaaaatggaccttttttatttttaaaaagctaattaactagatttgcttacttaaaatcaaagcaatcaactcgttacaagtctagaaataaggattttaaaatagattttgaattttgaccttatctttttccagaaagactttaaattgatactggaaaccaaataggatatatttttgggagatttcaggctattaaaacaaaggcaaacaaagaagtgaccttctaaaagtcctagtaatgattaggtccattgtttcaattaaagcataccatgcttgagagataaagtgtattaaatatttgactgtaactttgtgttagaaatatgtttttcaaatctataaaaaagatttacaaatctatctataccatgtttttcagttttatggtatttcttccagacctctcttcctgacatcgccattagtgtcaagtatttcttcaacccccagtgatgcaacgtgagcctatttttaaaaatgtagtctggaagcaatatgtaacatagtcaggaagcagtatggatatatggttaagcatatacactatacactgaactggggttaagcagagatcatactgcctgactttaagcacctgctctaccacagatgatcttctagaagccgtataaattaaacctctgaaggtttacatttcctcatttgaaaaatggaaataataaagtaaaccctcatggggtccttaagagtttaaatgaaataatccatataaagtgcttaagtgctgaacatagcatctggtgtgcaataatcactctataaatgctaattggtaaaattatcatcattgttattgttagtccaactatagtagtagtatggaaccaggcttctcaaaagtgtggcctgcagatcagggccagtgcagacttactggtttgcagtgagatccggagcttgtgccagaatgtaaataggcgatgtcactaaacatactgattactgttcagctgactttttaaaaatagcaagacctcttcagtgtaggaagcagttagttgatttacattctggtgcaagctctttaccttgccacaaaccagcaccagagttgacgtggagtgttggaccagtgatcccgctctccaaaaataatagtcctttattctgaagacgttattattcactcataatacctcattaactttctttttttctaaacatagtaaaaatagagtgtaagtatattgtttatgagttcagcagatatttattgatcacatagtttgtgcacagccctgtatcttattttgcaggagttgcaaagcgggctcagaaattaatcttggctttaggaagtctaccataaacccgcaaaaggaaataagtgaaaatctaaataaatgtgttgaatatatgcagtgagtgtttgcaatagtgttataagttggttccaaagatttcaatatagacggatgtttccttttgctgagctgctaccacaatgggacagaattaattatttttttggaaacggagtcttactctgatgcccaggttggagtgcagtggcgcacttcagctcactgcaacctccgcctcccagattcaagcaattctcccacctcaacctcctgagtagctgagattacaggcatccgccaccatgcccagctaatttttgtatttttagtagagacggggtttcactatgttggccaggcagatcttgaactcctgacctcaagtgatccacccgccttggcctcccaaagttctggggttacaggcatgaatcaccacgcctggccaggacagaattaataccttttactttttcagcattatgctatcacaataaagttcagagtttgctttattaagatagtgtttgaatattctaggagattcagaaacctgcagtactagggaaatctgagttttagatataataacaaaattataaattttaaagatttgtattgtagaagattatccttaagtgttttttaaattactaatttactatttcacccttcatgcaaatatatgaattataaatgattgattgttccatagaatatgaagagacattaaataaatcttaaaatatttataaagttttggttaaaatgagcacaatttcttctcaaaaaaattcactgccagcctgggcaacatagggagacactgtctctacaaaaataaaaaaataaaaattagccaggcatggtggtgtgttcctatagtcccactactcgagagactgaggcaggatgatcaattgagcccagaagttggaggctgcagtgagctatgatcatgccactgcactccagcctgggcgacggagtaagaccctgtctttaaaaaaaaaaaaaaaaaatgcattgctcaaacagataatgttgaaacaaattctggggtaatataaacataataatttttaaaaggcaaggcgtgtatattttacatataaatatgtatattatatagtacagggtttacaaactatgagtcagatcatgagacagatttatttttgcagactaatttactgttgagtgggcttagggaaaaaaggaaaataatgcaaaatgttcaagtcaagaagtgttatttcatttttaatatttcttagaatgttttacatggaagtggatatattggtttctcttattgccatgcttggtgcacctgctcataatcacgtttgttgtgccttttgccataaactgttacctaatctcactaatgactttaagaaaattgaaggtgggtgttagaaagattataggtaatattaaagaatataaggcaggcatggtggtgtgcacctctacttctagctactcggaaagctaaggcaggaggatcacttgagcccaggagttgaatacagcctgggcaacatagactctgtccctatttctaaaatttaaaaaaaaacacacacacaaacacatacaatgtaaaataaagaaaagactgtaacctgaaatttaagaggagaattttaaggaaaaaaagagtaaaaaatgaaatttggatcaagaaatgactaggtaagttagacccatggcactgtaatcacaacttttttaccatagcagatcaggtattttgcgatctggcccctatctcatctttgaactcatcttgtaccaaagtctttctctgcaattaggtaccagccacacttgccttcttttaagtaattgtctgtaaggttgagtctacatatcatagacaaagaatttctatttccacaccccaccctcagcctcacctaaccagacctgcctgttcaaactgtgtccctaccatgttcacattgcagacacatattaggcactcaagtattggttgaacaggtaaatggaaaacccaaaaatggaggcattgaggatgagaaaacttgaagacacagaagacctattagattatgaatgatatcgatggtaaaatacaatcagatgttgcccttagaagcatatgatccctaaaggatagaaaatgactcattcactatttactcagcccgtaattattaattagtcacccactgtatttggatttaggagtggaaattaccagtgaagaaggtgtagctccaataacagtgtaagtaaagagacagaaagacatggggaaaagataatcactagtacaaacggttcaagagtcccctcatacttgatgttgcctcctcagcatgtgcagtttacaagcggtcccacaaagatcagtgatctgctagagcaagcgtgatacatgccattgtctgaatctcagtgcagctttgtacttttcaacatgataactcttctgaattgatcaagaagaaagcagctttaataaatgttgaaaggagttaatttggggtttggatgtatgattcaagggacgaccaggagcctctacaaatattccagtttgtgggtttgtgagtcttaaagaattctaagaatagcaagagtctatcatatatcataaacagaagggaacaaaaaagtcacataaatccagaaacatagtgaattcctgatagaagtgtttaaactctatgcagcagtagtaaactaccttgaacttagctaagagtgaaataatgaaggacgtaactatgcaagatagactgcagtggagacactaagccctgcttcatagagctcacattccagtgaagggcaccaacagaaaacaaagagggaaaatgtatacattatgttaggtggtggtcttaaggagaaaaaatgaagcagttaaagaggttaggaagtggtttttgggagtgtgggagagcggtaaaagtttagatagggtggccagggaagcatttactgaactgccatttggtaacgacctttatgcagcaaggaagctagccatttggatatctgagggaggaacatttcagacatacagaagggtgaacaccaagttccagaggcaggcatctgccatggtgtttgaggaatagcaggggagccgtctggctagggaagactgaagtaggagctgttgcaaatgagggcagagaggcgatgggtccagatcatacagtgattgttggtcctcttaaggattttggtttttcctcagagtgagatgagatgggaagtattggagactattgagcagaggagacatgagctgactttaataggatgactctgactgcaggcttgagacctgactgtaaggggctaagggtagaggaaggccggttaggaggctattgcagtaatccaggtgagaggggtagtggctcagaccaagtgttcacagtagaggttatggggcacttgatattttttgaagacagaactgacatgattgaatatattagttttctattgcttctataagaaattaccataaattgagtggtaatttattgtcttaacagcttcgtagatcagaagtcggttgtcggtctcactggactacaatcaaggtgccagcaggactgtgttcgtttctggaaattctagaagatgatctgtttccttgcctcttctagctcctagaggtcactcacatcattcttcggccgtggccccttcctccaccttcaaagcccacaacattgcatctctccgaccttcttccatagtcatattttcctctgactgtggctaggagggtcctctgattgttaagactcatgtaattagattgggctcaccaggatcgtccaggataatcttccaatctcaaggttattaatttaatcacatctgtagagtcccttttgccatgcaaagtacatattcataggttccagggattcctacatgcacatctttggaggccattctacataccacatcagtcgaaggaccagatgtgggatttaagatagagaaaaatcaagggtaacttcaaatactttgatctgagcaatgggaaggaaggaattaactgaaattggggggaccagatttgtggctttggggtacatgttgggagctcagttgcaggcgtgtaaagtctgagtttcctattaaatatccaagtgggagatgatgcataggtagttgaatacatgacactgaagtttagatcgatggatcctaaggacagatacacccatacatccaagtatggatggcactaaagccatgagatgagatgagaccacttaggccctattaaagagagaaaggggaagagaggtccaggaactaagcattgggaacttccagatatctaccaagtgctaaaattatgtatttgggtatttgatacatgaaaagtaagcagtaatattggcttgaatacagaaaaaaaaaacacacaaaagaggagcactgaatggtgaaacataagttactcaggacaaattaatgcttttgcttcacttaatgccttacaaactttgtctttccatttctgtgaactgtatttctagaattactggaccagagccaaacacataaatgactaagacatagcttcatcttacattgacttctaattctaccttgttaaggttgtctgttaattagatatgtattattttcatggatgcatgtttaagagctgtaatagattgatttcaaatagctgtccttgacaaagtgtgccatctacaatatacatgtatgatagctttgaaagagcaaatgtcaatctttcagatttaaatttcttatagtggaatgtagtttatacttacaacagaacagttatgaaactttattttgaatgacatctaacctaccatattatttgtttctctttctttagactggtactgttaaatttgccaaaggccaagacatagatctttggtacatatttaattacctctaggaaaaaacatttacatggcttacaccagttgcaagatgaataaggagaggtatatgaatgttattggagtcaatgggcccaactcctctagttaggtctcagccactccaccctccaaatttggaatccaaaccatatagcagcaaaaggtccttctgagtagtcgaaatagatgttccagagtctataaatgtcatagttttgcgcctcagactcattggattcaatggtagcatcctttgtggactcaagctttacaaatgtgtctgtcaaacaagcttgtctggcttctaatgcaccggttaggagagcaggttagaaaggcagagaagagcctcacaaggtaagaggccacaccacacagtggcatgggttctgagtccccagggaagagcagggctccaggagagcagtctggtctttggcttctgtagatttcggagacatctgaggacatcattctgttttggcaactgatgtaatggtgaccttgagtcacaatgaaaaagttaaattgtgagtatagtttatttaagaaggcagaagtctggttatctgtttctgcaagtcaaaccaccctgcaacttagtagcttacaaaaacagtgaccatttgttgtctcatgatactttgggttgtatgggctcctgtggatgctgcttctgctcagttggctggggttgcagtcatctggaggctcgactgggctggggcatcttaggcagcttgttcacatggttgaaggtttatgctgctgtggactggaagttcagctttggtctcttcccggtggcttgggcgtgggtacctcatagaatgacagctggttctaaagaggagtgtttcaagcatgggaatatcttggaagtgattcagtatcacttaactgcattattttagtcatagtgacactggtcacagggccagctcagattcaaggggagaggaaatagactctacctctccatttggaacagtggcaaataatctgtggccatctttaattccactataacagagaagtggttaaggctaatgtgtgtggatacattgcacaatgtgtgatgaaggggccaggtaagtctcaggtctttagaaagaagactattcagaaaacttgattatttcctcagggttcaaagtggtcagtgctttataagtaagaatttactgtaattataagattattacactcttagggagtattataaataagagaaacatttctttttggtaaaaataatagctgttctttttttaaggtaaaacagttaagaaatactacctaaggcaatcattggttataatatttaatagcaatttaatttacatgtaggctgagaacccttggaagggattctaatcagaacaaaagaaaaatagaatataaaattaaattttaacttctctgaagagtggaattttctgattcttggataccttcccagaattagcttgtgcgatgatctcaagctaccatgcttcctggagctattctgtgggtctactctcaccttatagaggcagtgaagagttctgaagtgaatccatattacaacatttctattatgcctttgtaattccattttaattttgaaacactggcttttagatgaatttttaagaactttacttgggaagagctatgaagttcttctgcctctctggttacttacctctaaactagcttgttcatctgtgaattttaaaactttctatcctgctcttgctgccatcttcaaaatatcctttatgtgtgtatctagtgcctagtttactcatctaataagcccttagaagacactcagcaaatgttttttgagtgattgactgttgccctggagcctgtcttgaccaatagagagagagcttttcttatcacttactaattaggaactagctgttgagcacactggctccaaccatctaaagcaataattaaggtaaaccaggtgatccgaaaagtgcagtaacttacaaaatatcatgaactgtattttattattctttttaacttgagttttctttttcatttttatctggttaatgtgaaaaggagcttatttccagcaacactaatggaatttttctttttaatcactagtaattggaaggggaaagacccttcacctgacatgtggggactgagttattggtataaatcttgctctttcttgggtgatttctcttcttcatttaaattaaaagttgtccttaatggcctcttggagctgacatgttgggctcaagacccaggaatctcaagaaatatgctagagatttctggtttaattaaacaaaagaccttattaataaaagccagccagctgggcatggtggctcacatttgaaatcccagcactttgggaggccaaggaggacagaccacttgagcccaggagttcgaaactagcctgggcaacaaggcaaaactccgtctctacaaaaaaatacagaaattagctggacatagtggtgtacacctgtagtcccagctactcaggaggctgaggcagggggaaaacagcctgggaggttgaggctgcagtgagccatgatcacgccactgcatccagcctgggtgacagagcgagaccctgtcttttttatatatatataaaataaaagccaaccataactacatatggaaggaaataataaattcattcccctcacttggctttctaaactgacataagcaaaaggaaaatgaaaagttttaaaaatgtttttcattaaagtaaaggatttcttaataatagattttcctgtagcctgtgttagaggaacactcaccaggtcatcacagttctttccttttatagggtccagctcctcttttgacatgggattaggtgaccacgtgattgattagcctcacaatcacaatcctgtccctcctgttgctttccattcacagttgatcaagacgcagagcctgagatagaggtcaggcagagagcacgaggcccagtgcagaatcattttctgaaccagccaggaaataccggaacccaccaaactttaaacaccagcctaaattattcctgttcttttaagcaggcagcagaaatgacagaaacccgttaacagaaaaaaaaaaaataatgcttttcatttgaactcctgtgcattttctttttaacttatatgtgttcctaattttccttactctttttgtttgtttgtttcttagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggtgagtaaccactacaaaaaataatttgctgtatgtgttgattttttaattgttatttaatgacatgtcacagcctagtgttctaataatagtgtctaaaacaaaaaacaaaacattattcagataaaataattaaatcacgtacctaattttattaattttactaatactagctgaaaagttaataatatctatgtagaaattaattgtgtttagggtaccactgaattgtctatagagcagtattaaaattactcaaatgatcctagtattaaatttactcaaatgatccattgtgtatatgatattttaaaagatgtgatgcgtgttatttcctcagcatgggtatggggattaactgctctgtttcagtgcccagtggtctgagaatccagatatgtggatgtgcttgctggtgaagctggctgagctactgaaatcaaaagcacaaggaaattctgattttcctgactataagaaataactgagcaactaaatatgatccaggcctggggccacacactttggggtctaagatgggggaaagaattaggatcattaagagataaacctagggatattaaaatattaaagagttggagcaggcacagtggctcacatctggaatcccagcactttgggagaccaaggtggacagatcatttgagcccaggagttcaagaccagcctgggcaacatggcaaaatgccgtctctacaaagaagtagccgggcatggtgctgcatgcctgtcgtcccagctacttgggaggctgaggtgagagaatcacctgaacctgggaagttgaggctgcagtgagctgtgatgatgcccctgcattccagcctgggcgatgtgagtgagagaccttgtctcagaaaaaaaacaaaaaaaacaaggagtttgtttgagcaaagaatgactcatgaattacgcagcactcagaaccattggaggttagtgagccccattctagcagcaagggcagtgagcttttataggctgaacatgaaagtaagacaaaagacatttaaattggttagagtggaaagttccgagttagggaatagttggcagtttctgattgataaagtctagtatggttttactgtttacattggactttagtttgcttatgtgggaccttctagagctctgtcattgcctcagcctaatggcctctcaattaaagtttgtttgtttgtttaacgggatagtgggccaggtgcagtggttcacacctataatcccatcactttgggaggctgaggcaggaggattgcttgagtccagcagtttgagaccaggctgggcaacatggcaagatcccaactttataaaaaattaaaaaattagctgggcatggtggtgcgtgcctgtggtcccagctacccaagaggctgaggcagaaggatcacttgagcccatgaggtcaaggctgcagtgagccatgttcatgccactgtacttcagcctgggcaacagagcaagaccccgtctcaaaaaaaaaaaaaaaaaaaaaaaaaacaagaaaaggctgggcgctgtggctcatgcctgtaatctcagcactttgggaggccgagacgggcagatcatgaagtcaggagttcgagaccagcctgtccaatatggtgaaaccctgactctactaaaaaatacaaaaattagctgggcatggtgatgcacacctgtagtcccagctccttgggaggctgaggcaggagaatcacttgaacccaggaggtggaggttgcagtgagctgagattgtgtcactgcactccagcctgggtgacagagtaagactccatctcaaaaaaaaaaagaaaacaaaacaaaacaaaaaaaaacaccaagaaaaacaaggtagtgtagagaaggaaaaagtaataattttctctgtccttcataactcttatctgaggctccctgtaacaaaagacaaattaacagaagaaaaacagaagtgtattaatatgtatgcctcatgtatacacgggaaaaccccagagaaatgagcaagtctctagagtagatctcaaagaaagcatttaaattttgggcttaaataccatcattctctgaaacaaagtaaaaaaggttgtggggaacaaccctgttaagatgagatggccaggaaaagcaccttaaatgaaggtgaagtttgttatgaagatgtaagtcgatgtcttctttacttagtcatctcctcctgttgcagagagggagatgcccttataagcagagatttcttgtataggcacaaatttatctttaaaaaggtaacttttcagagctactcctatgtctacactttctcaaaatgtgcaaaggaggcatattttggggtcacatattctggtctccttcagtcatattctggggaggtatgtcctgagccccaacattagatagttaataaatacttattattcagtttgttgttgtatttggacttcaagtttttgttcaagtgagatccatattttactcttaagttttaaagcaagcaaccagtatttttatcatgaaattcatttctagattctcgcgatgtaagaattagaatagaccatatagtgtgaataataagaagtcccatttctcatagagaagttacgaatagatctagtagaatagactatgctctaatagaatagaattagaaactgatggaaccccttcatttttcagatgaataaactgtggcccagaaggatttgataatttgtctatctaatgtcagtagctttctgaattggagttaaaagaatattttctactataaattgttgctttcaagttgtttattatctctagagtttacctattttattatcactattattttttgagacagagaggctcgttctgtcacccaggctggaatgcagtggggcagtcttggcttactatgacctccgtctcccggttcaagcaattcttgtgcctcagcctcttgagtagctgggattacaggcatgcaccatcatgcttggcttatttttgtatttttagtagagtcagggtttcacaattttggccaggctggtctcgaactcctgggctcaagcgatcctcccaccttcacctcccaaagtgctgggattacaaacatgagccactgtacctgccctaaagttaacttactttaaaggtaatttgaaaagaggagggctggacaacagatgttttttatctgatttacagctgccagtatcaaaggtttattatgatttgttctttgttacgctgttattgttataacaaacgatttcagttcattacgagaagctaacgatgagaactgactgagtataattttcctagtttctgtggacaaataacattgaaaaaatgtgtttttattttacaataatttcaaacttacaaaaagttgcaaaaatagtacaaagattttccatatgttgttcacccagattccccaaatgtaagattttaccatataaactttatctttccctccctgccccctccatacattcatacacatttttattctgaaccatttaggggtaggttgaggacatgatgccctttgcctccaaatacttaacagagtatttatttactgaaaaacagtgtgtagccgtaacataattatcaaaatctggaatgtaatgttgatatctaattattatctgatttctagacattcacatttaatcagtttcccattgatagcctttataatcactgaaaaaaattgtttttctggtccaaaatccaatctaaaattgcattgtattttattgtcgttttttaatctgacacaactccccagtctctccctgtcctttatgactttgacatttttgaagagcacaggttatatattctgcagaacctccctcagtttgaacatgtctgatgtttccttagggttaggttccggctctgcatttgtggcaagaagatcacacaagtgctgtgtatccttctcagtgcctcatatcaggaggcacaagatgtcagttttgcccatgctggtgatgttaattctgatcccttggtaaggtggtatctgcctggttctttattgaaaagttaacaatttccctccaatcatttaatagatacatattttgaaagtatgtaaatgtttctcattatacatttgtaaccacccaatgggttcatcttgtttgttgtcaagatagagccaatttatcaagacaagggaattgaaatagagaatgaatttaatacacataaagctggctaaacagcagacaggagttgtactattactccaatcagcctctttgtcaatttggaggctagagtttttcaaggatagtttggtgggcagggggctaaggaatgggtactgctgattggctgaggatgcaatcacagaggtgtggaaaacagtcctcatgtgctgagtccacttctgggtagggacaacagaggagttactggtctatccagttatagggcctccagttgtcagaaatacaaaaacctgaaaagacatctcagaaggccaatcttaggttctataatagtgatgttatttacagggaggttacaaatcttgtgacctctggaataatgactggtaatcatttaactacacctacatcttggcagaattcaggcccctctcatcctcctaacctggtgtcctttcattagttttacaaaggcagtttcattttgctgtcatcatttaaactataaactatctacaaaagttagcttggcccactgcaggaatggctaagggagtttgggggtgaaaggcaagatggagttgtcaggtcagatctccttcaccatcataattttctcactgttacaatttctgcaaaggcagtttcacattcatccactagtgttagcatttttggtgattcttacctttgaattattacattagtagtaaccaaagatgattattctaattctgacatgccttctacacattatttagaatctttctgtaagtctgagctttctctccttcatcatttatttatgtcaatgtggactcataaattcttattttattctatgggttataatgtattactaagcctacttactttgttgttcaaattgcccccaatgtggcttctctgtccttttgacatttccccattattgagcacttctttgctttctggctcagtaagatgttccaggttcatctagtacattccgcatgccggtgtagaaaccattttttttttctccaggagtccttgttccgtttagtggtgaactgtgttttgaaaccaagatctggacactaagtacctattaccattggtttatcattgcaattttttttttgagacagtgtttcattctgtcacccaggctggagtgcagtggcatgatcacggctcactgcaacctcaacatcctgggctcaagtgatcctcccacctcagcctttagagtagctgggactacaagtgtgtgccactacactcaactaatttttgtattttttatagagacggggttttgtcatgttgcccaggttggtctcggactcctgggctcaagcaacctacctgccttggcctcccaaagtgctgggattataggcccacttcacccggcctatcattgcttttaggccatctcagtggacacaacaaggaaataaatgtatgtgagtgcaatatacacacgtctcattctatccatctatttgtggctctgtttctctctgtctttctctatttttatgtatttctattttcttacctctcatattttttatctctctttctatatcttaaaaaccatgagtttgtactgatgcctctgattccagtttagcactacagggtttattctagccttcccagttttcatatccataacttctctatgagaaacagggcttcgtgttattcacactatctttacctgttctcagattgaacaagtaaagatactcaaaagaacaattcatattgtagtttcagaattgctaatccacactgcagtttaaaaaatttttttaatctacttcttgagttttagaatttatcatcttcaagagcaagaattgttatatgttatatgttatattaatacctagcaatggtttctcttgtcatttttaatttctcaattatttcaatgaattaggcttattttctgttaattgggacgacatgtatcttcaaagtgagaaaaatcaaaatggtactcaaataagaaaatggatctatcctaaactaatttagatagtgggagcattggttggtttcttttggaaacaacttggtttttgttgttgttgttttaagagtttgcgagactgttttcttgttcttcagagttttaaacctttcaagaaaaaagtctttcttcagagccaagctttacaaaggtcctaaagatttcacctgtctttggtgcagaaacagaggacaatttcccatatgtttatagaatcttttcttattacattttttgcagacaggttatgaacgatcctaaaagagagagaaaaacatctctagaagtgtatattttgcttatttctccttctctagtttttgtcctgaaatttcccatgaatggatgggtcagtgaggtgaaaaagatatgaaaagatatgaaaaagaattaacttagattctaaaagatgtatgacttagaacatctgtacttctattgactgagtaaacttgttcaccattttctgctggtaggttctacctgtattcactcaaaaccaagatgtatgtgaattgttatccagggatgtgtgatatttgattcagaagggacctcactcctcagtaatggattctgatatattggctcactttgggtgggatagctgccttaggggcatactcaggctaggcattttacaggaatgttgttgaaaccattaagacttgcaaacttaaaaaccatgagcttgtgctgatgaattcaacactgaatgtgttgaattcacctttgggtgaattggtggttctttagattcctttaaacttgtagattctgtttttctggtactgaaattaaagggagtgattgggaccttggcagtagcttcaggattggtggtcctagagacattaagagaagaaagcagaagaggactcaggccctgatggacgtcctgatgatcaaaagtgagggattagaggcctttgggactagtatgtgtctaacagaacagtaatagcattgtgtctcatggaggtcctttttttctcacttcatttattctcatttaactatattaaattatagttaactaactttattatccattagatgaggtgaaacaatcactggcagtagatggaaaggacagaaagttctacaccagtgtagctcatgtggaggtcctcttgccacagtggcagtgatgagaccatacacggatacgtgatgccgctgctgctcccttgattctgatctggatctggttgcagattcttataggagatctccctgcagcccaccctaaagaccccaggccccagctctcccactacccagcagcccaacctctgtgtgctgcccggagttgggaatggagcatctttgcctcactgtctgaatttgtacaagttgtagaactgcagttgctaacttaggttgataaagccttgatttagattagattttgattacccggaggactcctcttacctactctcatagcagcagattggccagagtgttggtgatttcctttcaggtaggcggtaagaggccagggatgcacattctcatgcctcgattgcttaccttgcatgccccagagtcagttccagctgggctttgggacagagcatagggcaggccccactgctctggctttatgcaaatggcacatcagaagtacagaaaactgaatttagaaaatggattgagaaacatgaaaaaagtatttggtgagttcagaataaagagatgtgaagtattgatttctagttagggagcatttccagaccaaatgcgtaaatccaagggttgcacatcaccaaactcccaggataaatcacatgaaaatagctttttttatgtgttagaggagcaattttctgtttcttcaccatattgtgcaacttttgctaagtactcagtcacaaagtgacccagaattcaatgtttctctgaaaaaagttaaagccaaatgattcatagaaaggtacaactatttaagcttttctaattcccatagtgccaacttggcaactagtccatccagaataatgttttttaatactaggggggaatatcttccaaagaggaactatggggtagaaacaaaacctctaacaggcttgtaagtcattggtgagaagacaaagatgcaactgggacaatgaaaaagttgctaagtagtacccagaaaagttaggccaggtgttgtggctcacacctgtaatcccagcactttgggaggccgaggcgggcggatcacctgaggttgggaattggagaccagcctgaccagcatggagaaacctcgtctctactaaaaatacaaaattagccaggtgtgctggtgcgtgcctgtaatcccagctacttgggacgctgaggcaggagaattgcttgaacccgggaggcggaggttgcagtgagccaagatcctgccattgcactccagcctgggcaacaagagtgagactccatctcaaaaaaaaaaaaaaaaagaaaagaagcagaactaggggaagaaaggtcaataccaacaagagatacaatatttactataaatgcagagaaggcaagagttctttgtaaagctgcaatctcagtatcccttgaaatgtgaaatactcaaattatcgacatttgccaaatgataacattttttagccagtaattcaagtttgctaaggaatcaaccctcagtatgttacttagcttgcccagagtgattcagaaggcatgtaaaactggagaactctaacaaataaggcagatggtttcatgtttccctcttttctggctggagataaccttttcagtttgtgtttgcattgcttactgttaactatctccaagtagctgttactggaaggggagctgcatcctatgtggtcagagccacagttgagtacgtgcagtataatttgttgtgacttctgctcaactattaacttgggcacgtaagcaaacattcctacattaagcacgatatggatatgttcagtcttctactggttattgtaactgatatttagatggccttttcccatttctgaattaatgtctttgcctcataggtgaaatagtttgctctaatgtagaggaaggcagaaaaggaaaatgaagactgttggattggtatatttgttgtacttccaggaatgtataatgtttatactattatcaacacactgtaataaactaatcttgcagaatgtgtttcatgagcaaagagaaataaattaaatgcagtttttaaaaaaggcccaaatcagaagcttgagaacatggctcatgatcattggaatcttgtcgaattttagagttcgaaagcagctgtcctggaccttatatgaataaccaggctgaacgtgtccaaatgttttaataaaactggatagtattatttcagcaacgattctagctatgtaaagcagtgcccactgtcatcatagtactgtccccctgatgttgccattaggctagaaagagtagtttatttatttatttttattttttatttttttgagacagagtctcgctctgttgcccaggctggagtgcagtggtgtgatctcagctcactgcaacctgcgcctcccgggttcaagtgattttcctgcctcagcctcccgagtagctgggattacaggcacccaccaccacgcctggctaatttttgtatttttaatagagatggggtttcgtcacgttggccaggttagcctcaaactcctgacctctcaaataatccacccgccttggcctcccaaagtgctgagattacagatgtgagccaccgcacccagcctagaaagagtaatttaaaatgctgattgcctgagaatttcatggcttcagttgccacctttctataaagatgcttagaagcaactgtgatgtagtggcaattatactcgccaagaaactagaagatatggattggttctggtcatgctgtttactggcagtatgaccttggacaagtcacgcctctaagtttctttcctcatgcatcaaatgagggtgttggccttcatgtcttccagagatttctttcagtactgaaattctgcaactaccatgcctatctctagctctgacctctcccttagcctcctgccttgcttttccgttgatcccaggatggttatgcctggatgttcttctgataacattgaccatcttcctgactatcctgaaggtcatcttcctaccctcctaactcctgattccccccaaaagaactttatgctgctctttagcttcattcatttattttattttactttccaatttcctgttcttgtcaattatataattagtattttaagttagaaatcatagaatatttgtcttcttcctatgcataattagtctgttagtgggcactgcttattcttcctttgcagtaattttcccgtggttttattacctctctcccatgcttagcactaagcccaagcctttctctctcttcttttcaattattatgatgtccttatccatctttccactcaactcttatccctaccatatgtcagatcctctgttcggtattgggaacaaatgcaaaccacacgtgtagcttaaggatcttcccacatagtggagagacagagaatcatattcaaacaagggttttggctgggcacaggggctcacatctgtaatcccaacactttgggaagctgaggcaaaaggatcacttgagcccaggcaattgagaccagcctgggcaacagagcgagaccctgtctctactaaagaaattttttttttttttttgagacagagtctcactctgtcgcccaggctggagtacagtggtgccagctcagctcactgcaacctctgcctgccaggtttaagcgattctcctgcctcagcctcctgagtagctgggactataggcgtacgccaccacacccagctaatttttgtattttcagtagagacagggtttccccatgttgaccaggctggttttgaactcctgacctcaggtgatccacctgccttggcctcccaaattgctaggattacaggcatgagccaccatgcctggcctaaagaaaattttttaaaaacaagtagttttaatatagcttttcacatgaatgatgtttgaggtcttggctagggaccctagatagtggaccctgacatgaaggcaatccatttaaaagtaagaatttggcaagaataaaaaattacttgctaaggaataaaggaggcaaaattttatgtaaattcttaaacgatgtagaatcttaaactatgtagaatcacagaattttaaattatttctagacagtataagaaattattcattcaatgaataattactgagtactaggataatttggtgaccaacacggataggtctctgcttttagagctcatttgaggggccgttaggtagtggggaactaggaacaaacagcaacctcaggaaggtgatggctgccacggtgggaagcacaccgtggatctagatacctaggggatcacagcaagccttgtggagaaaacgacaccagagttcaaacttgaaggataattctcattcattcagtctattcattttacaggtaagaattaactaaagcttagaaaatttgtggtttacatggaacaaattaatggcaagccaatcccttaggtggcttgttattcctggatcttgccttgattccacgtttcctgagcgcagtatcttaaaatttcatctttcatagaacaaagtaagcgttgagtaaataattactgataacttgcaacctgttgacaaggctgacacctatctgaaagtgcaggaagtgcatttgcctttcagtccttaggaatttacagtctacagcagtcattcattttggagttacttgtatttctggtgagttatgtttatttttcaaattacagtgagaattcagatctaagaatttcataatgaatctcataaatagcagacctcaagataattagaaattttacaacgtttaaattccttagatcaattaaaaacactcttggaataatttatttttaaaatgcatgtaacaatgcataatttactgacaatgccttaagattgtagcatacaaatgaattcagtacattctactataataattcttgtacaaatgaatgtgataaacatcagttggtccataatatattttagaaaaaaaaggatttttaaaataaaatggctctagagtagctttgcttagaactgactccaaatccagatgggttggttgattatctcactgggtttatttagatgggtttatttatttaattatatttagattgtaaattaccaggatattttagcttttattatcagagaaatgttaagtaggcttatctggatatttgttatcatcatttggatttaaatataaatgctttaattttgagtcactagtttttatctaaatgctatctataatttacattgcttaaaacacaatagctgataacagaagccatatttttgatgggccttctaatcaaaaagaaaataatctctaaatacattagtcttttcagaaacacagttgaggttgaaagtattttttttttcatttttgtccttgatttttttttttttttttttgagacggagtcttgctctgtcgcccaggctggcgtgcagtggcacaatctctgctcactgcaagctccgcctcccgggttcacgccattctcctgcctcagcctcccaagtagctgagactacaggcgcccgccaccacgcctagctaattttttgtattttaagtagagacggggtttcaccatgttagccaggatggtctcgatctcctgacttcgtgatccgcccacctcggcctcccaaagtgctgggattacaggcgtgagccaccacacccggcctgtccttgatttttatctgcctttttttgtctggcagtcaaactttcacagtccctgttaactcctgtttcttcttaactttatttcctagcagtaactctgtgcataatccatattgttcagagtttcactaagtaagatgtaatacagcccactgctgatttactgatgaaagaaaatcacttataagatgaaccctgctgtaagacagagatgtctcttgttttgttttcagcagaagctgatcctgtctcattttttcctgctacaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggttggtttgtggggttcagtccgctccctgctgatgattcttggcttaggttctacaattctgaaggagcattattctggcattctacctgttaagcatctatgctgtgcagtagcaactggtctctgtcatcagccagccagcaacagttgctttcccacactggcatcatctgggattccttgtctaaatgtatcccatgactcccattatcccctggaaaaagttaacaacttgcttggcccctcagaaccttcaagcgtgtgcttctggagctatgcctcatgcagggtccacatcattgcctgtgtgcaagccacatggacacctggagcacactgtgtgccctgtgctttccacaccctgtgcctgtacacctgcccctccctgtgctcagcatgtccgggcccggctagttcctcctagtcactcagtatgcagtgtagcagccacctactccaggaaggcttccctgcccctccagtaatacacattagaaaaccctctgtggggcttctggaaaacttggtgtcagcctgcatcatagcagcttcgacagtgtttctcaaactgtgctttgcagagtcttctatgttccaaggagacttctctgtggctaccgcaagttgtggtatctcttctgtgcttagcttcattatgagatttcctttgaagaaggatttccaagagcttgaaagaagaaaaaaaaggaaaaagaaactggaaaaatcactgctctgggctagtgcttctcaagcacctttatattacagccatcatagaaagtgatagtatccatacagtaccgcaaggaaatggtcacagctgcctggagccagagttgaccatcccacgggcttcagctgccccgggcactgcccgaccactccaagagccaagtagctaagtatctcggggtcagtatttctgcacctctctaacccatttgtgtggcatacagtgtgccacgcacagcattggggaagctctgcttttctgtaacagggcagggatggtttttcacgtgctcatatccctagtgtctcatgtgctcatccccaggaggatgttcggtaaactggatagtggaagggattttgccctgtcccagctagcactgcactctggtgcggttcttatctccattcagaaaacccatggggctgggcacagtggctaatgcccataatcccagcactttgggagggcgaggcaggaggattgcttgagctctggagtttgagaccagactaggcaacacagtgagatctcatctctacaaaaaatacaaaaattagtgagcgtgatggtgcatgcctatagtcccagctactcaggaggctgaagcggaaagatcacttgagtccaggaaatcgaggctgcagtgagctgtgatcgcgccactgcactcctgcctgggtgacagagtgagaccctgtcccagaaaaaaagaaagcccatggggctcattcggtttgtactaagctactttccctcaaacgtttatcttcaaaagtagaagacagtcttcaggctagtgtcaaatcataggggaaagtctttagaccatcagcactctgacttgaacttcttgaagatatattaccttctgttattataacaattatgtccctgagtcattaaattactatgtatttataaattgctgattgtgtaaattgtacgtgagtggtacaaaagaaacataaaaacctctctggttcttaggagctcacaaactagttaaagagctggacaggacaagacataggaccctgaaagggtgaaggatccctaagcagatttgtggttggttggttggtttgacattttaaagtagccctttgaattatgtttttaattaaatgatggctctgactaggttctgaagttaatattatatctttaataccatctagactttgaaaaccctttaaaaggattctttaatgtagtcatttttaaaatgagatattataagagctttgtcatgatatggaatcagatatttctttttctttcttttttttttttttttttttttttttttttttttttttgagacagagtcccactctgtctcccaggctggagtgaagtggcacgatctcagctcacttcaacctccatcttccgggttcaagcgattatcgtgcctcagcctcctaagtagctgggactacaggcatgcaccatcacacttggctaactttttgtatttttagtagagacggggtttcgccatgttgcctgggctggtctcaaactccttagctgaggcagtttgctggcctcggcctttgaaagtgctggtattacaggcgtgagctaccgcacccagcctaagatacttcttaatatggaaagccacaaagacaaataatggtggggaaatctaataatactgttagacacgcctcaccttttaaacatctatcacatgttaggcttaggattgttttatggtaaaaacccaagcattcaattctgacacccaaaggaaatactatatattaaagtatgtattagtttcaatctgtgtatggcattcctttcttaacagggacagttgcttcaggtgtggtgggctgaggtacaaaggcacccatggagacaggtggagagtagcttcctgctttgacaggttttgcaggttgtttctttctgcccttgctgggctgccttattcttcattgctttcatatcttcacttcacagttactcttgcttctgaacattgtactttcttttccactgtgacatgcccccagaaccagcgcagagtcagaagatactctgatgcattgtggtaaacagtgtttgagtcacaggaaagaggccagagctattgaaaagacccctatgataaaataaagcaacacctgttttcttcctggtattccatgctctggagaggaggcaacatggctgtcaaagggtgtctccaccacttactcacttgtaaccttatagaagtcacctaacctctttgacctttaagttgcctcatctgaaaaatgtggacgattaatatacttgctctgagggttgttgtgaggactattaaatttatgtaactgatgcatggtgtatgtatgtggtagctatgtttataattatatttttataattatgattagaacaagattgattttcctgaagaggtatgctagccataattttgaataagctcagattgaatagctatttaaatcagaggatttaacattgatcattgattggccgggcacggtggctcacgcctgtaatcccagcactttgggaagccaaggcgggcagatcccaaggtcaggagatcgggaccatcctggctaacatggtgaaaccccgtctctactaaaaatacaaaaaaaattagctgggagtggtggcaggtgcctatagtcccagctgctcaggaggctgaggcaggagaatggcgtgaacccaggaggcagagcttgcagtgagccgagatcatgccactgcactccagactgggcaacagagtgagactccatctcaaaaaaaaaaaaaaattgatcattgattatagaaggcagtagtctatatttgatactgtctttttcatttttttggtagccccttagtatctatcaaacacatcataggcaattagtaaactgtctttaagcctactactattttttggatgctatatgtaacaactttgttcttctttaagcttttctctggccttttttgaaacagtgaatacctgaatattatatacctaaaatagtctttaggaactacatatcaagatatctcatagaagtgactcatagtgtcaaatggtggtcttttctgtttttagaactggaaaattctcaaattttcattaaggttaaactcaattatataattttataaaatataaatattaataaaactttattttattatagtcttagcttttagaaatttagccttaatttaaagatataaactgcatttcctgaaaccttggtagtgtatctattttttttacgtacttattagttaacagcactttttaaagtatcatacacacaatatctcattaccataaagttcagaaacatatctttgtgttatatagaaaaaaagtagtttttttttttgctttgttttgagttggagccttgctcacattgcacagactgggatgcagttgtgggatcatagctcactgtaatgtgggactcctcctgggctggagtgatctcccacctcagcctcccaagtaggtgggactgcagaaaaatgtgggtttgtatagtaagttttaggattgagccttcacaattcccttatataatcatctgtaaggctaggccttgctggatgagtctgctggagtttttaataagttagcatcttctcttttttttaattaagcctagatgtatttacataacacataaacctcctcaatcttatggggcagcattacttcctataagatcagtgcttaggtgagttttgctgaaaaggaaacagagataacattagaaattaaatctctaattagcctcagcaaaaaaaaaaaaattgaaaactagatttcaatgcatctgttggcatcttgcacaaagtataatactatagtattcaagatgctttattttctaagtttgaggaaaggaatcatcaatttatcactgctcatttgaaagacacaggatgagaacctgtatgaaaagaaaggcagagggcatacactttgatctcataaagatccagagaggaagaacatggacttttatcaccaaaactacaaggccaaggaagcaatcgttataatttgacagtgacaacagatagaacaactatctgggtttaaatcttgactctctacctggctttgtgaccttgggcagggtactgaatttttctgaccttcagttttctcatttataaatgagtcatagtaatgggatagcaatatctactttgaagatttattctgaagattaaatgagaaacatatacaccagcttagtgactggctcacactaggtgcttaatagatgtttgtttacttcctttttttttttttccttgaaagaggttaattgaggactgtgtcaagatccccaagactacccccgggttcagtgatttgctagaaaggttcatgggattcagcatattatttacatataactaaggtttattgcattgaaaagatacaaagcaacatcagcaaagggaaatagtggatgggacgaagtttacaggaacccaggcgcaagctcacgagctctcgcccagtgaagtcacaaaccgtgcacttcattcacagctcgtgaaatggtgccctaccagggaaactcaggctcagtgcccagggtttttattgagggctggccgtagaggcaccctctgcctagtatgtttcaaaattccagactcccagaaggaaagcacatgtgcagcgtaaaacatattgcctgtacaaatggttcaggcacagcaaactactcttttctgggggagtctcgctctgtcgcccaggctggagtgccctggcgcaatctcggctcactgcaagctccgcctctccagttcacgccattctcctgcctcagcctcccgggtagctggtactacaggcgcccgccactactcccggctaattttttgtatttttagtagagacggggtttcaccgcgttagccaggatggtctcgatatcctgaccttgtgatccgcctgcctcggcctcccaaagtgctgggattacaggcggggcaaactactctttatcagttctgggaatggtgaggaccctccccaaatctaagttcccaaatgctagccaagggctaaccttgcaggcaggcctgtcgaaggatagcaatctcagaattgccatgtacaagaataaataaaagtaaataccttaaatgggtaaaaaacatatgggattggggccgggcgcggtggctcacgcctgtaatcccagcactttgggaggccaaggtggctggatcacaaggtcaggagatcgagaccatcctggctaacacggtgaaatcttgtctctactaaaaatacaaaaaattagccaggcgtggtggcgggcgcctgtagtcccagctactctggaggctgaggcagaatggcgtgaacccgggaggcggagcttgcagtgagccgagattgcgccactgcactccagcctgggcgacagagcgagactctatctcaaaaaaaaaaaaaaaaaaaaatgggattggtttcttcaagcagtaatacaggtaaatatgtaaatagtgtcagaaagttattttcattaagcttagtgactaataggtggttattttaattttaaaaaatcatcccaagaagtatgggaaaagcccattaaaatcactaatgacctctccccactccaggaattctagccagttttcatgctgcccttaaataggtggttactttttagatccttctgtttgcttattatttggatgacatcttaatgatatcatctctcacagtgaatcaccaataatagtgtctgtcctaacagtgggctagcaggaccatgagcctgagccaggatggttattcttgtatcctttccttgaaaagtgtataattttactcaaaattctttcattgatgaattcgagaggaaaaattgaccagggtgttttatgatactactttttatgtataaagctcagaacaaaagttagatgcaggcttttattaatatttgtaataaacatttaggcagaggtctttaacttagggttcagaatggtctttgtagggggcagtccatgaacatatacaaactgggtataaatcttgtttatctgtgtttttttgtgctataattctgtagattgtatcaacttaaaggaattttggccccagtaaaaatttagagttactgatttagagaaatgaatataggaaaggcatttttcttgttaggaagttttttgcatgagttagcataagaatattctaactttaatgtttcttctttataggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagtaagtaagtgatactctaaccttacagtaataaggtatttcatttgggaagcttttaataactaacatacaggtttcagtttgctaattaactgtttaaatatttggtttcatcacacctcattaaataaaacctgtgctgaaaggagaacaggaagtgtttctaaaatcacatgcagttctgaaaacaaaatatgggtgaggagtctctagacatgatctccagagccaacttccctccagcaggctcaggccagagagtggctgccccaaaggcacagctggctctatttatgcttgctgtgaattgtctcttggtacagtaggtgcatgccgactcccctgacattctccactgcctccctgtgagcaggtgtgtttgttggagatcaggactattacctaagcactcaccatagagttaagtaacacaacatttcccacaagcagtcctgtgatagtcagtggagtatgggcagaaaatatagcccacccgaaaaggtcatctccctggactggggctccattcttaaaagattaaaaaaaaaaaaaaaaaacaaacaaacaaacaaaaaaaaaaacctttaactcagatttctttaaaacatctctttaaaagaatgactggaaatgtgcaatcaagcatcatttccattctgttactgcttttagacagccaaggtaccatttggggttgcattttttttttaaattgcagctacactggccctatttctttccccactactctgttggctgaatctaaaagcctccaggatctccagaattagacctctcttcatggagactaattgcctggccttttttccctgtcttctcccacagagaggagaagcatgagtttttagaccatgacccatatatgtagtggttctactcattaaacagaaaccaaaaaggaaattatttgatgtaggctgagccacagctgaacagataagtggctcagctgtctgtcagagccttttcttgaacatccacatatttcagaaacactttcagaagtatttattctattttatactcaaagcataaaggatgacagctccttctggctttgggaactttagttttcttaaatgtatctgtttctagaacctcaatatgactgcatatttatcattttttgtatgtatatgatatacattctcttgaatagcaaatctgcctattacagtgatttattctgttatcatctcatcctgcatgattcaagatattcaagaaagtcctgaggaaaataataaaatgattacggagacataggatttatgaaaacagttggaggttctcagtgtaaacagatgaagcctaaggaagggaagaatggcaaatctaatatatttgagagtcagaattgccaggtgaaaaacaggacgtaggccgggcactgtggctcacacctgtaatgacagcactttgggaggctgaggcgggaggatcacgtgaggccaggaggttgagaccagccttgacaacatagcaggaccctatctcaacaaaaaaattaaaaaattagccaggcatggtggctcaggcctgtagtcccacctactcaggaagctgaggtgggaggattgcttgaactaaggagtttgaggctgcagtgagctatgattgcaccactgcactccagcctgggtgacagagcaagaccctgtctctagaaaaaaaaaaaaaatgaaaaattaaaaaaaaaaaaccaggatatacatttctgcaagaaaaaaatgcaattaagactgataggatgggtgtaatccttcaagtcagggtaagcaaaaattcctaaatggatttggaaatggattttggatcttggaaaataaagctcataacagaactgaggtgcagatggtcttagagtacatgattcttataagtttaatataaactataattaattgtagagtgacttttgaactgtcaactttagaacatgcatcattatccaggctggtagtagaaactgtaaatgccacaggacttggagaggtatgtaatttcccctgaaggcaggctggaaaggcattcctattaagaaaccatcagtcttgcagtcttaaagtgagagtgccatgaaagctaccagaggattttgtaattctgagcctctgtgacccaggcggagcactggaccctctaaaggtgagctcctcattgttcaggggctcaacagccgacctgccctgtgggtggggcagcaagccagccactgacattgggctggcttcagcagactttacctgggcaccaggtttctttctcctgcttcagccttggattccacaggtgttatctggttttccttaccccatctactgcctaacaagcagaacaccattcagtatactgatggacttttcttttttactatttttgtcaggatccctcattaagattctcatctcttatggattgggatttgtgtcttggaaagatttgtcttgcaccgaaatcagtgctaacagctattgatcatttccccccatgctatttgatgctttcttgatttctatataaagctttaaaacctaccgtagcacttaaatatcatgtgaaaacaaactcaaccagtctaatacaaatgtattaattgtcatttaaaatttgtatttatttacttagagacaggacctcactatgttgcctaggctggagtgcagtggtgtgatcttggctcagtgtgacctcgaactcctgggctcaagccatctacctcttcagccttcaaagtagctgggattacaggtgtgcaccagtatgcccagctagtttttgttttttgttttttttttggtagagacggggtctaactatgttgcccaggctggtcttgaactcctggcctcaagcagttctcctgtcttggcctcccaaagtgctgggattataggcatgagccactgcacccagccctgccattttttatattaagaagtatgttttaaattacagaaatattctcaaacattttggtgaaacggcagtgcatttgccttaggtgtgtcacattttctccagccacttgcctagcaccacacctgctgtgaattaatctctgtgattcacaggctgccctgtgtcttggcacttaattgagacttagagccctgaatgtttagcgtgttgtttcctatcacctagctgtcttttaaccggaagacaaaatatgaaataagcagaaaacatacattgagatttacgataatatgtagccagattactgtacagtaataaactatcacaaaggtgtttttaggttggaggttttcctgggaaatgttttatgcagttgtggatcttctttcatttttggtgagctagatgtctgctagatatcgtccttcagtgggtgttgctgttttccgtaactgtgcaggtagttataggaaagttatgcgtatgtaaataaaccacatacattgaataagaatcaaggaaatgaataaacaaaatgtctgaagtaccagatgcacattttttaaagcttttctgccccaaattctgcagattatggccttaaagccctgtatcagctgtgcttgaggagcctaaactatttatctatttctgttttgctctgctttttcccttctgaagattttaaaaattcttttttattgccatttggaacaaaattcaacattagaaccaacttacaagacagccaaaatagctcagtgagagagcattagaccgaagaattcacctatgactaaaaagttttagcagctagaaccaaataaagaattagtggccataattatttttcccacatcttctaggagaataaaagtaaatatttcagtgcaataaaaagtttatcttgggccaggtgcggtggcttacgcctgtaatcccagcactttgggaggccaaggcaggcagatcatgaggtcaggagatcgagaccatcctggctaacacggtgaagccccgtctctactaaaaatacaaaaaaaattagccggccatggtggtgggcacctgtagtcccagctactcgggaggctgaggcaggagaatggcatgaacctgagaggcagagcttgcagtgagctgagatcgggccactgcactccagcctgggcaacagagcgagactccatctcaaaaaaaaaaaaaaaaaacagtttatcttgataggaaattgctcatgaatgggctgctggaatcaaatacccctttccaaatccaggttagctgttaagttgcaccagtgagaagcttgcttgatggactcatctgggaggaatgaatgcgtgtcctcctaaggccaagcagcagccaggttcaggggatgcagctcagctcaagtactcattcttttccttttaatttcttttttttttttttttgagacggagtctcactctgttgccaggctggagtgcagtggcacgatctcggctcgctgcaacctctgtctcccgggttcaagtgattctcctgcctcagccttgtgagtagctgggactacagacgcatgccatcatgcccagctaatttttgtatttttagtagacagggtttcaccatgttggccaggatggtcccaatctcttgacttcatgatccgcccgcctcagcctcccaaagtgctgggattacaggcgtgagccaccactcctggccttccttttaatttctaaacaatccttccttaatatgtggagtaaaatgaagtaatcagaattataagaatggagaaaacgttttgttctcattattccaattggcaagttttcactcattaggatcaacagccatgctgtttgcttggtaaaaaatctgccccaagtaattcaattatatgtggaaaaaggaagtgcaagcaagggaccgtacctgtgtaccagctgatgtgggaccccctggagcggcctctgcccagcttcctgggagccacttagcagaccaggaaacgagcacagctcacctagttctcagtgacctgtgataccttgctatttttctagatggatctgtcttcctacaaaacccttgagttaattcaatcccattctacaaatggtatggaaaggaaagagacataagctagagacctagagaatggaattgagctgtaaaaactatggcagttgtgggaagtcatcttttttacttagatttttagtgaaatctaacaaaattaaatgggaaaacaatataaattatatttaacttccccaaagacgttttctcatttaggtgcatctttacttatttaaagatacatgtaggcagcaacacagggatttctttccctgtatctgttacgtagtattgcctaaaattttttgtaattcagacatttttttaatagtgatgttgtttgcattgtattttattttcatgggtttttttttctttaggatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtaattattattgagtaggctaaacagactgctgatcgttgtcaagcactagtttctcagtttcctaccattttactgatcaggaagtgaggatgaactatgtgacctggggattcgttgaatttggtcatgagtgcaaagaagaattattgcagccagtaacaaaagtcttgattccattagcatgttggaggtttggaaatgaattaaattgattgagctgccaaaggagaaagttttgagggaagactcaactactagagcataaaggtgatagtcatctttaatagtattttttctttagctaaggtactagcaaagcaaattgtttgactcttaaactgatctcttcttatgaacaatttactggatttttttgatagcccctttatcagagtaattagtatcttaccccagagaacttactagaaacttgtttcaagtatactgactttaattttagcaaattttggcttataattgacgataaaattttcatcctaatcattacaaaatattctttattacttttaaattaaaaattagaaaaaatgaaaacaaggtatctcaaactctgaaagacactgagacttcagaaaatcctaacatttgagatctcaaacgaaactaacaaatattgactaatttaccattactaggtgccgagatgttttatccctccaggagactatgagcctcctaaatatccctgacttattatgacagagcaattccaacagtcatgaaggttccctggaaatcacttagagttgatcttgattgaattagtccagccttcagagaaaccagggctgtcacttgcccccgtgaaccacctgtaaggaaaatcattgttagtgccatacgcagtttctgtattagctgttatgattggaactctcagtatgtgttgtaaaggtgagaccaccaagatcctggttgatttgaacaaaactataaagaaacatggcactatcaggtgagaaccctttctctgtgtgacatatgagcatatgttatcattcaccagtacagtgctttgagaagtgacagtgctagtatttcagcagatgacacaaaggtctcatagttattgaagccacaatgaaagcagacaacctttaaatccatttatcaaagcacttgcagtttccatctcaaggcaagtgaaacaataataaatatcgtgcaaagaaaatgagtctgtggcagtgcatttcatggagtaaagtactgcgcagcatattctcttcaggatcagtgagcctactgaatcatgacttatctgacgctaatgatgctgtctttccatttaaaggtgtacaacccgagaataagagcaaactcgctcgtcatgcagcccatcagccagagccaggcagagatacgcaagcagattcttggctcatcttcttcaggtagtgctgtggacacaaatactaaatgttgtcaattcttgtatgcaggcaacccagaaatattaaagccatttttcttggtgtcttttaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccaggtagccttatgctcccatgtcagccaggcattaggctgagattcaccttctcctgcccattctctgtcctgagttcacatgatgcgcagcaatgcacacaagcatggagggggcgttggtttggactgaagcattttcctgctagaggtaaacattctctgaaggtaatttttaaaaccccacaaacctctaggaaataactgttctgacacgagaaatgtgtctgctgttggacactgcagcacaggggaactgggcttaaggagctgggtaatgtggagtatggaagcgtaagggtgaatcagcagaaagaagaattctcagcagcttgaattgtccttttttcttttctttttttttttttttttttttgagacagggtcttgctctgttgctcaaactggagtacagtggcgtgatcatagctcactgcaacctccacctcacaggctcaagtgatcctcccaccacagcttcccaaatagctgggaccacaggtgcaagccaccacacttattaatgtagatttcctttgtagatgtagatttcttttacaaagtgacagcttttcagagctagtcctatgtctgcagtttctcagaataaccagctcaaaatatgccagagaagtatattttggggtggcatattctagtctcctccagtcatattttggggtggtgtgtcctgagccccaacaagataggtttcatttttgaaaattgctcttccagtcccactgttcatctcataagcccaggaatcaccacctgttgatttcctaggcatcttcttgctcagggtagtagatgtttggtggactagaaatgcagggagaagaaaaggaaggcttggtgatgtcaaggatttttaaaagcaaactatctcactgtgttctctcaatagtcaccctctgtgctgctcattccatgaggcttaaagctgataactgggggacaaaagggttagggtaacaatttatttttgtctcctgacaatacacacataacttttctgctgtgcttggggaaaatataactgtggattaattctgactcattgttttggaagcaaaaaaagaaaaagatgctcgcagctgctgcatttaattcaacttataattgaaatatgcaaatccagcaaactagttacccttttcaggatgcatgaaccatgtgaaaatgaatttggcataactaggctacaggctgttaattgaattcccctgatctggacctctttttaaaaaatcagttgtatttttcttccttggctgcctgacaattgacctccatcctgaatgacacagtcactgtccattggggtaggaggcctcaggaccagctgaccacttcagtggaaacagatggcctgagactgccgctaccctgggaaggcagtggtacctagatagaaatttggagaaaaactagccaaaaggtaccagactacaccagaggtcatctttgtattcagaggcagaactcattttggtagtagccagatgactggctttggtatgatctatgattctttggattatgaaaagaaaagtgaacccaaacacaaacaggcatggcacgttagataaggcaacgcctcatgaaaacaggggaaaatgcaggaagaaaataaagttgctgggcacagtggctcacgcctctaatcccagcattttgggaggccgaggtgggtggatcacctcaggtcaggagttcaagaccagcctgaccaacgtggtgaaatctcgtctctactaaaaacaaaattagccgggcatggtagtgcatgcctgtaatcccagctacttgggaggctgaggcaggagaatcacttgaactcaggaggtggaggttgcggtgaaccaagattgcgccattgcactgcagcctgggcaacaagagcaaaactctgtctcaaaaaaaaaaaaaaaaaaaagaaagaaagaaaagaaagtcaaaggctgcagaggccagggatggctctggtgaaaagaggaattaaagattctgcagggctgggcatggtggctcacacctgtaatcctggcaccttgggaggctgaggtgggagaactgcttgagggccaggaattcaagaccagcctgggcaatataacaagaccccatctctacaaattttttttttttttttttttaatgagccaggtgtggtggcatacgcctgtagtactagctgtttgggaagctgagtcaggaggatcacttgagtccagggttcaaggttgcagtgagctatgatcgtgctactgtacttcagacagggtgacagagcaagaccctggttcaaaagagaaacaaaagattctacagtggtgtcatctgttgtgatggtgcagatctttcaccagaggattcctaaaccaattcatcaagaccttctggaatagtatttaccacactaaaagcccagtttgtaagaatactagagaagtatatgcgcttgtttgtaaatcacttggaaactcaagatttggctttggaatttacaaaatgatctttaaatgttaacgtaacatttactatactatatataacatttacatgtactaagaggagaatgggaggaagcaggctgccaacggccctcacatgtggccctccccatagctctgccgcagtgcctgacacctaccggcaggactggcactgcccaaacagcccagagagtcgagcaaatattctagcatgactgtcaggaggccacagcctaggtttttaagttaatgaaggttacactattatctgtttaaaggctacacaaaagttactactatactcagatgagggggtgtgaaaaagagacgcaaacatgccaaaacaactttccagggccagtgtgtgaggatcttggaaacaataaagtaaataatgttacagaaagtgaaaacaaaatccaggagaggttttaaagggcccagaatggaagtacttttggctcctgaagccctttaggctcttgtgggcctgggaactatatggcttatcatttaagttgatatgtttttgcgtgcaacagtgcaggcggaaagatggctgtggctcagcaggagtgacccctccctgctaacaaaacaaaacaaaacagcaatttaacttaatggaacctgtttattttgcgatgaattcagacaaactgaccatgtccctgtgaacttcatgggacaggggcatgaatgctattaatgattaagctgggatgaaaggtggaaacagatactgccctgggtaaactggggtagatggtccccatattgaggggactatgccaaaaggcacaggctcttgggccaggctgccagggctccaagcctggccccatcatttgctagtggggtattattcagtaaattaggactctcattgcttcacttcatttatctgaatatgaggataatcaaagcaattggttcatagagttattaagataaattagttaacatatgcatgccccttagaaaagtgactggtgtatagtaaatgctatagcacagtcatcgtctgagtgactcctacctgagctctgcaccacaggggccctgagctgcagagggtcctagaaagagcagttttaatgggtgtgagaagcagataatgaccctcagttattaggagacatcaccagattgcctctgagatgggccggagccaggaagagccatggcagataacagcaacagcactggacttgggagtccagcatcagctgtgctggcagagcatgccaggtgccaggttcaacactgccggtggaaggcccaagttcaaaacctcactttacatatgacaaaacagctgggtggccatgtggctttggcaagccacttgtctttttctcatctgtaaaattagggtagagtgtctgccctcttgtatcctggggttatttagaggtacaaatgagatgtttatgcaaaattgccatgtacagtgtaaaggagtaggagttaggcaaatgccaggttttgggaacatgtccctgtgaaattaagtgaagcagaagcctttcctccctgtcctcttcagagccaactcttaatgctattccccagaggccctagacattgtagagtcttagggtctacaccatctcttcattcttcagtttctccccctgtggactcttttacacaatgcccaagtcccaaccctaaaataaatcagaaacagaagcttcatttgctccttcagccctcctaagtgataactgcatttttctctgtccatttatgtaaatgtgtatatacattaatgcaggggtccccaacccctaggcagtgatgggtaccagttcgtggcctgttaggaactgggccggacagcaggaggtgagtggggggcaagcgagcattactgcctgagctccacctcctgtcagatcagtggcagcactggattctcgtaggagctcgaaccctattatgaactgcacatgccagggatctaggctgcccgctccttatgagaatctaatgcctgatgatctgtcactgtctcccatcacccccagatgggaccgtctagttacaggaaaacaagctcagggctcccactgattctacactatgatgagttgtataattatttcattatatattacaatgtaataataataaaaataaagtgcacatgtaacgagcttgaatcatctcacaaccatcctctccaccctctggtctgtggaaaaattgtcttccatgaagtcggtccctggtgccaaaaagtttggggacctctgcattaatgcatgtacctggcacacagtaggtactatgtgagtatagctctttttgttcttccctatgctacgtccctaccatttggaagttccagtggcactctggaagcactctgttatagaatgcattatgttgcagtggatatattaaattcttctgaatgcaagcactagtaatccagctcaaactagcataaggaaaaagtgaattatgataagggaactgaggtatcttaagaaatccaaaacaagttttttagtttctcatccctgtatctctaggttcccctccctccctcccttccatggtatggaactggcagtcccagaacaacctagaaaaatcaggaagaaaaatgcatgggttttaaaatgaccatacaatgggtgttttctatatgagtagttagctggcattatgcaaatgtgtagagtctccccctgtggactcttttacacaatgcccaagtcccaaccctaaaataaatcagaaacagaaacttcatttgctccttcagccctcctaagtgataactgcatttctctctgtccattgatataaatgtgtatatacattaatgcaggggtctccaacccccaggccgcgatgggtactagttaatgacccgttaggaactgggcagagtcttagctgctctctgccctaagctttatgatttactatgtcagctcctggaaactcccttggtctaaagtcgaaaacgcccaagaaagggagccattgattctatttgagaagctgcccaccctgaaccagtcccctgtgactggggttagtagtgataatgtggtgttgtcacgtggcacaaaatcctgtcctataagtatggaagtgaaggtacagttcctataaaaggggacaatttggaggtaaaagtgcatttccagtagagcaggattcttgatttacgtgtgcatctccatatataaatgagaccatccatgctagaagggccaagagtgaggctgtcccagatgtgtgcctgccccagagccttgccagtgccaatagcacaagatactcaaaacagactgagagcaaataataatttgagcctcacccttatgaggaaatcatgaaccaacaccaaacataaagtcctttaactactcatatagaaaacacccactgtatggtcattttaaaacccatgcattttttttcctgatttttctaggttgttctggggctgccagttccatactatctaactacagtgccaactcttgtttaaagatagttctctataatggtatgagggtggggagagtcttcagctagtcaccactacaaaaacctggggccagcttcctggctgtaagaacagttactgggagtggagaccgttggtaatttgtgaagtggcagaactttcccaatgcccttacgcttgaggaatactgactagacaggtgccctctagaaggccgatagtcttccccagaacatgagcaaaggcagtcacgtgtgggagacaaattcagcttccttccccacttagtcctttctgaggcctgggcggtgggagtgatgtgacatgcagggagagtcgagaggatcaggaggtgcctgtggctgtcaaaggtctgcgtgtgtttccttccatgtcacgggcaggagcagagctggcgtgtgagaggtcttcaggcacagctaagctcggaggagctggcctccgcctgcctcacggtgcgggtggcactgggagggcagtggggatactgccattacccgagagccctgcccagggcaaggctggacagaaggatcttggctcccgccagtgggcagggagttgaaaatgcttttcttcagtttaccatggaggccactctatctctaacatcctttccaactctaatgactcaaatccagccttacttctctgctcttattgggaagaaagggggttaaggagtgtggtggaaggagagggaatggccctggctttggggactggttaccaggagaccccctgccctatcctcgtgaaaatacatgtccactttagacaagagaaggcatgatgttctctctcctatgcatattcccaggaataattgcagactaaaacttttacctgtaggaaagtacatataaatatgttggcatacatttgcataatgtcagctaccttgagaggaaattcagtgtttctgagccatttttgccagattaggcagaaagtaggccaaagattgttataacaaaagagacctggctggaggaagcctcctgagcacctgagtagacagacttcctgtgagggtttgggagccaaccgaggcttcctaccatctgacatctataagaacactataagaacatgggaaacatgccgcgtggggctgtcagctctggaactgccgtggccttggactccacttggcctgtgctcagcttggagttagcgctgcatcggctcctcctctgctggttgcagtttaatgacctctttgtaactaggttttctactgatgccaaggaaggaaaatgcaggcacatattggagcttggcatttggggttccacagaaaacaggcacacagaacagtgaagaaatactgtaatgatagcccttcacattactttgagtgatggtagtggaggaggagtgtgaccttgcagtgagctattccacagggagtacagctgccgctggcaagcgagcttaataaagatgatgtttggttcatctcaaaattgccttcagaataaagcagtctgattttgcactgccagaacaaagaggcctgacactaaaacacttccattccatttgttagcgttacttactatggattatacttaagcagcactgccctaaagaacccccatataaactcttctgctttttagctaagcaagtttatgggccacactggggagataaaatgcagaatataatattagcaaatcctatttagttatttattaatgttcttcacctgtgtaatctgcattcattaactcattctttctaatataataaaaccccaagaacatcctctccttttctgttgtaggaccaggagcagaatcatgaagtcatttatgttactaaccctgtgtgcggccaactcaactccagggtgtaaaaatgaatagtaggtgccctttggggacagagcctggctgtcaagccagatgcttaaagggaccattgccaaagatcctgtaacttataatgcagcagctttgctgatttatagaaactggtttctgaaaagctttcagtagttaagtttgtactccagccccttcctgctctgtttaagatgcttatttctgatgctgcttcttgtaccttctccagcagatcggctgttacttttcatgtcatgcctcactgatagaactcttgaactttttttctgaatagcccatctgtttatttcccatgattgtgatttctcaaggtcatggttagtccaaaggtccccaagaatgaacaagtaagacggtaatgctgtatgtcaggacccaggcaggacaggaatatctctgagaagccataagcttctgctcagttttaaatcttgatgggaaaacattcagaatagggaaattcaacatatttgccccaaggtaaggatgaaagccttgcttcagtactccagcggatgtctgggttccctgcagatttcccttgggtggtttggcactgccccctcactcctagtagcagatcttttgcctgtggtgggcgcgtcaggctgaagttatatctggtgctggctccgctgtcctccagcaggactggaggtgtggtaggctgcatcgcagcttccctgagtcatttcccagcctacagtagtggcttctaatgccttccagttgtcctgacaggaatggaggaattttatcaaatcgaagtttgtgagtaggtttttttttttttgagacggagtctcgctctgtcgcccaggctggagtgcagtggtgccatctcggctcactacaagctccacttcctgggttcacgccattctcctgcctcaacctcccgagtagctgggaccacaggcgcctgccaccacgcccggctaattttttgtatttttttagttgagacggggtttcaccgtgttagccaggatggtctcaatctcctgacctggtgatcctcccgcctcggcctcccaaagtgaggtttttgagctactcagtttgcctgaaatttagacatagagcttaatgatcaaagtttagacagcacataagaaaatttttaccatatgttactttgaactcccaggagcagacaggttcaagcgcttcttagggccccagagtcttcagcccctgcccaccttgcacttactggaactaaaacaaaaccaacctagtggctcataaatcctgcagttttggggtataacaatacagcagctttctattatgggatttgcttcattgtgtgacctgtattgctataccaggaaccagaagggtggacaaaacacatgtatttatttaataaatattaggttggtgcaaaaataattgtggtttttgccattgaaagtaatggcaaaaaccgcaattacttttgcaccaatctatatatagccttattccacaaagagaatatatttctttaaataaatggatttttaaaaactttggtaaagactgagcatatataataccacatcattatcgatgttacataaacttaaaagaaataaagagatggagagaatcagcttgctatctttatttctttatttgcactgggaaataacatctttgtctactatttctagcatctgagatccaggtcagttgtgattaatttttctctgtattatgcaatgtattttcctgcttttcatgcctctctactggatgctagacattgtacattttaccttcttgggcactgaatatttttgtagtcccagaggtacttttgagctttgtcctaggatgcagtgtgatcctttcaggtcctgctgtatagctgtgtcaggtggcagtgcccatctagggtttctcacttgtgttttctacccagtgccccataaatcatgaggttttccagctagggtggtgggaacaggccctaccctaggtcctgtgtcagcaccactgttccttctaatcttctcacatggctctttctctggcctgaggtggttccttacacacatgcgctgatcagtagggctgtgctgcctagttgagggagctccctctggcccccgacttagatctgtgtgtctctctccagtactgtgaccgcgagttccggccaccttagtctccctggatccctggcattgttttcctactgcagggaggctggcaggctccacctgggttccccccgcatgcacactgcagctgggaccctcctcggagcatgagctggacaatcacagggctcccctcctgagtttgccctctcaagaatcactatccttcactccctggtatttggtggcttgcaaaccgttgtttcacatattttgtccattgtttgcttgtttcatgcaggagggaaaagtccagtacctgtttctccatcttagccatatgagactcttaaattattatttttttcctttcctagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacaggtatccttaatgactattccttttctttttttgcaaatctgcactaggtatagatttagatcggatccatttgaaattatattttgaggagcacagagcagagatagtgatcaactcatttaaccttttgaaatgatagtgaggtattttaataggttagaaaaggaaaattttcttaatatgaaaaattatcttaagaaaactaactcaaagttcagcaaatttatacatcagatgtatgaaaacatactagatttcttttgctgaaataatcagtgcagatgaagaaaatgtgtcactagaggtgtttttccccaaataatgttgtgtgcctgttttttatttcctattggcttcattcatcctggcttgtatgttttaatttattctaatactgggggaacagaccaaccattgtgctgtatcggaactggttccaatcctcttcttgtgtctggacctccaagcacctcaggttttccctgctcctgccggaatagaagcaggatattaaccatattcagttgaccttagaaaagcaaacacacacacacaaaaggagagggagaattaggatgactcactctaaatttctgggatttctaagtaaacaagaataacatatttattcagagtaccaagacaggagccatgccactaacagtcgtgacccctcccctctgcatgttaggctaagataaaatgtcttcattattgctaaccatgtgacctttttcattttgaagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtgtaagtgaatgctcagaaactacctattaattccaccttcctttccctagataagtctgagtccttattagttattcatcaaacattcttcgccagccctactggccacttgaatgcaatggcacttgaggccctaaacgcacccacaggcatctgcagagtgggagatgctcagtccccctgctcccacggagctctggtgtgccaccatggcgggcctgtacttccagagctccaggactccactcagccagccttcagagcaagcttgcttggggcatggtgacgggggacacagactcgtacatgggtctttggaggaagacaagaacagccacctctacgtgcccactgtcagagttgtgctgtgcaccttccgtatcctggcacattcaccacgtgcatgcagagaggctgcagagctccagatactagtgcagaataggtaggctggggtgctgaggggaggctgcagagttgctgacggagcttgatagaggagagcagagggtgtccagagaagagaatggcgcatgtcaaagcaaagccacaaagtcctttgtatgcctgaagggcagtgggtagcttacctgtcacaggaaggtactcagaagtcaactggaagctgctatgcagacagaaacaagaggagggggcaaacagggcaaagcagcatagcagaggctagagccacccataaagggcagccagtaaggtccctccctgacattttccatgaagcatcttttacctcctttgttctgaaagatggtgtgaaaatatgtgaagtagtgtgaaaaatatgacagcaatttgaaagacagaattgtataaagaacagggagttagtgtttcaaagctgagaagaaaaagttgtcagtggagccagcaggtacacaggaatctggtggcaccttttgagggcatgctgaatgggtgacactaagtacatgctgtggttgctccgagcagcatgagtggacaggacagggtaaatgagggtcttctgtccatggtgccatggccatgtacattcccaggtccatcttaagtaattacaggtggccagaaagactaacttcaaactcacccacatgcctgaattttaagataaaagttacagctagggtagatagatgagcttaactataacataattaattcccaaatcaacctggtagtaatcctgttcttatcattaaataaaatatgagatattttcatagatcagaggaatttatactgtgggctttttcctgcctagtttgattaaatgggaccacatacatacatgctgtatgcatagagacacaacatagatcttacaaaatcctctctggcctttatgagccacgggttagtgaaatacatcttcagtcaccactaggaacagtttccacagttggctgggatcacagaaccccagcaggtggcatgggtgctgtcggtggcaccgtctcccttcctggtagtgccctgacagctgaccttgcagccaccagaaatccttgtccttgctgccttcctgccactcacctacgtggcctcctttgtaggagaggagagcacagggcttaaagatggcaactgcctggcctgggctcttcagagcttctgacaaatcatttctaaatagccttgtgttctttccctcctagactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcaggtgagaaggggtggggtcacctcagcataggctctgctgaattgcacatactcaggatatgctgccaacaatggcttaggatgatgattttgacattaagtaaaactaaaaatccatgttattattaaagatttggtacttaagtatccttcccctcaagggaataaagggccaaggcagaatatgtagtcttaatggagaaaaatgacatatcattatggatttcctcatctgtaaagtaaggttcctacatcacagggtcattgcgtgctacacaccaagtgtaaagcacttggcattggagtgtatgtcgcccatagtatggtgggtagcgtgctaagtttcatctcatggccaaaacattaacctcacagctgcactgttttagcagtgccctgctgttgctgaagttagttaacatcactgtctcaaagttttaggcaaaacatgcttatggcttattttctacatgtgaaagtaggaaacatgagtggcaaacgttagttttaactatcccgtataaaatactttggtatttttttcaacaaacatctttgtataatgatctccatattaatacaaaatcttttttctttaaaattctgcctttcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactgtaagtttaatggagaagaaagggttgtattttttttttaattcatacctgtaggagtaaatgacaaatttggcttttattcttagttctaaagtttatactgatgcaatcttaatttacgttgacagtacctactaagggcaggcctctgtggatgatacctaagaaatgtccctgcctgttagattacagcatagaaaagacagtgtagaaataaaaacaaagaccatgtgtctttaagaaggacagaatgctagagaaatgcactgtatacaggtgcattgaccttgagaggaatgagcttagccatctttcaagagccactgcagttggagctgtcggggaagaggaaggagggaaggctgaagagagaggcaggcaccagaaggtgtaaggctttatgggccacatagtttatattttatctaagtgcagtacacagcaattggagcattttaagcaagagtagcatcttctcgatatagttttaaggatcactgtagctggccaggcaccttgggaggccaaggcaggaggaagatggcttgagcccaagagttcaagaccagccctggcaacatagcaagaccccgtctctacaaaataaaaaaattagccgggtgtggtggcatgcgcctatagtcccagctacttgagattctgcgacagaggatcgcttgagcccaggaggtcaaggctgcagtgaggtactgtcacaccaccgcacaccagcctgggagacagaccaagacgctgtctaaaaagaaaaaaggaaaaataactgtggctgctacatgaatggaaaggaggggcaatggcaagagtgagactactccactagtctttgagaggccagtacagagtctggatccattttgaaggttccactactattccagcaagtagtgttcaaggcagcaaccaagagtgactcatagatgtctggcttacgcagctggatgtggagtggtactagttaaaataagaagcaaagataccccctctctcccctacccaaagctctcttaagcatacgattggtgcctcttatatggtgatgggccttaggggaaatactagtttccactaaaggttagtggtagacagcacttccactgtgtggcataacactagagaggccaacttattctagaaatgcaacaggattggctgcataaaaaacagaaagtatttattttacaaagtcggactgagatactatctgagttcaaattaaataccggttctacaggtagattctccagggatgggaagtgcccagacataatgtttggtgtctctcaccaccttccccactcataatctcatctttttgtcttaaataaacagatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagt

SEQ ID NO: 38314 - DNA, 49511 bp, Homo sapiens
gtggaggtgcgggattgggcgggctgccacggcatggagaatggctccgcttctgttgcagctggcggtgctcggcgcggcgctggcggccgcagccctcgtactggtgagaacagggatgggaacccgcgcaggccggggcttaccgctctcctggagactgcggctcctcaggcgtcccctcctccgcgctaccagttctcggagaagtcccttttcccctagattcccccaaattcctgacctcggagtttcctggagtttcactctccttttcttcggttctttaattttcccttggaatcttatctctttgtgtgctcagagacttgtaagttttttcacactggagcgcacccacccggcctggcatcatcgccgcttccatcgcccctggcgcccgcgccccctacccacctcctctgtcaacctcgacctctcccagactctccgggacctgcagccgctgcagttctgctccacccagggaggtctcgagcccccagaaggggtgtgctccctagcctgctcccttggctgatgtggttaagcaaataggggtgacggagccttgacggcagccatctgttacaaatgggaataaatgcgtggatcgatgagacccactagggacgcagggtgagcgagagagacaggcctcaggcgccttgtccggggtcgcattgtgtcccagaattaagcaccctaaatatactgcccctaaacaaggcaggacgatagaatgcaaactcgattgtctttgcccttgctctcgaaacacaaaaacattgtaaacacttgctgattgttaagtggtagaaaattggcgaactctctcccgcacaccttggaatgagcctgccctctagttagtaagtggagaggatttcagcttccttgacattcagattagccacctagacagcactgccaggaaggccactctgccatctttccagaggttgtataaatttacagtttagataaaatgtaatgcatccttacttctttgttgatagtatctgggtgagagaggagtcctctcttgccctaactagtagagatttcagggtttagggcttttttgttttttcaagtttttgagcaaaccaggattgattgattgattgattgatttttggcggggtgcgggcggggagtggattcacacattcttagattgaagctgccttactttgggtcttttgcacagattttatgggattgtactgacggtatttgttcccactagcttgaagtgataagagctaccatttattgattgtagtacttactatatgttgtgttgcacttggtttaataggagttattaaatctttaacactgtgacatatatgttatcattagcattattttactggtgaggaaacatgttggagaaatgagctcgtgtactcaaatgttgcacaactagtgaaacttaggttttttaaatgccagagcaagaaatcattaaaaaaataatttttcaaaacctcatcctgtcttcatatgtatccactctccattactcacagtctcacctcctttctgaattattttaaaacaactcgaagacattttatctttaaatcctcagcatttatttctaacagataaggtccttctttttaaaataccacaataaagtggtcacagatttaaatttattctgtgatttcaaatgccccctcagttcacttgccctcacttgtctcatatatgtctcagtatatatgtctgtttgttccaatcaggatccaaacaagtgccacacattgtactctgttgatgtcttgagtctcttaatcagttgacagtttctcctccccctttttttcttttccttgtcttttttttttttttttttttttgagacggagtctggctcttgtcacccaggctggagtgcagtggtgtgatcttggctcactgcaacctctgccctcaagcaattctcctgcctcagcctcctgagtagctgggattacaggcgcctaccaccactcccggttaatttttgtacttttaatagagatggggtttcgccatgttggccaggctggtctcgaactcctgaactcaggtgatccaccctcctcggcctcccaaacttctgggattacagacatgagccaccgcgcccggcctttttccttgtctttaatatgatcatttgtcctgtagaacttctcacaatttggatttctttgattgcatccccttaatgccttttaacatcttctatctcaaattttctataaactggtagttaggatggagagacctgatcacatacatactcgatgtgttttttaatcaagaaaaaattgtgagtgatgcttcttcctttctcttgtgtctcatcaggagtcatgtaatggccatttgtctctggtgttaagatggatctgtggtttcaaatgttgccagccagacccaccagtttataaagtttgtcatcagcctaatggttttagtagtcattgaggatcattacctaaatgctttatttcattgcgggttgcaaagtgaaatattctcattgtatccttcatttattacctagagttttgtaatgaaagaaatctcatcctcagctattcatttaccctaaaatacctttcatacatataaaacgcaaaaggcaaatttttgaaatgagatccttcctgcatcttacccagtttttgtctttagtatcattgcaaatttatgatttacagtatttttcatggtttgatccattgcagtaattttttttggcaggggggaagtgggaggacgatcagattcttgcatcataggccactgagagcccattcaggttgactactttgtcctttcagcacagcccttataatctttgataatctttgattataatcttataatctctgaagtgatagtagttgatgatggcagtaaagatcagacctcaaagatcaaacctcaggagctgatgacaatgacaatttgataatgtcttcaaattgatcattaaattacaaatgaatagcattccaaaaatttaaagactgttttgaaagcagaaagtgtaccaatagaaacaatgtaaaaacaatggttatttccaaagcttagctcccaagtgcatatggaagggagcctgtaagttagatacttcagtaaatgctgtattctgaattcaaattcgagttaagtgtcaaaaacatattcttaaacattgttggtccctacttggtagtctggggaatcttccttttatatcttgggtctgtctggtcctggatggaaagtgtgccctcaccccgcatgttccaactgcaaaatggacttgtcctgtcacatatagattccaagtagcgataggaccttactatatgtgtgtgtgtctctatgcatgtagacacgctaaggatcagggttttagggcacctgagagtagactggtcttcctgtagtgactgacctttattgtagctgggatggtggaggcctggcgaatgatgactgggaagagacagagcctcctaaggcatcagcaccttactgatggaaaaaaggacagtaattcgttcataagtaggggactcactattgtctaattttggagtcacctctagaccattgttaatgaactaaaacctgagagtgagtattcaactaaaagaaaagtagatgatgtattctaacataaatacagaaaagtcagcaaaacataatttctgttttgtaaaagacatgtatgtctgcttttagatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggtgtaagccctgttttgatttttttggtaaagggtagtttggaaaagaaaaggaaatttaaagtatttgacttcactgtctttgccaaaacattaatagatgtgggctgtgttgagcacacagttgataattgttgtagttcggcagagagggaagtgaatatttgctctcatgaataggagcagcatcatgaggcagcgggactggaatgttctagagaggtaataagcacattgtggacagaaggcaggatttcagatgggaatgaccattgggaaagtaccagaggggcttgttagattattgggacttttttctgtatgtaagctgaatgtgccgggcttggaaaatcattttcaaaagtgatttttaatatatttttttcttcaagtgcctgtgatgatggatgaagctctgagctatctagagaagagacaggtatcatgttttctcttttaatatgatatctccaattaaaactagaccaggtcaccaattgtggaccccaagccagatgcactgtgagaggcagtcctggcagcaccccgatcgctgggccacctgctgcttgcttgttgctatccataagcccggcacgtagcatgctacctccagaggcaggtcgttgacccaggacaaaccaggaagcgaaaatttctgtttctgtaccctcctacccattttaatcctgtcttgcttgatgatatatttaaaattgagtgacagtgtatgtctgcagactttgtatgatgccacaatgctgtttttacttttgtgacttgtaagaaaaggtgtattgttgctgtttttgctgttaacttttattctcttctctctttttttattttttggttaactgggtttgaataaacagaaaaactaagtctgaatgaacagaaaaaagatatttttaaaagacacacttacattgaaattattttgtatttcttcaatattctcaagagtctcccctcacattttcttcctgttttccctacataaggagaagagaagtaatacacaaccttcttttgtaacattagctgccattggaatccccttggagggattaagaattaagtgagttctttttaaaaaaaaattgttttgatttactttgcttttagattttttgtataaaggggaaatagaagattcactgaaagagaaagggctgtattaccttattaccaacttcaaacattcaatttagagaaaagaagaaaggaattgagcctttaatatgtatgaggcttctacctcttcaattacgtgtaatcttcacaccagccacatagagtaggtttttctgttctctttttttaatcagaaaataggcccaaaaagttaagttgcccaaggtcattaggctaagaaatgctgcagccaagctggaatctgccctctctgacttcaaacctcaggagcttttttcttacacacctgtaccctctcaaatgtgctatagcaccacaagtacctggcttcttccaccaccaaggtacagggcagactggggaacagcaaggtgacatggagagattgagtcaatattcactctccacctctacccaggatctctctctctctttttacttagcctttttattttatgcggtttgtgcactaatatttatattcaaatttatatgtatcaacactaaagcagttgttttttaaattactggtgatttgattagaatactttatggcagttatgccaaattgtattactttatttttgtttcttgcagaaacgagatcctgcgttcacttatgaagtgatagtagttgatgatggcagtaaagatcagacctcaaaggtaaatacacttgcttttagaattgacaatagttagaaaatagagaataattttgcacatgtgaaatctcactttcattcaccaggggaccctaaagctgtgcctaacactctccattgttatagtctagatagcagaaaaaacagatttcatttatggaacttctccataagaccagggaagctttgaagatcgccagatagggaagaaacatgcccgcgcacagttcctcctggcctttagggtaggaaccttcgttgcctaccaatttgtgcttcctttttccctaagcacagtttctttatgctccatcttgccttataatttctaaagcagtcacgccaatagaaagctgctttcgtaccagcccctgggaagcaggtgtgtcctttcacatgcacagagagcattggcaggatctggcttaggaagggtaagtgctgcactttgaatagtatgatgtgaaagttatgaacacaagccatctcagcagtttagtgatacatgaagggaatggcatggaaagccacattggacacttgctgttgagattatagaggtagcctagacccagctgaggctgtgcatcttctcctgaggagcacttttttggtggcccttgacctgtgagtggccagctgctctgctggaaggatcagggatgccctcccagggaggacaagcaagggaggggttagcaattggccccactgctcccaaggttgggaggaagtagaaagttgaaattatatttagtagaagtttttatttaaaacaaaccagttttcgctaagttaagtatttatagattccctgttaatgtcttacagtctgaggggtgtgaggaaaattttagatacggctcttgttcttgaggcgtttcagaccaagggggcacaaggtatagtacaagagaatactgcagttgtacagtgatgtttattatatcctcaaacaacataccaaaaaggcgagtaggcactcagtaggaactcagttcacaaatggtggccgagtgacagctgctgccctgtatactaaaggccatgctgtaaagcttcattgtgcatccattccaaacagttgtggctttaacaatgttatattccttgaagctagataccatactctagagggagcttttcatcctaacatagtaaagtcttattagttcacttagctacttatataatgactttatcttcttggttttgcagtctcaagtattgtgccattccagagtaaacatctacagcacaaataactgttctttgaacacatttcttcagctgttaagcagaagtcgagagttctgactggcactaaaatacaaagatgtaaagaccactttctaccttgaaggagttcacatctattaataatactggaaatatgcatcaaataattagagcactatgtgttagacatttttatcaattaggaactatatcatagagtggcttagataataaagacgtttaattatctcatctgccaggaagtctagaaatagttgattccagagttggcttagcatttaaacaggatcaggttgctagatccatatcattttcagtctcacgcattccttcatcacaaaatggccacagctgcaaatattacatgtcctggagtagtaagggacagccaggactttaagaatcatctctgggctgggcatggtggttcatgcccgtaatcccaacactttgggaggccaaggtgggagggtgggaggactgcttgagcgcaagagttcaaggttacagtgagctgtgatcgcacgactgaactccagcctgggtagcagagcaagaccctgtgtcaaaaaaaaagaatcatctctgcgtgcatctctcctttttaactaggaacgaaaatctttatcagaagtcctcacccctccctctactaaagcccacacccaaagttcacaagctagaacttagtgacatgaccaccaaagcctgcagggaggctgcaaaagtactcagcaaagaggagttagaccaatcatggttcatcccctagggcttcacagttgtcactgcattattggggccataacagcaaagaaggaggcactgtttgctggtttggcagctagttaacagtgctacaacaggaccatggctgcatttgctggttgaaactgatagatttcagctatgtgccagataccagaaataaaaatctttgcctttaagtagctgacatttacagttgcattgtgatgagtaaagtaatagttgaatgagaaaatgcttcagtagtacacattgctattagaattatacttttctttttcccgggggaaggtggggatgggcatggaggctagaaaagagaaatggtgtttggctgagtcttaagctggcctgacaggtgaggaagctggaagacagtgttctgagaaaaggcatacaagtgtaagaccgtggtatggtctggaaatctcaaatactgctaatgttcacggtactaatggggcagcctcagaagctggctaaaaaggtgaaggctgaatcacaaaggatctcctatgctatgataaggaactcatatgtgatgcttagaagccataagtcatcactgagggtgtttgaacagggcttatgtgaactgatttccatattagaaaggctactcgtataactttaggaatgaattagggagtcagggtagagatgtggggactttaggggataaggccctgaactaggtcaggaaggtgtgaggatagcatggatttgagagggattttacaaatcagtcagtgagttatagtagccagtgaattgtaatgggtgatagaaatggaagatgattctcaggttttcaatttgagcaacttagtagatgatgatgccatttgctgcagcaaggaatgtagactgagcagaagttgggaggaggagatgaatgaaattctggagtttttatttatccaatatataactaggtgacacaggagagaagagtctgggctctaaacagacgtgagattcataaatataagctataattaagcccatgcagtgactcccagtgagcttttatgttgagaagagaagatggccaggggtttcccattagctgtatgtacagtgtagagtcagtccttgtgtggattatcagcatttaaggagcaagccaagcaaaaggagttattggtgaaaacttgggaacagtagaggagggcaaaggccagatgagagcaactttacagctgcctgtagagatggttgtcaaaggagagggtacctgatgggctaaggttacaaggaaacgggatgtggaagagcaaagggcatgagccctactacagtggaccgaaaaataaatgggtgatgaaatgcaggtggcaaatatagatcactatctcacgactttgattataaagcagagtaatggccgtagcttgagaaaatagtgaagtcaaaggaaagtttttaggatgctggcagcttgagcaagtctgaggctgtggagccagcagagaggaagagattgaagatttagaagagaatttactgctgagagagaggaatttgagtgaaaagattcgggagaaatggtcaggatacaaacagcctctctggggaataagagcgattgcagaccagaacaaatacaaaagtcattaaccagtgttaagggcccaatcataagtttgtaccagtcagatagcacatggcttttgtggggtttttttgttgttttttgttgttgttgttgtttgttttttagcagctcagtagcttaggtagaggagtcaagaaaagaaggtcattgcccactgtggtggttcctctgcaggaaactgaactatgatttcaacctagtaggtcaatggcaccaagatttctacagctcctccaggtcatcagaatgtacagtgggtgtaacctagtcacaagaagggataaactgcaatagcagtgtttgagccaaagcaagaaacacagcttatataattctctttaatccaaattaattttattctgatttttatataatttcataggtagcttttaaatattgccagaaatatggaagtgacaaagtacgtgtgataaccctggtgaagaatcgtggaaaaggtggagcgattagaatggtaatacatattttcaacatttttatctaaaatatgaaggtatcttgaataatgtcttttgcagacttgtatgtttgcccactgcttgaataccagcatttcaagttagtgataacataattttaataataacttcatgtttttagtcaaattttaagatgtgtcatatctataatatagtgggtgatttaaaaatagatttatgtatttatgtttatcttaaagtttaaaatgttaccatctacctctgtatctttgatagagttagcagatagcttatgtggttttttgcagtttaaaaaatgttttttgtattaagttttaccttgatgaaggtatgctgttatgcatggtagcatgaactaagatgaatttgacttgggtctgtcctgatgaaatgtgcagtctaataggaaaggtaagcatttgcataagtaaaaaagaagattataattatgagagacatgcagataaagtgctaagaaatttcaaaaaagaggttactgtcagctgaggcatatcagctatgaatcaagctggaagtttaaaaatcaagatatgtgaaagaaaacctaaataattgactttgaggtccatttatttatttttccctcataaaaagaagtctaaaggtgggcagtccagggcttgttcaactccacagtcatcagaagtccaggcttctgccgtttcactccttcttcctcatgcacacagggtgactcctggagcactagccatcacgtccacattcaacaggaaggagaagggaaatggtcaggatacaaatcatcacatgttgccctcttcacagtgtcttatgagttgggtaatattagtttgattattatatagttgaggaaagtgagtaaagaaggtaaagtaaattacccagtgttatcagatgataagaggtagagtcaagatttggatgcagttagtttcactctgaaagccatgcttttaacctctctgataactctatagagaaaagacttgagaaaacagcacgccatttagtaaagccagaaaagacagaagtaggaactctttggatatgtactagaaacagtgattcactttggctgggtcacaggatatatgaaacagaaagaaagtaggattgatgcagtgtcatgatgggctttaaatctatccatttgtttctttattcagccaatgttgtattttcattagagacactgagatgaaagacacctattctgtccttaaggacatcacagtttagtagggagacagaccattgccatacagtgttgtaaatgctataatagaagtacatgcaaaaagttggtgccaccatcttttgagggcagcagcacagatgtcccagaggaggcaaattctcggcggggtctttaaggaggattaggacttaaccacctccaagttgggagggcagggagcctagacggggaacatgaacaaaggcacagcaatgtgaaagaacatgccacaataaaggacccactcatggtacccacgtcttgactggagataaggctggagcggtgggtgagttaaggtcacaaactgtagacgaggggcttttacattttttaccattgacagagtgacactttaatcagccagcatcaagtgtagcaatattgggcaaggtatgatgaatatttatttggattatgatagtgacagaagagaagaaaatgaggggataaatgtgagagctattaaaatgacatagcattgggtctgggatcagagagaagaatgacatgctaagccattcttacattgctataaagaaatacctgagactggataacatataaagaaaagagatgtgattgattgacggttctgcatgctgtacacggagcatggtgccagcatttgcctctagtgaaggcctcaggaagcttccactcatgatagaaagcgaagtggaagcaggagcatcgtatgacgagaacaggagcaagttagcgggcacggtggtgccacacacttttagacaaccagatctcatgaaaacttgctcactattgcaaggacagcaccaagctgttcatgagggatccacccccatgacccaaacacctcccactgggccccacctccaacattggggatcacattgcaatatgaaatttggaggggacacagatccaaactatgtcaaatgagtaccactggccttgggtaacagggaggatgacgatgccattaatagaaggaatgaaacactggaggaggagctggtataagaggcagttatgttgagtttgagccatgttaagtttgaaacaacatgcagtggtatccagaatagcctaggagagaggatgtgagtgagtcatccacatatgtcagatgatagttgaacctgaagccattaaactggcaaagaggaggttacagagaaaaggagaatcaggaaatcttaaggcagtgaggcacatgagaaataatgggtataaaatatgactgaggaaacacaaatgggagttgctatggtagactgccttttcaaggagctgcagcaaagtgaaggccatagacggtagaacaggaaagtaggcttaaacaagtttgatcacgcatcattgaaattagtcacttactggttttttgccccatttcagactaatagctccagtttttttaccacctcagcctcccaagtagctgggactacaggcatgtgccactatatcaggctaattttttaaatttttttgtagagatggagtctcactgtattgcccagactggtctcaaactcctgagctcaagcaatccttccacctcagcttcccaaagtgctaggattgtagtaggtgtgagtcatctcacctagccttttgcatttgttctaatgggtgtgattaaaaagacatcacagatactaactagttagcttattataccatagaataaatgatctgatttctctctacatttgtatatgtcttacctatagtcacactatgttgtgttatcaaagcaattttactatatcaaaccataaatatatttgcacgtaagaaataaggaattcactcaaatacatcagagaaattaaaagttgatgtgcagtttatttctgtatgaaatatgcactcatggagccataatttgcacaaaagaccagccaattcagaattgaatggcataattttgctgtttcaaataccgcaaatggcataacataacatttggatttatgcataattcttaaagtttattgacactttttatttctttaattaatttagtaaactttagatcctataataaatgatactaaagacctgtgcatttcacagcatatctatatattagaatgtttaatctgtctataaacatgttctttatatgtggttctaagtagcccgtaattcattttaagcatcatgacacgataaacatataatatgtatgatacgtactgtccgttttttattctttgtgatgcagaatatctttaatttgtccaaacctattttattatcttggtattttccaagatatttgtagtatgacttcacaaagtttttaaaataatgaagataggcaataggttcatttgagaagatcttaatatacaggtaatttgttttcagtgaactctggcctccttcagccatctcatacctcatctttcactcttaggtattttaagtagaacagactgaagtgtcattgaatttaacctgagttttaaccaattttctttgacttgaaattttaaaatacagggtatattcagttctcgaggagaaaagatccttatggcagatgctgatggagccacaaagtttccagatgttgagaaattagaaaaggggctaaatgatctacagccttggcctgtgagtataagaatgtagtttaaataacattcagtcaagaatgcaggagagctaaagtaaagttaaaggagagtttacctatcagtttaaaaactgagtgtttttggtatgaaatccttatacaaatggtacagccccatagaggaactgatcattttgttacaaatattgtctgattttatgagattcacttgacaattacttatttaatattgtgaccatttctctctcttggtttctgattgcttctacccaagttttaatatttattgtgcatattcaattaagacttttatttaaaagtatagcctgaattccaggtaaagatgtgaaatgaagctggatcacagaatccagtttttgatgaaacaaacaaaatcacaagcagcaatcactcaaaaaggattatttgaaacttcacaccataacttcaaaaagtggaggttgaggaaagaaataaaatcctagtaccattcctaccttttaaaagccatttagagaaataagatgaatttggcaaacgctcaggatcctgagcgtttgccaaatacttcccaatctggaaaaaatgaataagagaatgaaaaagcacccttggacaacatcaaacaatatacctaccatcacacaatatgtcaaacaatatacctaccaccacacaatacgtcagaatttcagcagaagcaagaaaacttgctgaggtctgccatttttcaggactgtaagctgaattggggacacagatccatgtgactagatcctttcctggatggagtgtaccttgttcaagacactcgacaaaatctcacaagaccagggaacccaagtaaccaacaaagccacgtagagctccaggggagggtccctcctccctgccttcccaccgtctaccctcaagtccagatataatactcaggccttgaaattctagtttagagggggaagagatacaggtacatcaaggagaatgttcatttactgtaggagagctgcccatgttaatcatgacaaaataaaagaaagaaatggcaatcacaccaacatataattacacaaaaaagaattaaagttgcatacaaaagatttaagacagtgtaatccaaggaaaaggacaaaattacatgcaagtattctggctaaagaaataaaacaatgaaaataagaatttagcaacacaggtcttcaaaggtaagatgacaaaacaacaaaatggtattaaaagaaaaattacaggccaggtttacatgcctgtaattccagcactgtgggaggccagggcaggaagatcacttgaggccaggagtttgagcccagcctgggcaacataacaagaccccatctctgtaaaaataagagaaaaattaacagggtgtggtggtgtatgcgtctagtcccagctacttaggaggctgaggcaggaggatcatttgagcccagcagtttgaggttatagtgagctgtgattgccccaccgcactccagcctcagtgacaaagcaagagcctgtctcaaaaaaaaaaaaaaaattacagaactaaggaaacaaattgagaccaaaataagatgaatatgtaaaactatctatgaatgaaatagacctagtttagaactgaatattattacatatttattaagatcctgttatagcaaaaaccaaaccaaacaacacaaaaaggtaaacatataaggcccccccaaatttaataataattacagaaaaactcactgcatatccttctagaaataaatatttatttaattccacactttgtgaagtatatttctcccccaccatcatccatccccatcccttgtatttctagctgttttttttgtttttttctaggtgttttttgtttttttaagattctaagtgaatcaactaatataattcttaagagaattagctgtaaagatattcataccattgctcttcagacaagtagcactagctgcatgtgtctatttaaatttaaataaaatgaaaatttagttcctcagtttcattggccacatttaaattacttgttgctaaaagctaccttttttttttttaaaggagataaggtcttactgtgttgcccaggctggactcaaactccatcctcctgcctcagcttcctgaatagctgggactacagaagtgagccaccatgccccgcttgttgtatagcatttccatcatcacaaaaagttctctggcttataacatgatatgaatttattgttggatatgttgtagttcactcttactaaaaaagtatttcatgtccaacatcttagtaaatcatgataggctaaaaggaaaatctcattcataaagttacttggtgtgatttcctgattttctccagaggaccccaagagaaacttgataaatatttcccttgcattatctttctagagggagtcactcagtgggagggagggcataaggcatcagatttttagcagctgattttgtcattcagcagtagggcaaagataatttaaatgattttgctgatgttagggagtgaaccaaacaataaaacaaaaatctgaactttattcttataaatctagttcctttatactactctgtaaagaaaaggagttctgatgccatattttttccttatcataatcccatttactacactgttactagaaatgttaagttttaaagaattaaagcatgtgattatcattaagctattaattcgtagccttggttttacagcaccttaaagtatccctaattatttaagtgtcccagctcaattgaattaatttgaattaaatttagtaagttttattaatatgcatcatgtaatactctttgcaggaggtggaaaggaggcaaataaatgataggtggttaaagttacaaaattcatagtttttggatccacccagtgaaaaatatggttctgacaaagcttataaacagccagtcattgctctcagaaaacttacattctgaagttgacatgcatagagaaattagaagaaatcttcttacttatgtaattcaggtgttagagaactttttctgtaaaggaccatatagtaaatatttcagctttaaagccagtcagcctctgtggcagctgctcaacgctctattgtagcatgaaagtagacatagataaaatacatcctttatttacacaaataagcagcagatcagatttgggctacaggctatagtttgctgactcttaaatctaatttaatcatttatccaatattggaaagtttttacaactacctagtgatctttcagcctctactgcatagctctagtgatgcttaagcagctcattctgtctcagctcagctgtgaagttcctctagacaccaaatgcaaatatgtctccttttaatcacccccttccattgtttctgtcttctgtagctacacaaaattatctactccacttctttgtgacagcccttcagagagtcaaagctgttttccatgtgtattctctgttttaggctgtcagttcttacggtttttgttgttgttgtttgtttgtttgtttgtttttgagacagagtctcgctttgtcatccaggctggagtgcagtggcgcaatctcagcttactgcaagctccgcctcccgggttcacaccattctcctgcctcagcctccccagtagctgggactacaggcgcctgccaccatgcccggctaatttttttttgtatttttagtagagacagggtttcaccgtgttagccaggatggtctctatctcctgacttcgtgatccaccagccacggcctcccaaaagtgctgggattacaggcatgaaccactgcgcctggcccagttcttacagtttttaaacatagcatatttttttcttataattttccactgaagatgtgtctgttcgtgtggatttggtttccacattacattgttacttcgtacaggtattgccaactctttttcctgttcattgcctttgaactttgtctctccatctctatactggtgtggatttctttctgtgttcttttgctttgttttcaggaatggaattgtggctagttatctcaacttcaacttgttagatttctgtgtctaaaagtgtaggttcttgttctatcttagggcaatagctgttttctcaattcatttaagccacaaatttgataagcatgccttgcatgtatttccctaagccctaataaaaatagcgactgaaatagttcagaaaataatgaaacaggaacgtgggttttgtagtcaagtcctataattacgtgactgtctcactagatggcagtcattagcttaaatatcttttacaatattgctttgaccatttaagtcatttctttagtacgttttacagtggtttctaatgtcttctttcttagctgatttttttttaatgactacaaaaagaaatttattactacttgcttgtatttcctcttagagtaaccaggttacatgttctggttctgatgattcttatacaaagtcatcttacaaaagttgcctacaatttcttttctgataataagtgctcctgtaaggttttaaactacatgtatataatttaagtagagctttgtataatacatacaaataaaatagggcatttacattttcatactaaaaattttattttattttattttatttttgagacagggtctccctgtgtcacctgggttggagtgcagtggctcaatctcagctcactgcaacctctgcctcttgggcttaagcgattctcgtgcctcagcctcccgagtagctggaattacaggcacgcaccaccacgccaggctattttttgtgttttttggtagagatggggtttcactgtgttggccaggctggtctcaaactcctggcctcaagtgatctgcctgcctcggcctcccaaattgtggggattaggagcatgggccaccacgctcagccaaaactttcatttatattttacttgtattttcttttcccacatctttgttttttaatatgcaaagctttcctctcagattttcagtttcctaactggtagttagtctacctctttttaaaaatatgcttgttttttagtaatttttctaagcaaagtatatgctggccaggcacagtggctcacatctgtaatcccagcgctttgagaggccatggtgggaggatcgtttgaggccaggagtatgagaccagcctggccaacatagcgaaatcccgtctctactaaaaattagccaggtgtcgtagcgcacacctgtaagcccagctactcgggaagctgaggcatgagaatcactagaacctgggaggcagaggttgcagtgagtcgggactgcgccactgcactccaccttggtcaacagagagagactctgtctcaaaaaataataaaaaattttttcaaaaaataatcccaaagtatatgatgatcacttgttcagttgcttaacttttctaaatagaatcaaaaatccctaacaggcaaaataaatgctaaaaagtgtgtatttcatgatcatagagtcatttctcaggctgtgacttaggttttaaattattttatttattttttattattattttttgagacaaggtctcattctgtcacccagcctggagtgcagtgatgcgatcttggctcactgcaacctctgcttccagggttcaagcaaatctcatgtgtcaacctcccgagtagctgagagtgcatgtgcaaaccaccatgcctggttaattgtttggtatttttagcagatgaggtttcaccatgttgccgaggctggtcttgaactcctgacctcaagcagtcagccctccttggcccccaaagtgctgggattacaggctgagtcaccacgcctggcccttaaattctgatttagacatagctctaacaagctgagtttttagttttttaagcccacagatgactagaattaatggatatgaaaaagatacggagaaaaattacattaagaagaaccataggaagcagatcttaactacacgcacaactcagtctggagtgctgggttgcttactaatgaccctgaatgctcttctatctctaatatagtaatccttggccagttctagttttgtataccaatgattcatatctgcgtgcatggtttggttccttaaaagaatgtgacagttagtccttctccctttttttgtggaccatgtgagcaagtctaagaagctggtatgtttgtttcaccctctcaatatatgggtagaaaagcaggcttccaaaagagaactcaacctccaaagtcatttgttttagacaccataactctgaggtagtgattaaaatgaggaaatgtggccgggcacagtggctcatccctgtaataccagcactttgggaacctgaggacaggcgtttgagaccagcctggccaacatggtaaaaccccatctctactaaaaatacaaaaacttagccatgcatggtggcacacacctgtagtcccagctactcaggaggccgaagcaggagaataacttgagcccaagaggtggaggttgcagcgagccaagatcgtgccactgcactccagcctgagctacagagcaagactccataattaataaataaataaggaaatgtatgtcaggtgtttagcatgtgttcagcactcaaccagtacctgtaattattaacattcatctttttttctttttttttcctttttttttttttaattgagaccaaatctcactctgtcacccaggctggagtgcagtggcacaatctcagctcactgcagcctctgcctcctgggttcaagtgattctcctgcctcagcctcccaaacagctgggattacaggcatccaccaccaggcccggctaactttttttgtatttttagtagaggtggggtctcaccatggtggccagggctggtcttgaactcctgacctcaagtgatcctctcacctgggcctcccaaaatgctgggattacaggcgtgagccaccacgcccggctaacattcatctttgtgcttgatattttttcatcagatccaattctgttactgtttatgattgttaatataaattagctatatctctatctattccttttctccagtaaattgtgtgaaaatatttaacttaaaaagtactgaggaccgggcacagtggctcacgcctgtaatcccagcatttcaggagactgaggcatgcggatcacccgaggtcaggagtttgagaccagcctggccaacgtggcagaaccccatctctactgaaaatataaaaattagctgggtgtggtggcacgtgcccataatcccagctacttgggagctgagataggagaatctcttgaagccagaaggcggaggttgcagtgagctgagattgtgccactgcactccagcctgggtgacggagtgagattccgtctcaaaaaaaaaaaaaaaacaaaggtggggcgcagtgactcatgcctataatcccagcactttgggaggccgaggcgggtggatcatgaggtcaggagatggagaccatcctggctaacatggtgaaaccccgtctctactaaaaatacaaaaaattagccgggcatggtgccacgtgcctgtaatcgcagctactcgggaggctgaggcaagagaatcgcttgaacccaggaagtggttgttgcaatgagccgagatcttgccactgtactccagcctgggcaacagagtgagattccattaaaaaaaaaaaaaaatactgagaaagattttgattgatttagcatttcttgctagaagataatatatactttacttcttaccaccgtttttgttttttttttttttttttttttttggagacagtctcactctgtcgcccaggctagagtgcagtagcatgatctcagctcactgcaacctacacttcccgagttcaagcaattctcatgccttagcctcccaagtagctgggaatacaggtgtgtgccaccatgcctggctgatttttgtatttttagtagagacggggtttcaccatgttggccaggctggtcttgaactcatggcctcaagcgattcccctgcctcagcctcccaaagtgctgggagtataggcatgagccactgcacctatttttttgtttttttaaatgagttgggatctccttctgttgcccaggctggggtgcaatggtgccatcatgactcagccacaatcctcttacctcagcctccctagtggctaggactacaggcacatgccaccacacctgcctcacttattaaaagccaactgtcatagtaacttaaatactcattttaaaaaaccatgggaaattcagttatactccaaaagaggtttaaaagaaagagactccatgtctacagacattttctaacatgggcagtttttaaaacaaagatatctttcatttctgaagaacagctaactttttgaaaaaatgtttagattaattctacctgatagtgagattggtatcagggattcagctcttacatcagaattcttcagatacacaaaactcttaaaagctcttggggacttatgctgagataaaaacgagatttgtaaaagaaagttttttggattttgatttgtttttagttaaattacatggtattttaactctactcatgaatctttgaaatggagaagtatgttcttttttatgtattactcaatagtgttgttgctcttttcaagtttaaagttaaaactgatttgccatatgctatttgaacttttaacatgcttcctctctaagaaaatcattctctccctttctgcacaaagtacctctaccagaaaaacaagggaataaattattttactactaaatagtaggcaaagtatataacacaatttttttttttcctgagacagagtctcggtctgttgcccaggctggagtgcagtggtgcgatctcggctcaccgcaacctctgcctcccaggttcaagcgattctcctgcctcagcctcccaagtagctgggactacaggcgcttgcaaccacagccggctaatttatgtatttttagtagaaatgaggttttgccatgttggccaggctagtcttgaactcctgacctcaggagatctgcctgccttggcctcccaaagtgctgggattatagccatgaaccaccgtgcccagctaagaaaattcttttctttttttttttttttttttttttttgagacagagtcttgctctgtcactgaagatggagtgcaatggcgcaatcttgtctcactgcaacctccacctcccagattcaagcagtttcctgcctcagcctcctgagtagctgggattacaggcatgcaccaccactcctggctagtttttgtatttttagtagaaatggtttcaccatgttggccagacgggtcttgaactcctgacctcaggtgatctgcccacctcagcctcccaaagtgctaggattacaggcataagctaccgtgcccagcctagaaaattctttaaagaaaatatggatagctaaaacatcccccaaacgttttatttttttattaataataaagatagaataaccagaactgacaagaatttgatttaatagtcaatatcataccagttaatgggaatgtaagtaacatgttttgttttgtttttttttttttgagacaagttactgctctgttgcccaggctggagtgcagtggttcctgccttggcctcccgagtagctgggactacaggggcacgctaccatgcctggccaatttttgtatttttaatagagatggggtttcgctatgttgccaaggttggtctcaaacgcctggtctcaagtgatgtgcccacttcggcctcccaaagtacttggattacaggtaaagaaccttttaaaggaaaatttggcccatatgcattaaaaaacattcagacttttaacttagtattctacatctatgactccaaagaaggaaatctaaaatacagataagagttttatattcaaagatgttctttcagttgcctttctataacataaaattagaaaggacaacaaataggcaaatagtcaaagtaatggtaaatctgtacattaaaatattgtatagcccttacaattgacaagaaaaagaaaaactaccatgcagcactattatgacaaattcttgaaaggtagtcaaacttgaatcttatcaagcctctgaatctaactaccagtttagaggaagtacaggggacaggagaacatgttaaatgtcaccatgggggtgcaatcagcaacatctaaaacctaggaaactgtagagcaaacaatgtggtttcttcaggttacaagaaaaaaatttaaagaggtcgggagaacccacagataaaagaaataccaactgatttgtatggatttttttggtggtggtggtttgtttttttagacagagttttactcttgttgcccaggctgggatgcaatggtgcaatcttggctcactgcaccctccgcctcctgagttcaagcaattctcctgccgcaacctcccaagtggctgggactacaggcgcatgccaccacgcccagctaatttttgtatttttagtagagacagggtttcaccatgtaggccaggatgatctggatatcttgatcttgtgatgtgcctgcctcggccacccaaagtgctgggattacaggcgtgagccactgcgcctggccctgtatggattttatttggccattcattcaaacaaactgaaaacatttaagagagaattgggcaaatttgaaatatgtatgtctgatggtattaaggaattattggtgttttaggtgtcatagtggtactatgattgacattatatgaatttgtaacatatgatatctagaatttttttcaaaataatcccaggttgggtgggatggtggtgggggggctttacatagaacaagattggcaatgtgttgctaattattgaagctaggtagtaggtatgtggtgcttcattttccccttgtttctagttttgcgtatgtttgaaaatacccataataaaaagtataaaaacaataaactttaacatgaataaatttttgttgaaaaagaacatgacatacatgagtaaatttgagctatgtttttttgtaatgtagagaaaaaaagaatacaaagaaatatacacagtttaaaacagtggctgcttttaggtagtaagataattcatgagttttctctttaattatcatttatatatgtaaatttatatacttgcaaattttttataatgagcacttttaaatttatttttgttagtcattcaaaattcaaatggtataagaaagatatacagtgaaactagctctacttttcatctctcagttaccctcagatataactagtgttactcatttcttttattgggaagatgcatactgtgtatgtattcttttttaaattgcaaagtgtggtactatacagtgttctcttgtttctacttaacaatgtgtcttggagattgcactatatttatgcataaagaccttcctcattctttcacatcttcatagccagtcccttcggatggagatgcaggtttgctacttcaaatactgaaatgattaaactctatgaaagtcattttacacatatgcaagtatatttgtcggaagaattgttggaattgctgggtcaggttatatgtatatttgtaattttgataacgtttcaaattgctgttgctagagagtgtgcgggcacagtatggtaaaaaattataggttttattcgcattactcttggaataagtgtaattgaggatcttttcagttgttcaagagctattttcacttcctcttttgtgtactctgtttcaagtctgctgcttttccaactgtatttttgggtactttttaaaatagtaaatgcactttatgctttttggaaattaaccttttgtctgtagtataaattgccaatattttcccccagtttttttgtcttttagttttgaatatggttggattttttgttattttatcatacaattctttaaaatgttactaacaaatggatcagtcttctggttttttgtacttgtaccttccttcagattatttacaaaatgatttctgatgttttacatttaaatatttgatgtatctggactatgtcccattattcagttaagaagctcaagtccaacttaatttggtttccaagtggctaccacgatgtcccacaccatttgtcagttcgtctttttcccactgatttaaaaggtcatctttatcatattctaagtactcatatggctttgtgtatgtgtttcctggccttttcattctgtccatggaattgtccatggatttgtctattcacattccagcaccttagtttgaattattgtagctttatcatatattttttaaatttttgtgatgagtcatcctttactcttgaattttcctggcttttttcttgattatttttgcttctcttttaaaaatttttttattttctcaccactatactaacaaggacctttttttttttttttgatggaaagtctaaaatcagcttgtccagttcagtgaaaaatcattttggcatttttattggttttaagttaggaagcattgattttttttttttttttttgagacggagtcttgctctgtctcccaggctggagcacagtggtgtgatctcggctcactgcaagctctgcctcctgggttcacgccattctcctgcctcagcctcccgagtagctgggattacaggcgcccgccaccacgcccagctaattttgtgaatttttagtagagacggggtttcgctgtgttagccaggatgatctcgatctcctgacctcgtgatctgccctccttggcctcccaaagtgctgcgattacaggcgtgagccaccacgcccggccagaagcattgactttttaatgctgttactatatcctctcatatatcatgacaagaccttctgtgtgtttaaatcttttgttttccttgttagcatttacatgtttcctttatttagatcttgtctaaactttctacctttcttataaactttatttctagatttttcatttttattggtgttataaatgcttcgattatatcttgtgattattgttcgtacatgtgacatctaaagttttgtatatatattcattttgtgactactcatcttttaaaattctttgtttctaatgtagtttttcagttgctattctttgattttcaaggtatataattatgtcatctacagataacccttttctttctcataccactaatttttctctcaaataatatagtattttcacacagaaaatatcatttaaagttacgaattttaacataacgcatgccccttatatttagctctatttaagcaaaatttagtgtcctcttagtatgattaggcttctcaaagttgtacatattctgaacttttcaataaacctttaaaagatttttaatgtcaacttttttaaaatcagtttctaaaaatgagatattctcattgaaaataaatatttttattagtgatatttaaatattgaaaaactatctctgctttttccctcagaatcaaatggctatagcatgtggatctcgagctcatttagaaaaagaatcaattgctcaggtgagacttcattaattggcatgggacagccaattaattggcttttatttctttttttatatatatatctggcaagaaactggcttttatgtctaatctcttaaacatgaggttcctttcaaaagaaattaatgttttaattgtggaaaggttatgaaggattggcacattttagaattgatttttttttaagcatatacaagaagatgtggacttcgctttgccttaggatggaagcagttctttttaatatatttttaagataaagagaatctgttcagtaataaaacaaactttaaattacgctttttttttttttttttttttggagacggagtctccctctgttgcccaggctggagtgcagtggtgcgatcttggctcactgggcaacctccacttcctgggttcaagcagttctcctgcctcagcctcacaagtagctgggactacaggcgcacaccgccacacctggctatgattttgtattttggtagagacagggtttcactgtgttgcccagcctggtcttgaactcctgagctcaggtaatccgcctgcctcagcctcccaaagtactaggattaaaggtgtgagctactgcgcccagcctaaatgatgcattttttaaccaatcaacttgcctttatttttttctaacattggcacagttaagtgctttattttgaattttattcagttaaaaatttttttttaacctcattcctcttagaaaaacactatcactataccttaaaatttcacaagtttgcaactgcccttttagggtgtaaaaatgtcactaaagatgttcaattcttcattttgtaggttatgctagaaaaactagagtaacaatttcccaggtccctcttacgcacatgaggctttgagaaccagtagaataaaaggttgaacctttcccccaatgattcggaagagagatatgtagaaattttaatttttaaaaaaggtatattgatgacagagtgacaaaaaccttttaaggattatattgaagtacaaaaacccagactctctttttattttttgtttatttatttttgagacagagtctcgctctgtcacccaggatgcagtgcagtggcgcaatcttggctcactgcaacctctgcctcccgggttcaagcaattcttctgcctcagtctcccaagaagctgagattacaggtacacgccatcatgcctggctaatttttgtagttttagtagaagaggtttcaccatgttggccaagctggtctcaaactcctgaccttaggtgatccacctgccttggcctcccaaagtgctgggattacaggcatgagccaccacgcccggccttctttttttgtttgttttttttgtttttatgagacagagtctaactctgtcacccaagttggagtgcagtggcgcaatctcggcttactgcaacctctgcctcccggattcaagcgattctcctgcctcagcttcccgagtagctgggattacaggcgtgcgccaccacacccagctaatttttgtatttttagtagaggcagtttcaccatttggtctcgaactcctgacctcatcatctgccctccttggcctcccaaagtgctgggattacaggtgtcagccaccacgcctggcctcttctcttttttttagaagtaattattttactagcacctagtctagtattctatgtatcctagagattctcactgatgtttgaaaaaggttaatctgttaaccatagagaatagcacactcctagatatttaaaatgggaagagagcttagaattaatcctgcttcatcagtttaacaacgcacgggggataagaaaaggaaaagtatgtgtctaagatcttcagcacattttatatatatgtgtgtataattataaaatagtatatatatgtataattataaaatagtatatatataaaattgtagtagaaactattaaatactaaattcccacaataggaaatacagctatagccctagatgaaatgtgcagccagtaaagctgatgataatggagactatttaataacatgggataaaacctgaaatattaggttgtttgtaaaaaatagtatgatattataaatacagttatctgtgttgaaataacaaataggctggacacagtggctcacacctgtaatcccagcactttgagaggccgaggcaggcggatcacctgaggtcaggagttcaagaccagcctggccaacatggtgaaacctcatctctactaaaaatacaaaaactagctgggtgtggtggcgcccacctgtaatcccagctacttgggagactgaggcaggagaatcacgtgaacccgggaggcagaggttgcaggtgagctgagatcaggccactgcactccagcctgggcgacagagtaagacacctcctcctcaaaaaaataaataaataaataaataaaataaataaaaatttgtttttgcacactaaaacagctaatgaaaatagatcaatactaatttaatggttttttaagtactttttttctttctttttttttttaaaatatattaatgagatgagaaaggataatctacttggtgaaggaaaaaagatagtttggaaaaatagccaaatacacttaggagccagtgagtaatataggcaagagatagttcttgtatttgttggtggtggctgtagaaaggagccatgtgttttggttttgtttttcatggtgtaaattcttttcacttagaacttgcattggttgaaaactctgaatttttcctagaaatacactagtatttaaatgagacttatgctatggtctaaatcttttacctagtactgctcttagccaggtatcaagggatcaatcgcaggaaccacatatttataattcatcttgtctccatccatccattctttcagctctaaaaccaagtgtttggtttagtgttcttgattcccacagaattggctgccattctatagaaagaagggataacctttgatactcactagagatcattggttgtccgctgcagatgctatgacaactactgctcagtaggcttgttcaagtccagcttattcttatagaatcatagctgtctcacaaaaggttgtctccaagaaggcacaagacatgcatccgcctcatgtctagaaaactgcagcatggctttccatttcccttcgtgtgctgtcagtaataaacccctgcatggtgatcaatctgtggacaatgagaaaattataaaagaactaatcaagatagcaaatgacaacttcggtagcttattgcctaatgttcagaaacatctttccttgatatttttctacatttctcaattattctaccacctcttttactgctcccttggaagacaaacatgacactgccctgatagagtcttgtatcatccttaaaagtgcttacattcccatgtgttctgtataacggtaatgtttatatatggtctggctattcttgaatttatcattttaaaaggattcaaaaatagaatccattagtggttacttaatgtttttagtttttgtttaaagagtctttgcttaagtcctgggacttctttgaacttcttattttaagttaatgaaattagaagtcacctttaaatttcacctgaattaatttcttgtttacattttataaacattgaagatactagcgttaacactgaaacagtgaaaattgttttccttaatgttttaaatggccatttcagaagatcatataagccttctctcttttagtagcttcacttaactaaataagtctatcctatattttaggtatcttctaaattttaagatattttgcaaagttctaaaaacaaaaacaagattatcttgtttgtgactaaccttgttaagcttttaaatatgttagaaatcaaataacttaaggtcttcatgtgaactctacatttttctgctttttaaaaaatagccattatcctaaagcaaacaaaaatcctgttattaacatccaagccagagcagtcatgaatagttttatttgcgaacaaataagctcactcaaatcacattaaaaatcactcaaggagaataatttataggtattgtttttctacctttaatttttatttttctatctttcaatttctatttgttcctttcctaagcataagtgctcttttggaggtttaatcagtcaaccagtatttattggaagtattttgtatggaaggcactgagcaagctgttgtgagattcctaaagtattttaagatgaggtttctgccctatctacttagagaggtaagacatatttacatcaacccataactaatgattctagatgataaatgagaagtgctagatcatttttaaaagtttgttttacataccatatagataagtattttattcttcctttccttcctgccctatttaatacataagtaaaattgtggtcaggagagtaaagtaagctttcaagctttcttcctgtatgaagaacattattgagttcctgttattttctgtgccaaacacttcgctatattctttaaaataatctcatttaatccttataataactttgtgaggtaggcattattctcattttatcaggaaatggacttagagggctgaagtaacttgttgaaggtcaccctgctaattagtaacggagccaggattccaatataggcctcctagtttggtgctttttcttttcttttctttttttctttttttttttttttgagttggagtctcactctgtcacccaggctggggtacagtggcgccatctcggctcattgcaacctgtgcctcccaagttcaagcgattcttctgcctcagcctcctaagtagctgggactacaggcgtgtgccaccatgcctggctaatttttgtatttttagtagagatggggtttcgccatgttgggcaggctggtcttgaacccctgacctcaagcaatccacctgcctcggcctcccagagtgctgggattacaggtgtgagccaccgcacctcgcctgatttggtgctttttctttgttactctgttccactgtggttctgtttggtgttgatggaaaaagccatgcaaaggaagaacgatactaaaaattataattttgaaaagcaaaagccaaaaggaggaagggacctttatcccatagtatgagatattaaatgttctaatagactcttaataggttgcttatgtatgtaagtaacgcatcattacttgagtctattgccttaactaaggaacattttaaaagatcgtgtcttaaagaagctgggtatagtggcacacgcctgtgatcccagctgctctgtaggttgaggcagaaggatcacttgatcccaggaatttgaggctgcagtgaaccatgaccacaccactggactctagcctggacaacagaaggcgtctctgtctctaaaaaaaattttgttattttattttttagaaagatcctatcttttactaaatcttaaatgtgaaagtctggaatccagtgataataatcttatgttcttatgttttaaaatgtgctatgttttatgaataatggaatattctgttactactaataaaattaatcatcagtaacagtagtgaaacttcagatgggattaaaacctacttaatcttaatatccaaagtattaaagaactcaatattttaaatgtatttaattagatctctggcatgcttagaaagaccaggtgtttgtttcaaactcctttctagtccataaccttcatgatactctgctatacatcttctgtcaatattctcattagttaagtatcaactgcaggcttatatctgtgctttgttttgtcaatacatcctggaaactgacagcttttttgaaactgaaatacatgtggggcaaagcagcataaaatatgtaagtaaacaagacgttctccttgctcacagcagcagccccaaacctgtttctcctggtaggctaaagccctggccgcttgtctgactcaacctccaggaaatgagtaactgcttcctagtgcctctactctgctccaagcagtaggcattcttgctgtttctttaatatactttgttggtgaagctcatggaacagtggtgttcttatgtaagatctaccagtcaattaaatattaaaatacagttgtctacagccaggtgttttcagtgtctcctttacagatgaatggaaaagtcatttatattttgtctttgttttcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatggtaggtttctgactggaatgtatccagtctgtcttatgacccagccatcttctaggtaatgagaaacagccctgtatatttataatgaacatgtagatttaaacaaaattgacaataatgtatgtaaacttgatcttgcctttatacttttcctgagttggatcttattttgaaaatacacaaacccaacaatatggtataaagttatgtgtgttcaccttaattgtagacagtagaaattgagtggcctgaaaacattttttttcctttgaagaaaaaagaaaaagctcagaaacatcaaaacagaatagggcacccattttctcttttcttccttctacggaagataaggtgtctttcctaagaccgatcttttgacctctacatctccttccaccttgtcaaaacctaatcctgtccatgtatttcatctcttgtgtattcagccttttcccttccatcacatctttcccagaaccctttccattgaccctgctgtgcccttccagctctagccctgtctccttcacaagcaaccttctcttgaaaaagtgttttatattcactggctttgttttcttgcttcccactcactcctcaccccaccttcttcatatggattttcttccatgcctcatcatttttttttttttttgagtttcgctcttgttgcccaggatggagtacaatggcaggatttcagctcactgcaacctccgcctcccgcgttcaagtgattctcctgcctcagcctcccaagtagctgggattacaggtgggcgctaccacacccagctagtttttgtatttttagtagagatgaggtttcaccatgttggccaggctggtcttgaactcctgacctcaggtgatccacccaaagtgctgcgattacagacgtgagccactgcacccagtctacttcatcttaacatctagccacctctatgtcattgaagccagtggtcatgttaaatgaccacttgtcacacttaacccatcagcagcatttgatactcctgagctctcttttgaaatatactggagatacaggtggctagcactgttgtacagaagctgaaaccctgacatcagccctgacattctccacatgcatatatccaatccatgacagggcctgttgattttagcttttgtgttcctccatttctctccatctctaccaccgccatccagaacaccatccttctccatactaccatgctgtagcccacaaggtctttgcaaacttaagtgtgatcaatcatatgcacctcttctgcttatattccttcatgggcttcccatggtctttagtctggccccacctgtgtctccacatgcggactcttttcttttctaaccacgccccttctcaccttctccttcagatcttccttagggtagcctgccctcactctctaaagataatataattagctcgggtgcccctaattatatcctgttgcagtgccatgtgctgtattcatagcacctatgacatttgtagttttttcttatatttgtgtaattacttaatgtttctttttctcgattaaagcataatctttctccatgagagcaagagtcacatttaattttacttattagtatatcccactatctaatatcatgcccagcacatagtaggtacccagtaaatactgttgaaagaactaatacttagtcatgggttctgtgtgaatcctgttcatgttgggtatctgcatgattatgccagtatatgtccatttttatactctctacaatttttgtgcatctgttttcaaagacctgttgtcttcctagaaatatatgccatataacccccaaaatactactttaaaaaatgtattttcagaattatcattcagactttttaaaatcttgtttttctagattaaaacattttaagtagtctacattagttgtcaaatttagatatgtgtttttattatgttgaaaaataaaataaactcatagttaatagacttcgaaatcagaaaatctaatttaagaaacgactctagaagtaaagccctctgtctgcattagctatttttcagtcagctattgctccagaactagggtcagagatgcaggttctttgtggtttgaaaggaagaatttagaaattgagaatactatttttcgttgttgaggatctttcatttttgttgaaatataaaaggttaggattgataacttaaaaatcatgaagcttccctgtcaggattgttctagggcagcattgtttaatagaaatatgagacaagaggcaaggcatatatgtaatttcaaattttctattagccacatttaaaaagtaaaaagatggctcatgcctgtaatcccagttctttgggaggccaaggtggggaggatcacttgaggccgggagttaaagaccaccctggaaaacatagcaagaccctgtctccagaaaaaaaaatttttttaattagcttggtgtggtggtgtgcacgcctgtagtcccagccactcaggatactgaggcaggaggatctcataagcccagtttaggctgcagtgagctatgattgcaccactgtactttagcctgggcaacagggtaaatcctgtctcttaaaaaaagtaaaaagctgatcagatttacttgttatccaatatatttccaagatattgtcatatcaccatgcaatcagtatgaaaaaagttgaactattttacattattttctttgtactatatattcaaatttacagcacatctcaattcagactagccacatttcaagtgctcagtatcctcatgtgctgaggggctgttgtattagacagcagttcttgtggggttaagttaaagaacattaatggggtttttttctttttttagtgttaatgttacatgcaagccttttatttattttgtgttaattgacataagattgacctcacttagtggctggggatggtggcttacagtggtcatcctagcactttgggaggctgaggcaggtggattgcttgagtccaggaatttgaaaccagcatgggcaacaatggtgaaacctgtctcggtttgttttttgttttaattttattagggaaaaaacaagattcacctcacttaaaattttaactgctcacatttttctttagggtacattatgtttatttggtgcctctaaaggagaaccaccaagtatacatgtatcagcttaatgagcagtatacccttcaccacaataatacgtcatcagtggtttttatttaaacatctttgttcctgcactttaaatcaagactaaagaacaatataagttacagaaaccaagttgtatatctatgccttatttccaaatgtcacctttgacatttgactattttttcttaaggattcattgaaatttttctcagaactttcaagaaatcgaaatcaaatagagtttctaggtactagaaatctgtaaaggagtatacctaaaattaagacttttggtatcggctgggcgtagtggctcacgcctgtaatcccagcactttgggaggccgaagcgggtggatcacttgaggtcaggagttcaagaccagcctggccaaaatggtgaaacctcgtctttactaaaaatacatttttaaaaattagccaagcgtggtggtaggcacctgtaatcccagctacttgggaggccgaggcaggagaattgcttgaacccaggaggcagaggttgcagtgagccgagatcacgccactgcactccagtctgggtgacagagtgaaactctgtctcaaaaaaagactctcagtatctctttggattcagaactgcagagttgagtataggtatgttaagtatatatattcaaatattaatataaattaaatgggtatgttaaaaacaaaaatagattaaaaaattttaagtaatgtaaatttggccttcaaattcagatacatatatatacagttgtctcttggtatccacagtaaatgaattctaggaacatcacccacagataccaaaatctgtacagatgctcaagtctttgctataaaatggtgtactctttgcatataacctatgcacatactctcatatactttaaatcatctctaggttacttatacctcatacaaggtaagtgctatgtaaatagtatgtgtttgttttttgttgttagtgttttggagacagggtctcatgtcactcaggctggagtgaacatggctcactgcagcctctgccttctggccttaggcgatcctcccacctcagcctgctgagtagctgggactacaggtgcatgccatcacgcccagctaatttgtgtatttttttgtagagacagagtttgccacattgccaggctggtcccaaaatcctgagctcacgtgatcctcccacctcagcctcccaaagtgctgagattacaggcatgagccaccgcactctgcttgtatattttatttgtattattttttattgtggttttctactgtttattttttaatattttcagtccatgattggttgaatttgcgaatgtggaacccatggatatggagaaccaactatgtatatagcttcatcttcagagctgtacttcacctaaattctttccatttatggaagttaaaatacttgggccaggtgtagtggttcacacctataatcctagctctttgggaggctgagttgggcagatcatttgggcccaggagttcaagacaagcctgggcaacatggcagaaccctatcactacaaaaaaaaatacaaaaattaactgggcatggtggtgggcacctgtaatcctagctactcagggcactgaggcagaagaatcacttgaacccgggaggtggagattgcaggcaagactccatctaaaaaaaaaaaaaaagcaaattattagctaggcgtggtggcacatgcccatagtcccacctactcaggaggctgaggcaggaggatagcttgagccctgaggtcaaggctgcagtgagcacttgattgcaccactgcactccagcctgggtgatagaacgagaccctgtctcaataataatatatatatgtttttttctttgaaatgaactttgcttcaatgaatactttttatttttaatcagtgttataattttatatattaaatagttagtttgataggcttagaatagtaattccttgccccaatttccactccatagctgtggccactttcaactgttttttgctatttctttgtggtatttgcatttgtgttcaaaataatgggtctgcatagctatttctcagttgttcagttttagatattaatttccaaaagaggaaatcgatgctaagaactaaagttctcttaaagttctgtataccctccacacgtaaactccaaatacagttttaaaataattattttttgtcagtattgatagtcatagctgtgtgaaaataattcacatttgagtgcagcatgattatattacctttcttgtactactttttgttttcccgaaggtaataaatgtttggggtttttgtttgcttgactttactatggatctgttacttactcatgttcaggctctcaagagtataattatcccttactgtgtttaaacacagattctgcatttcttcatttttgctggagacatctcagtcagctcatgtctttctgcttgctctctggcctgtgatacagcttgctccatcctctatctccatttccttatttatacccccatgttagtaaagcacattcctctattaactttctaaaaatatgagaaagaaactttttgattccttgcatgtgaaaaaaaaattgattctaccctcacatttgttttatagttaggtagagaaaggattatagtcattcaaaatggaaatttttcctcagaattctggaaacattcctgtattgtctttggcactccatacttctgtgaaggagtccaattctgaatcttgactcttcgcatgttgtttccacccccttttggaagctttttctccacagtgttttgaaatattataattctaggccttaatgtagttctttttcatgcattttgttgagtattcagtaggtccttctaattttttgtaaattgacaaattatagttgcatatgtttaggatacaaagtgatattatgatttatgaatacaatgtagcataattaaatcaagctaattaatgtacatcctttttttgtggtgggaacatttgaaatttactatcttagcaattttgaaatgtacaacacattattattaactataatcactacattgtataatagatctccaaaaaaaaaccttattccccctgtctgaggctttgtaccctttgaccatcatctccccatctccccacccagcctcaggaaaccaccattctactctctgcctctatgtgtttgatggttttagattccacataaaagtgagaggatatgcaacatttgtctttctggatctgatgcttatttcacttggcataacttagcataatattctccaattccatccatgtcacaaatgacagaatttcttttttaaggctgaataatatttctttttttttttattttattttgtttgcagttgcaagatttaatagagtgaaaacagagctcccatacaatgggaggggacccaaagggggttgccacttcctgctcgaatgcctgggtttataatcccgatcattgtccctccccctgtgctctcaggcgatatatgatttgactatttctttacctcctgctttagcctaatttgtatttcagtgagccctctttacaacctgattggttgggtgtgagctgagttacaagccccatgtttaaaggtagatgcggtcacctttcccagctaggctaaggaattcttagtcggcctaggaaatccagctagtcctgtctctcagttcccactctcaacaggaaaacccaagtgctgctggggagaccaccgctctaaccgcttcctgctgaattggggcgtagtaggggtcatgcagttgagatttcctctggaggggtgccttcgatgccatcaacatcggagcatgggctagcaggccagtccaggggtccatggtagatcttagtcatgcactgcatctggggctccatttgaagaaccacttgtagttttacagcttcaattctggaagagacaaacttaacaaggaggttaaaaatacagggattgaaatgtatggcctgaagtgcaggggcatatgggtgtgggcagtgaaagtggggtttcctttagaaaaactcctatacattggggcatcagtatttccaggaagccacattctccatagaagctcttggtaaggagagctagtggtggtacagcggcatggagggggtgcggtgagagtgaaagggggtaagagaacagtaaggaggaaaatatgacaagggaaggccatggggattggggatctgcgattctagttactttcctcacggttgtcgcttaaagagcaggcacagatcctctagaggttcacaggaatagctagcgttgtctcctggattttcggtttcctttggcagtatccagggtttgactcaagtgtgatgtatccaagactccacaccagccactttaaacgcggttggggtagataaaaggactggatagagtccttcccaggatgtatctagggatgcggaattagagggaagggacttgactaataccatgtctccagggtggaatagttcctttccctcttctcggggacaggcttcctgtaatgttttaagaacttgttgatatttggctaaggaggtgatgtctgcaactaacttggccgtctcttggtcaagcacaaggtcattggttaggagtggctgtctatacagcatttcatatgggctaagtcccgctttttggggagagtttcggattcctagtaaggctgtaggcaacagagcaggccatgcaagatgggtttcttgggttagcttttttagatgtcatttgagtgtttcgttcattttctcgactcttcctgaggattgtggcctccaggcgcagtgtaagtgatattgtatgcctaacgcctgggatacttcctgggttaccgcagccttgaaagcggggccattgtcactctgtaagcctcagggaagtccgaatctgggaattatttcatgaattagtgcctttattgcctcttgggccttttctgtcctacaagggaaggcctccgcccaaccagtgagagtatctacccagactagtagatactgaaatccctgagatttgggcatgtgggtaaaatctagttgccagtgttctcctggtaatggcctgttctttgttctcctgaaggagcttggcgataaggcaggggattatttctttggcacacttcacaggccctgactatctgcttgatagttttgaaaagtcctggtccagtaaataacgatttggccatctgatgggtgctatcaatgcctaagtgaaaggtctggtgaagggttttaagtaatttccattggttagctgcaggcaaaagtatttttccttcttcggtggctagccatcctgaggggaggaaactatgtcctcatgaggtgcctcattctatttcttctgcttagtactggggcttcgtttcctggaggagattaccccatactaggggtccttctataagcatttctaatggagggtcccgccttgtagctcttttggcttttttggcttcaatatctgctgggcggttcccttctatttctcttttctttcctttctgatgatcccagcagtgtaagactgccacctcttaaagctcagctcgagccgtaacaaacacggaccagaggagtgtgcagttgcaagatgtattagagtgaaaacagagttcccatacaaggggaggggacccaaaggaggttgcccaaggctgaataatatttcattgtgtacatataccacattttccttcccagtttttctgttgacagacccttaggttgattggataacttggctgttgtgaacagcgctgcagtgaacatgagagtgcagttatctcctcaacatactgatttcaaatcttttggataaatactcaaaagtgagatttctggaccatatggtaattctgtttttagttttttgagggacctccatacactttcccataatcactatactaatttacattctcaccaacagtgtacaaggtttcccacttctccacctcctcaccagtgcttgttgtgtcatcttttttataatggccattctgacaggggctttaatttgcatttccttaatgattagtgatgctgagcattttttcatatatctcttggccatctgtatgtcatcttttgagaaatgtctattcaggtcccttgcccattttttaatcaaattaattgttttctttctatggagttgagttccttgtatatttgtgatgttagccccttatcagatatatggcctacagatattttctcccaatccataggttgtctgtacagtctgttagtatttcttttgttgtgcagaagctttttagtttgatgtaatcccatttgtctgtttttgcttttattgcctatgcttttgggatccaatctaataaaaaacacatggcccagaccagtgtcatttagttttttccatatgttttcttctagtagttttacagtttcaggtcttacgtgtaagtgtgtaagtctttaatccatgttgaggtttgtttttgttttagttttttgatataagggtccagtttcgtccttctgcatagggatatccagttttcccaacaccatctattgaaaagtcatgtcctttagttctgagaaatgtttcttaatcttttttttttttttttttttttttttcacaatctctgttcattttctctgctctcttacaaacagatgtggaacctccttactagtcctgtaattttatcttctctcttcttttctagttttgatcttttgagatttcctcaattttattatccaatcttctttttgaatttttatctctgctatcaaaattgtaatttcctagaactctttttttttgtttttcagtattaactttttaaaaaacctattcttgttgcatgactacagtgtcttccactacctctgaatatcttatttaaaactttgtcattttctttacctgcattgtttctgttgcctctgattttgtgtttctttttaacactcattcttcacatgtctatagtatggcactaaaacactcagtagaagctgtgtccatgcgcagagcctctgattggtaaatttcgctacaggttaaaccagcagagctacgtgtgagaaagtcccaactggcattgtcttttggacaggtcattttcatgaaagtagagtccttcaatctcctgcctaggagctgtgagcctggctgttagcattcacagaaccaacagagaaaaggcatgaagggaaggaaaatcttagatgttcagtgagtcctacttgcagccccacctgtgtcttcacctgaagacatcagttgaggccttcaatgcctgagcctctggggtgctctgtggcacccttctcccactgtcctgtccatgttccctacaacttccaaggttttttttatttttattatcatttcctcccatctttgttcttatatgtttattccatattgttgtgttaattttgatagggctgcaggaggcagcagtggggttcatgtccatctggtgggtttaacagggtctcagcatattttttgtcctttaggaatctgttagtgagataacagctgtaccaggaactgagtaagaaaagaaaacacagtggctcagcccaacccatatttgcataaacaaatgaaggcatcttagttggagaataacccttatactgtttccccctaataacataaggctctgtatagaagtacttggtattttagttaaaatgtttgcttaggtaacagactgggcacttataatatgatgatatgagctgcatttttttgtatgtgtaataaatgtcttctaaaatgtttaagaggagaaagacataatttaattttgggtcagacacagtggctcaagcctgtaatctcaggactttgggaggtcaagccaggcggatcatttaagcccaggagttcaagacctgggatacataatgaaacctcttctctacaaaaaatacaaaaattaaccaggcatggtggcacagagatgaaaattcaaaaagagggctagataataaaattgaggaaatctcaaaagaacaaaactagaaaagaagaagataaaattataggactagtaaggaatatctgggcctatgctcccagatgttcaggaggcaaaggtgggaggatcacctgagtccagggaggttgaggctgcagtgagccctgattgcgccactgcattccagcctggatgacagagtaagaccctgtttaaaacaaaccgaaaaacccttttggtctaggattttttttttaatataaggtgatttcagttaaccaccccactcttttttactcaattgttttgtgtatttgataagtcactagctatatactgatatccttagaaataatatataataatctttttcaggttatcaagtatcattagaactaactcagcccactagctaatattttgtttttgtgttaaaaggaaagttaagggtaaagcaccaggcttaatattgaaattatttcttttttcataagtatcacaattctaggggacgaaagttttaaaatacaacccacttttgtaagtggttttatcataatacttggaatttaaactatttacctaatggatgattatggtattgtggcaaaaaaccaaaaaatctcccaaattcaagttgtctgggattggagaaatcaaatataagtggactttaggcattttcttgtctgtattaataatgttttacaccaggccctagaagtttgaactgtgctctgtgcagcctagaaagtggggactgactcatggatgaaggcaaaacagtcaaggactttagacagtttcaatgacgatgaagaagatttaacaggtagtagtgcttttcttcctgagctttaataccagtgagagaagcaactagttcagagaaattttgtaagcagaatccaggaaaacttatgagtcaggattcagaacctttaaggaaagcaggtttgacctaagccaaggcactgactgaaaagaggctttaagaaagacctttcgtaagtggaaggaaggatacactggagatttagactggaaatggttttaacagtatatattaggacaagtaagacaatatatcagattcctatgtatgtattaattatacccaaagagtatttcagactagtccaaagtagctttttactttcaatagttgccagtattatattgtgcaggacaccacagggaaggggaacagaaaagacaaggaaggccctggggacactattagaaaagtaatctggatcctctgatggtagaagaaaataggcaaccaactctaaagtaatgtaaaacagtctcaactagagcatctcagagttttgttttatcagctgtctgaatcagttgaaaatgtcagttctttaccttgagctagtccagttaaggttaggattgaaaaccatcaatcttgaaattttccaggattaaattttttcttggaacccatgaggctagttttacctctgtgagtttctgagttgtaatagagatacaatattatgcaatgatattctaaattattatttgacttgaaacttctgaactactcagctttgaattatttgatttctgtgaatctgatcttcagatttatggtataagctttatatctgccatgtaagcttctttaaaacatgccaaggtagagatgtagttgtgttctatttgtctttaaaaataaatatcaatatattttctattttagggcatttgatgtagaactactgtacatagcacagttctttaaaattccaatagcagaaattgctgtcaactggacagaaattgaaggtgagtatattgtttattgtatgattgtcttgagtcagataatacagttgtttagtaaagtcagctggctttaatgttctccttgctcccctcatcaagcccttctcagctgtcttgactcaaagatccagttccaaggagaatagtacctactaataccttccatctggcttgctgccttttatattttttgtctgttcatggggccttcagtaggcctactaccttgtcgaagaaacttcaataaaacttcctacaatagacaaagtcatggtgatctgaaattagaaggttgatagtcttttgagatagataaatttattttttgcatcaccatttcctatattttttttatcactaggtggatattaattaggtacctgcaaaccactatgcaaagctaaataagaaataaaaattttttttatggccgagcaccatgcctcatgcctgtaatcccagcactttcggagaccgagggggtggatcacctaaggtcaggagttcaagaccagtctggccaacagggtgaaaccccgtctttactaaaaaatacaaaaagatggccgggcgtggtgtcaggcacctgtaatcccagctagtcaggagtctgaggcagaagaattgcttgaacccgagaggcaaaggttgcggtgagccaagattgcaccattgcactcccgcctgggcaacgagtgaaactccatctgaaaaaataaataactaaaagtgtttttactccaaatgtccacagtcaatccagagccatttaaaaactatatctgtacatatatccaaaagtataaagatcccaactctataataacttgaaatctatcataaatcttaataattcctattttaaaaggcttagacagctctggctgtatagaattttaaacatattctagttttctccttaccttagaatgaacctaaattaattcacagtgtgggagcagttaacataatcaactggagactttttcgaagtccagctcttctggtgagagtccttgttgcagtaaaccattattgctctgtaacctcagatgtttagggacagaaaaaggttaagaaccaatctcgagattatacaaactgtatagtctaggatgaattcaaacctctttacatcttgctgaatcaaactgagtttacaaaatcttagctcatctccacagtagctgcctagaatcaaaggggattgggaagcaggtcaaaggatcactcaggggtatcatgatcaactttgttgatttgtgttgatctttggccaacctagactctatgggaagatgaggtggggaaaagtaaaagtccattttatgtttagtcatttgcttatttgcattacagagatagttgtcttgtaatatgaattgtaggtacctcaacttcctcatttgtgggatgaagataatttttggccctgataaacgataatgtctctacagtgctttggtggtaatgttttcagaagaaagctgtcatataaattcagagcagtgaaaaaggtcttctttaaatataaagtataattaaaatgataatgaaatgttaaaccttcctcctgatactttatctgcacgtatatactataagtaatggttataagaatctgctgtggctgggtgcagtcactcatgcctgtaatcccagcactttgggagcctaagttgggaggatcacttgagcctaggagtttgagaccagcctgggcaacacagtgagacctcatctctataaaaaaattgtaaaattaggcaggtgtggtgcgtgcctcctgtactcccagctactggggaggctgaggtaggaggactggatcgtttgagcccgggaggtcaaggttacagtgagccataatcgtgtcactgcactacagcctgggtgacagagcaagatcttgtttaaaaaaaaaacaaaaaaagaatctgctgtgatatgtggatcagatatttaattaggctggtgttcttgtgtagcccgagacaaagaggtctggacaaaattatcttaagtctgatcataggctttattttttatcattaagattggatttatgtagaaataatcatatttatctgttgtgctgtatctttagttgtttcatatgtaattattttcagtaatgagcactcagtgagtagtttttttattagacttctagagccctcaccatatgtagtccttcctttctatagtagggccgtatgaaattttcactatttagatcctctcaagtttcatttcacttcaagatgttctgtttttgtttttagagaaaaccactccactcacttcagctttgaaattgtttaactttttggtccatgatttaaaaaattaaggtgctaaaggctcacaacgatcatgtagactgactttaaactgatacgttttctgctgagtttatttaagctaatttgtttttaattatttttaaatcacaggttctaaattagttccattctggagctggctacaaatgggtaaagacctactttttatacgacttcgatatttgactggtgcctggaggcttgagcaaactcggaaaatgaattaggttgtttgcagtcttcagttgtgttcttatgcttcagtgtcacatttcatttcatttgaaactaaaattttaagtaaagctgaaataaacttcttgtcattgtctgcctttt

SEQ ID NO: 38315 - DNA, 77909 bp, Homo sapiens
tgcgcgtcatggccgtcagcaccgcgttcccgtcctcttccgcttggccccagaaagtttcggttctgcccggcggtggacccacgagcgcgtaagtgccgcggaagaccggctggactctgggggcacctgggtcgctcacgatccctgaggcgagagcttcgctcggggcgcggcttgtcacctgttgcccttacagtccccgcccatcccaggtctccctcagaccctgcccgagcgcccccgtccttgcccagcgggccgggaagcacctcgggcaggtggaagccggcccaggcacccagcctgcctctgttggtcggttagaaagacagaccccaaacaccagttccaagaccccggagggcggagggcccgcaaaggaaaggagcccaccatgcggcgtctcagaacaagcctgaatgtcttagcgcaggatggggcaggccccggagttcctgcctgcgtggtctttaggaagtttagtctctggcccagttgggccgggacagcccagaccttcactttgcaagactccgctggtgctcggatctctgccctcttcccaggaggggaagaagcttctttcttcctggcccatcctttggccaagacctattcactatccactgccccttgtgcccatgcgcagggtctcgagctagcccccaggggtcttttcccgaaacacctgttgtctctggtgtggcggcactgcactggactggagtccgtgctgttgaaacctggcgggggtggggcggggaggggggaggatggcgggattttattttttgtaagaaaagcacatgtggttgacacgttaaccgcgtggccccctgttaaagcacatgtattctctgatgtccctgtcactcttcactgttcccattgggtgtcctctccagaaaaaaaaatagaacacttgttgaaactgcctgtgttggccagagcctctcagcccctctgcttgtcttaccacagcagtttcctttcccgacagagaaatgggtcaggggcttttgcggggcagaggatccagggcttaatctgctcactggttctcctgcccgtgcaggccttgtggtctcaggctgcaagcttaattcccctgccatctgcctaatgcggctggagggtgttgggggctggtgtgggggaggggtggggagctggagctatcatgccaaggttttctgctttcagtagttcccaccttctgaagtggacccctgttgagtgagctccacttgaccctcccttctgtgacaaccactgttctgaaagcattgaatgccccatactagttgtgcaccgtggttattatcaccctgaaaataagagctaattgtcacagtgatggatctcagcctcctttgattaataggatctctcctaaaggctcttgctttaggaaatagagtttatctgtttatgttcaaagtgactatctttgtgtagcacttcatttactttttaaattgtttttaatattttattagaaaaataaacatacagaatcactgaaaggattgtatggtgaatatccgtatactcaattcttaatattttactttgatttttttttttttttgcagttactttagagattggtaacagtctcaggcagtgatcctttagctgttgttccgatgacctttgccccttggggctgggtttggagcaccagtataatttcaggagccaagtttttaacctggtcctttttgagggggatggcccccatagatgtttgtgatgagaggaatcacccataacagagcaagatcagagcagctggtagctttgacccatattggtcaccaaggctatggactgctgactcaagaatacaaagtaggtacgcaagaaatggcagccccctcacccccacccaccctgcttccctttaggggagatgtttagctgataggtaacttttgtttactgaagattccaaagacacagctttggtgactcaagactagaatgtctttaaacatgaggcagaggaagtgtgttgtctagctgtggtcttatggtggaaatcactggtaggcacctagatttaggaaccacgttcactgcaagcagccctaggcagcaggtaagggtcattaactggtgcctgtgattacagaggcaacttgtgagcacagatgagtccattatggtcagggcaacatctgctcacgtcatgactgctatgttcttgtcttagtcaaaagataaacagtattttgtttgtgagctcaatgccagtttcaagaaaataagaagtctttattggtataagagcctctatctgagcaattaaataaatcaatagggtgggaattggaatgtttctgtggttctacctatggaaatgctgtttaccttcttgctgttcgttgatacatcacaaaaatggctgaaatgtctgtactacccccataataagagccattgccttggagcaaatgggccccatggctttgagaagaggatgatggcagaagctgtgctcagttaggcaagagcagttttatcccttttctcacatgggagccagtcaacctgttgattttagtaacttccagtggtccttcctgttcacttggatctctgtggcatttgaaaggcaccaagggcctgtttctcattaggccggatgccatttggaggatgtgtacatcagtgtggttctgatgaaagacttaaggagaatctgtggtttgggtatagtattgtggccctgtggctgggacccaagggctgatctggccaactacctcaggaatctagagtactataccctaggccagtcccaggaacccgagttaggggaagtccttagcatacaaaagaaaagcttggaccaaaaaaagcattccaagaaaaccattagcatgcagggggcaaggccaagagaagaatccctatgtgaagtccaggatagggctggatagctgaatcagaaacagtggtttaaaatggagctggaaggaatttcctgaagttgactctgcagccccagatgctttttccagggtatctgtagacttggtcaggagcagggaggggacacttagaagcctcagccactgagaatgtctgttaccccccctttcccacctccttcaagggttgcaattcttaattaattcacatgaaggaagtttacctctcaacattgcatctgaaaaaagaaaggtaggaagaggtcaaatgacttccccaggacagatagagtgcctaaaaatagttgagtaagctaaatataccttgggtctcacccaaccatggcatgatctttgttgcataatacataatggaaagttcacgtaactagtctgattccaaaatctaaatagggtcccatttgacaaaacttggctaccactggtaagagagaagaaaatatcttgctcattgctccaactccagcttcagagccatcctgggtcctgcttgcccctcccatctgcagcatggccccaccttctgcctctctgcacctacgctggcactgctgttgtcatgctcctccccaagaagtgcaacagaacccaggcccaccagcacctcccctccccaggttgccttgttgatggtgtcacatgcacactttcaggaatggagagacaagggccttgggaggtgtatttgtgctagggctgccataacaaaataccacaaactgagtggcttaagcagcagaaatgtactttcttacagttctggaggctgtaagtcccagatcaagccattggcaggtttggcttctcctgaggcctctctccttggctctcagacagccgccttcttgctgtggcctcacacggcttttcctctgtgctccgcatccctggtatctcttgtgtgtgtccagaattccccttataaactcaccagttccaattggatttgggcccactctcatggcctcatttaatcttcattacctctttaaaggccctgtcttcaaatgcagtcacattctgaggtatgagggttagggcttcaacatcgaaatgcggtggggtggtgtgcacaattcaccccctgacaggaggtttgggttagcagggttgtttgtgagggtggcggtgcttttcattttccaggatggggtgaaggaggctgtgggtaaggcttcctcgggaaccgaactgtggttcacacttcctcctgtccacaccaaacccagcgagactggagcagctggccaaaggaaggtgtagggagcatgagctgggcagggcatggccttggcagagggagcagagcattcaaaccctggaggcagggcccagccacagaagggcatcgcagggatgcctgaacataggcagaggggaagaagggaaggaggagggacaagaagatgggcctatccctatcgaggtcaggcagcccatctgtaaagggcctcacaagctgggttaagagatttgtacccatgtctgacagcagtcacctgagctctcaggacaccagaggtctgtttataaagagaggctaggtaggcagtgtggagtagacacacttcatccatccctgaattatattattctattcactctgggaataatagctcacaatatttttacaataattacaacataatgttcacaatttctacatggtgttttaagtgcattattttattcaacatacaaataatttatgctcaataaaggaaaattgaaaaatcagagaaatagaatttttttaaaaatgtgctcatgatggccgggcgcagtggctcatgcctgtaatcccagcactttgggaggccaaggcgggtggatcacgaggtcaggagatcaagaccatcctggccaacatggtgaaaccccgtctctactaaaatacatttaaaaaaaaaattgccagtcgtggtggcgtgcgcctgtagccccagctactcacgaggctgaggcaggggaaatcacttgaacctgggagggggaggttgcagtgagctgagatcgcgccactgcactccagcctggcgacagagcgagactccatttcaaaaaaaaagtgctcttgttgccaccattgaaagattagtagtatttacatctttgtacatttctatgcctcaaagtttagtttgtatggtggggcaaggatctatgtgttttgttttgtctaattcattcattcattcagcagtaatttattgagggctctccatgtgccagaactgtgctaggggaaatcatgaacagcaacgaagtttacagtcaagtggaaagaatagagattcaacaaaaaattaccattgtgacaaatggccccagaagccacagaagcataatgtgagactctgcagtgagggctgagaatcatgagcggagtacagtgtggtaccttgtatgttcacttgttcttatcaaagcacttaccaggcctcaagtgctccttcttactagtttttattggggtatatgttatctatttctcctgctgagcctgagttccttaaaggtcagagctccacccactgccccttttcacagctatagccccggctcctggttcaggcttgcctcttaatcgtgctgccaaaaaataccttttacctggctggcagtttgttagcacacagaagttgcctgctgcttcctcaaggccatgttttgtggctatgtcatattctatcagagattcagttcttagttcataactagctggattgaccccctgacacttcggtcaggagaggtcccagagcatataattttggagatctgtagtttttccccatctaggttgggcctgtattctttggagcaggagtagatgcaccagttgagttcttaattattgatgcagttgttccagagattgtccagattctcatgcctgtcattgtcacctcttggatattttctcagccccacagcgtcaagtacagaggtgtggctcctcccttgagcaactgcccacctcactaaaaaaagacttggcttccccagatccaaaagcaacacctcagagccctctaagtcctgctctctggggtccatggactcgaatagtggctgttttgtatgtgttctgggagagcaaccaaggaaactgctattgttggtggggggaaggggaccaagagaaggttgaagaagccatggcaaagcctcaagttctcattccctttatgaaagagagaagatgacaagcaaaaaggagtgtttgggaaagatgacccaggcatgcagtgggttaacactttaatcataggtccaaggggttgggtcacctaatgagtctttgttcacgtgtgctgaaatgcctgcctctgagctggcctctggcaaactccggagcactctcctagccaccctcttgaagctctgggaagggcagtctgcctgcccactgattgttccagcccctgggccagcaggacctccaggccttcgaagctgcaggtaccagccaagtgcctccctttctgtaggtggtaactagatagttgccgttgggtgtgctgaaccaggcctaggcaatggactcttccagaaaggcttttctgcctttttaaccatccttgtccttaacattctttcttggtcaggggagactttacaactggtaggctcctccttatttgggactgggggaggaatccaactgtaaggtgtcctctctgggtcagcccttagctattgtgttgggagcaaaattttgaaggtggagaaaggttgacttccacgcctccaacctcctcctcccctgatgattcttctttccttgtgtgactactcagatgctgtctgagccagtttctgggcaatattatgagtattagtcacttggaccatagcataaataggtttgcatgagtcagtcagcatctttgtatcttaatttgactaaattgccgttgctattgtttaaggcatttagggcatctgggcaggtatagaaaaaacttggaggtcagagaaggtcctttacttctaaaatgatatctaggtcatgactaggaactcatacagtagtaccaagtgaaaaataagaattttaaaaaatgcattgagtcccttttcctctttgtcagaaaactggatgttttcagacattttggataggcttaaacataattttgagttgttggcaaggaaattcaatgcttccaaagattttataaaacgcatttctctgatatttgaaagagcctgtcagagacagcaacgaaggtttttacatgttgtgcaacaaggactgtgggtttatgaggtgattggcacactgggggccctgtgaggtgtgtgagtcctggagtccttacgctggtgctggggcagccgtggtagtatgtacagagctttgagtgtctcctgagttaggagagccatttgctaatgggttgtagatgtcaggatcaggctggttcatgccaggagtctgtgattccctcaatgaaagggcaagcttatctagagacacaaggaagttggccatgtttggagagtgatcttgcccattctgtgccttttgttggttagtaatgacctcagaccgagacggaggagcaaggagggcaagatgctgagttcctgaaaatagcatccccatggtgaccatgttctctatggaagctctgatttacttcctgaatccctgtgaggtgatgacccagagccagagtggggaagcccaccacaccccacaggcctggcaggcagtttcttagggctcattatgctggtggcgacacaggctctttgaaaaatcagcttgtgtaatgagtggctgggaacagctcaccccacgacctgggaacttgacaccagccaagagcacactcccaaggtcagacagagaaggtctcctgccttgggctcacacaagggcagtgtcaccaaagcaccaagaagtcttaaaggagtgtgttgccatctgtgttcaggcttatgatgctgtttgggtttgcagacattgtttcccttgtgccagactccagttagggctggtttccagaaaatccagctggttggttccttcattgtcctggccgcagcccggatgagttactcaggatctgttgttgctatcacctccttcccaagctccaccctctccacagacatggtcagaagtgtacacacagacccagtgggctgcatttaaagatcacagggtatcactccagtcgtctttctccaggattatttctctcagagactgcaaactcctctgtgttggcagcagccaaataagaggaatgcagttagagaaacagcctttactcttgtgtgcctccgtcccagcatccttttctttttggctctctccagtgactgcctgttcactttttaggcctggccatcacagagtgtctaccacttctcccttccccaagctgaattagattttcccttcctcagatcccactgcatttttttttataaattcatcccaatgctccttttttgtgagatataacttatagttatatgagttgtgacaagtgtatgtttgtcaaatacatatagtcatgtaaccatcaccgtaatcaaggcagtaaacagaattgccccccatattttcctgtgctcctttgtagtcagactctcccttctcccctagaccctggcagctactgatgtgatttctctcctaatgatttgcctttgccagaatagcatataaatgggattgcacagttgtggtggtttgagaggcttctttgactcagcacagggcatttcagattcctccatgttgttttgtatgcccatagttcatatcttctcagtactgagtgcccatgactttttatccatatctctacgtgagcctcttccattgtatctggatatgtgatatttttccatctgtctccttgatgggtagccaggctcttccagggctggactgtgtcttgtgtgcctctgtatccccagcctgcatgtagcagacacttgacggaatgtgctggggcagctgtgtgttgatagtggaggttcttatcctctctggctctctctagggccccggctggtccctgctcaggcctgtgttcagctggtgacctggagagacacccagggatgggcaggcaggcttctcataaagcactcccatcctcagtttggtgtccctgatggatgggtgccaacacttgttgggaggtttggggggttctctgtggctcccctgaagctcttctctctgggactcatgaattcctgggactgtggtacgggcatgtgtctgtttccttcctaagccagagaagccctctttgggccttgtttgcactgagtcacagctacattggctagttagttaaaaataggctctagttatctctgccctgtgataggccctctcctcgggcagaggcaggaatccttatgtaaatatttggaggagcttgtggctggggtggtttccatgccaggatctgcttgcctggactcctggagccacgagggcaaggtggcagtgggagagtgagaggtggcatgtgttagaacactcagggtgttcacattacttgggagatgctggagttcatggtagtacctcgagccggtggaagtggttggtcatttgctgtagtgacaatggctgagtcttaaaaagtcagtaggacttattggaaaaccaccaggtttgaaatcagactgaccagagttcagtctctgtgattcctcgccttactggcccgtggcctaaaacaagttacatgactcctctgagcatcattttctcctttgtaaacagggacgatgttatctgctccaccagggtgattgtgagaattaaaagtgatcatgtgtgtaaagcacgtaacagagccctgcacgcaatagaccctcatttagtgccggctgccaccacagccaactctagtcttgctatctactttgccagcaaacattacaaccttgcactggatatctaagggaagaatgagaggttctgaaaggacgtaggatctccagatgcatgtccagacctctttccaatgtgctcacatctctttaacttctgttggccttcagccctacgggtaaatcacttcaacagctgcccatgtagggctgataactcaggactcaccagctgggagaggactgtaaccaaacttaaaaatagagacacatccattgcctggtgcaggggctgtgcaggcctctggagagaaggccaggcagcatctgcacacccaggctgagttggactctgggcagctggaggcttcaagcctcacgacgaaggggaccctgccaggcaagcccggctttccttggtccagaagttctgagggtatgtgtcctcatcctctcccccaactagcactgcctggctagagactgaccattcttcagagaaagaaaggtggagagggtgtggggccaggtgtgggggagatggggatccttaggcttagcagagctgtctgaagctgggctgcactgattccgtgtagcctttggtataaggggatggagagagccactaggtggctttttaaaggaaagtaaggcagtcctatctaaggtgaatggaaagtgagctcaaaaagataggctgcaatatgattgatctaatttcttgtttagccccaaaccaggtcactgtgtctgaatagaagtgtgtcagaaacaaaccagagagtgcccacagaacaaggcccacacagaaaggtcaagccctcctgttgagggaatacacccagatagggtgacctttgtgcccagagcagagttctctaatattgtcgttaaattgtgtctgtatctgcttcctccatggcctccccttcctctgtgcaggtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaaggtatggtaggttgctgggcaggctgagtttggttttgagggacttgtggcagggctttttgctgttgccagttgaaattcaaccctttcatttttgttcacacaacgagtaattggagtcctcaggtcacatcatattgaaatatttgggtctcaaatatccaccttgtgtaaggcttggaaagcttgcctggtttcctttcagagaactgtaaagccagtttgtaaacaaaatcatacacccggctccaggactgggtctgatttccattagtgcacacatgtgtgttttgaagctgcctgttaagtctttggctaaatcccaaacttctgggctctgatgaagttggcttctttggaaaagaatgttctttctcccactgagcaggaaggacagagacccacctatcttgttttgctgcccaactgggtcctggctggcggatggcccattgcctgggatgcactgtaggtccagtcctgctgcctcccagacttccctgagctcagcgttgtccactgagagaggctatgacttgtatcccttatctcactggagaaaagcaaggcagaggaaggtgcagataaagtttcatagactcaggagaaacggactattttctttttggctgcaaattccaagtttcactctttcagatgctgtcccaggggtcagagtttttataagttttccatccccactcatcaccagtgctgacctttaagctcttcggagctctaggacacttgatactacacagtctgaagctgaccacttcctccatgcctgcagagtccgctgtgacacttttctgacagactaaaggcccaggcttctaactgcttgggcaccacaagcagttatctcccataccaggagccattggcctagcatggccacagtgcagttctcattctgaagttccaaagtcaacaagataaaaaacattttctcaggcttttaatcttgtgtctaccatgccttgggcctctgatagctaacaatttcatggcatttcatgtgcaccgggcactttctataccaacagcctggcaccagtctatgctcctaaccactctagtctactttcagctaagacattagatgcttttttaaatctacacagagaggcagagaaagtgaaatgccagtctctgcaaatctgagtttgccactggctttaagaggtctctccataaagtagatagtcttttctgtgtttcaatatctggttcttgaggataactttgagacctggaggtccttattgggagggaagagggtgaaataggggaccctcaggtagagcttctgatctagaccattgtctatcctatgtaccagctgagtctggccacccccaacatcctgggctgatttcaatgtcctttacataggccacagagcactttggtgggaattcttgaaaggtgccactttctcagtaccctccactttcatctgttggtaaacgtcttaataagcatacaaatctacagcatctaccatgagagtggagtgtccttaactgaggcatctttgtgtggtacacagccttcactcctctgcagggcagcccacttatcctcttggtgacagcagtttcaaagactttggagtcaggcaggggtgtgctcagcttctggcttctcttttaaccctcgaaaatgttggacaagtcccttcacctttccaacgcacagttgcttccttcatgtgccaggtgggtttgatgataacacccacttctcaagattattgaaagaatcaaatagtaattcctgcaaagctaatattacttagaatatcagagattagagctgaaaatttcatatttcatatccagagtctactccttcaaagtttcaggagttcccagatcaggttgcgagtgtttacctggcctgaggaggcaggagggtggaggaggaaggctctttgtctctcccaggcccctggctcactggctgtcagtgccagccattgcagacacttctagcaaggtacagtggacaacagtcacttgtaagaatcagtcccaagaacctgtctccaccatttgctaatctttgcctgaggggtcgtgttgattacattttcagccatcttaggcttggcttcagtcctggacaggtctgcttcaaaccatggttcttgggagcagggtttaggaatttaagaattgccagagaagcagatagttttgtgaagcacatcccaccatctctgctgggaaaaggttttccaggatctaaaccaaatccagtgtctcgatagtccctctgtcccacagcagaggcagtgagtgagagtcaaaggtgggttttcctcttttctacacagggaggtgaattatcttagaagttaagaggtgagctctggagttagacagctcttgagaaaaccagggttcttattccagctctgctgtttgccacccatgatctttggccaagtgctctgatttctctgtacactcctcatctgcaaaatggggataatcatagcagacttcatagattctaaattgtacttttttttttgacattttaacagctctgaaactgtaatgtatattataattaattgtatcttagattcatcgaaataaggcaatccctgcctctcaatgccatattaaatgagaaaaatacatgtaaaggcccagcccctcaaggacactcagttaacagaagcaggtgcggttgtcattgttggaattgtgattgtcactactattatttgcacatactgggtattctgatcctgcgcttacctataatgagcagtaggattatagtgaagaacctgaaatgtggctagaataaaggtaaagctttctggaagtcagtattcagggactgaattgattcatccacacagcaaacatttgttgtccagctactatatgcaaattactagccctgggtggtggacagacaagggtgaacaagaaatgtgcccagtcaacaagcattgtaaagtatctgtgagctctcaggacatttcaacactccctgacttggagttatatctcatggatacttacatacccttttatgtttcagaggtgctttgtatcactgaccacttgctcctcatgcttcctggattatttctgcttctctgtctgagtttagtcactatctggttacatgttcctatttgttgtcttaaagatgctgtgacagaactaagcaaagaatttcaggaagcaggggaacccatcacggatgacagcaccagcttgcataaattttcttataaacttgagtatctcctgcaagtaagtgatgcctgtaatgtgttgatttttgcactggtatctcttttctccctcttgggtgactcatcagcattcaagatatggttcagaaagcccaaggagccagtaagccctcgtggttagattgaaggtcagagcagtccccagtgccagctcaatcctccaagtgtgatcctttggggaattgcaatgttgccccttaggatggctttgagaatcaagaacatcctttagagatttaggtcattgtaaggtaggtcagaaggttactgtatggcaaagatcttaactttgggacagttacatacccctttgggagtttagtgaaagctatagagtcttcccaaaaagacattcgtgtatgtatacacacaatcacgcatttttgcaggcagattctaagagtgtgtggaccctctaaagattatccatgggcttctgttttagagctttgctactcaatgtgcagtccatagaccagcagcatcagcatcctctgggagcttatttgtagtatattcttggctcccaccccaacctactgaatcagaatctctggggtcagcccaggatattttcttttaacatattgatggtataactcttatccctgcttagcccaaaaagtgctgatgtaaaaaacactgcagatgtggaaaaatgcatgcaactaaaataggcaggaaagaaatgctgtagaagttattttagggtagtggtattaggtgttaaatttttttctatttttgtgttttgttttatctagatatcctaataacatacgcatatcttgcttctgtaatcagaaaaaaaatgctataaaatgttatagaaagatatacctgtgtcattgtgaacaccattattttgcaacgtcacatcccaccaaagcacgtagtatgcgggcccactagaggaaaggcccctaacgtgctgaagggcttgcctctctcatgacatttcagctggttctttaacattgtaaaaatgtttttgagcctttctttttttcaattaagcccattttggttttgggtttgaaatgactcagagctgacatttatttaaatttattgtaggtgtattaaaacgatattgaaactgaagtgttgagtaactgggataaaaggtcattatcttatttccctaagtcgaagcatagttaacactcttcatattgcccttaagactcttttctttttctttttttttttttctttgagacagagtttcactcttgttgcccaggctggagtgcagtggtgcaaccttggctcactgctacctctgcctcctgggttcaagtgattctcctgcctcagcctcttgagtagctgggatcacaggcgcccgccaccacacccagctaatttttgtatttttagtagagatggggtttcaccatgttggccaggctggtcttggacccctgacctcaggtgatccacccacctcagcctcccaaagtgctggattaccagcgtgagccaccgcacatggccaagactcttttcttgtatttctttctcatccgttaataacaccttcggtggttttccacccagctgtatgaacagggtattaacacaccttgatttgccaataaataaaaataatgccaataaagggcctcacccagtgctggcacctaagaagctattgttattatttatcatttaaatgccggaatgaagagcagtgggtttggacctcctctccctttccctttccctacccagtttgatcagaaagagaaggccaccctcctgggcaacaagaaggactactgggattacttctgtgcctgcctggccaaggtgaaaggagccaatgatgggatccgctttgtcaagtctatctcagaggtaagctgagcaagcagccaacaacttcatgtcgtccttttgcctgcttaaagcagctcttgcagagacctttgctgcagacagctaaataaggaagtgggagtttatgggtggtaaagaaatctagtccaggtatacgcaatgcccattgttgcagtggctcaaggttggggaaaccacttcagtgagtgtttatcaaggggaagaatgctgagtcctgaatgtaccttaggccacaacccgcatgttacttaacagggtggcctattcacatacattgtagtctgctaatggcagcccttgagatgtaaagcataggatgactccatctttttaaaaaactcattttctgagataaaattctttagagtttgctatgctgctttccctacactttgcccaggaaacttagatttgaaataagaatgatgtgggatctcaagagacatttcttaaaacagtgatgtgccaactttctactttaaattctgcgcccctcaagagcaaaatgccatggctttgctgttttacaaaactccagaacaggccgggcgcggtggctcacgcctgtaatcccagcactttgggaggccgaggcgggcagatcacgaggtcaggagatcgagaccatcctggctaacacagtgaaaccccgtctctactaaaaaacacacaaaaaaattagccaggcgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaaactccagaacaacaaacacacacacatacttcacatacacactcacactctcctttctgtttattttccaccctcaacccccagagaatctttcttctctctcctcagcctattccatccaggagtgcagaactttgcatatcagggagcaggtaaaccccttgatttgagacaggaggtttgtacatttcttctttcttttcagtaagtgtgaagtcagtttaaagtcaacacacctgctgcttggctggctgcccacaaataccacagcctaaggtattctgggaagggctcctcaccaaacacgccagctggagctaaatgactttcttcttatagagaatgatggtgttagatatgctgacatcaatggctggacatttcccaccatttgcactctctgacatctgagacgatgaggaaggatcctggctctaaagggctggttctgcgagtttctttaatgtccatgttagtgtggatgagtcttgtgaggtctggtgggatacttgggtccatgaagtagagcagtattttaattttagtgcatcataaatgtggaagaggttctctttgtcactctcctctcttcattcctcagccgctgcatcagagcaactaaagcctttaactttatgactttggacagttgaagtctggaaataaatttagttttagtccgcattccccaggattatgaaatgcttgctaaaacacatctactttttggctagtttcttcttcttttctcataatgcaaacagatctttagacagtctgaagccatgaaaattgactttctagaagcaaaaaacattccttgcttgcatgaatgttggtgttttagtggctggcataggctctgcttcccatagggtccagtttcatctctgttgaagactgctctctggggcatcattggttggaatggcttggaacatccctaggctaagtgagttgctggttacttggttaattttaataatcaagtagccatctgggtctttaactgagagggcaagagttaatggataagaagcatttgtaggttccctcagacccctttgaggtaggcggtagctatttaggctaaaataggtgaaggttctaagaaaccatttctggagattcagtatgggctcagcttggactgtgtttcactgtgatgagggtgtagctcggcatcgggctcttggcacaatgacctggtttaaagcagaatcagctctcctgtaccctgcagatttcctgtcctttgctgccattgtattgcttctctggatagtgtatgtgggttctgattagaagctaaaaaaaattaaggaattagttaatgaaagtggatccataatctcaaaacataaaaaggccatgcagcattttgatttgcagtacaaaggaactattgttcccttccccctaaaaataccttttaaaataaatagttccctttatatatatatatatatatatatatatatatatatatatatatatatatatatatatttaattcagttaatgggcctgattaaaagtatagcctcaaatgtttgccattaaaaaagttttgatgttctaaaggctggtataatggtaagtttgccaaaaataaggacaagttcctgtctttgggagcttacagacctgggctgtgatgtgagggtcttaatgaaattctgcagggtgtgtgtttgtataattgacatgcttcactttacaatgccttgctcacctctttccaacggcctgaatttcctggttatcaccactaaacactttgttctcacctcaatcgtcagtggaaaactgatttagacaggatataccatcaagattctcccccgcgcatctgctgagatcgtctatctgcagacatgtcatggtggtttttataaagccaataaaccaggctgctgcctgccttcacttccaggtgtcctggctgtacccaaaacatacatggggaaatgtcttacagcttctgtagttaaagagagttaacacctttttgttttttaaaactacttcatatggtatcatttccttgagtcagcagtaagaagaaatatagttctgagctaaaaggtgctatacaccaggatgtttaccccattgaatcaggaaatatgtggtacagcctcaatcactggcatttaatgccaatatttcctgactcaatatagtgttggaattaaaatttgaatagtatgaggtataggaaccctctggcaaaccactgctcccccttcccccatcacatatacacactgtaaatatttctgacctttgaaggggtggggagggtattggttccagcttaccctacccagagccagagcctgagagagcaggtgcttgtggtaggtcaggaggttttgaattcctgcctactttcttgagtttctgggctgacctatcaggaatatgaatcctaatttgcaaacttgcccaagtgtcttctgtggctgtcccttttattccatccgccttggccattatatgctcccagctgacagagccctgctttgcagcctcatggcagagtctctgaccaacatatcccatttccatcacaacaagcttttgagtggtgaatttaagcctcaaacagttacggtcacatctccttcctctgaattggattttaggtataagctctgtggggagaggttttgaagacaggcctgcacctgggccttcctatgccatccatgccaaacttgtgagacagacccatatccattttatccttagcccagtgtgactgggctgcctagagacacccctggtctcacccctgggctccttctgattcaatgtagtgatttggcatatctgataaagaacaggaaatccaaccaggaaagcgttggcagacttgtagattttactgatggtttcatggaacacagatgaggcagttacacggccgcactcacgcacctctgcccttgtccctcccttcctccttctgcacatgtttctgccaagccctttaggcccttcccctgcacctgttccccacgcaccttaaaaacaaaccatcattagctgagctgagcccatctcttcctcctcaagctgacttctggtgtgagaagtgcttcacttacctacctccaggttttactctaatataaaactgagttttatttggttcctatctgactccaaacccagagattctgatagagcagaggagggaaagtgacattccaatagaatccacagatgtttggaagcctcttgttaatatgttttccatgatatgtttgctggagtctgcagattattctcagatgaaggcctgcaagtagttcacccacttcaagccttactctctgcggtaagagtatcaaatgtgttgtgtcctttgaaggacaacgtatagggtaaaattgggtgacattttttgccctgtatctgtgtttcacaagccatctatgagaccaggtctgtatttggagttaggctgacagctctttggctctatgtaatctgctttttccagctccgaacatccttggggaaaggaagagcatttattcgctactccttggtgcaccagaggttggcagacaccttacagcagtgcttcatgaacaccaaagtgaccaggtaaatacaggacagggctggggtttgggatcatcccgtgcagaaatgaactaaagttcattaataataatgacagctgcaacagtagtgctcatttgtgtcccccgtgacactgcagactccttccacatatatcattgtcttccacccctcctcccaaagtccttgacacatgtgggcaagtagcactgtgtttttataggtaagtgaggctcagaggggcttaatgcttttctctaggcctcacccgttactctcttaactcccgataccaggcattttccctggtggatggcatgtccttggtgccagcactactggacagacaggttacagccttggcctctcagcagaatcacctgtggggcttttaatactactgagcctgcgtcctcacctggcatactgagtgaacacactggagactggtgggtagccaggactgggagccactgcagagctcaggtcaggtgtgcagtcagcctttgtgcgggtagtgctgaagcctcaaaagggaagagagaagggaggagagaggcagggattgagtctataaaggggagaatgggtgtcagcttagaagctgcaaatcaggtaccagtcaactaaacctctttgggttttccagcatctcttggcccctttccttttggagtattccaaatttttttgaatctaaaaaaaactacaaagggaaaaccttttgtttcattatgtcaccttaaagattgatttgcatagagatgtactcatatttctcatgcatgtgacaggccttgtgaattgatgtgagctgaaaaagtttgcatatttgatttgaaggttattttgttttagatgtttggtgaagatcgcacagttcacagacaataatgtcccacttttttgcccacgcgggagtgcagtggcacgatcatagcacactgtaacctcaagctgctgggctcaagtgatcttcttacctcagccttcgagtagctggataggcatttaccactgtgtctggctaattttttactttttatatagacagggtctcactatgttgcccagcttggcctcaaattcctgggctcaagtgaaccccctgcctaggcctcccaaagtgctaggattacaggtgtgagccactatgcccaggcatctttttcattttgggcaagggttggggtagggggttggggtagtcttaacctgtcacacaggctggagtgcagtggcatgatcatggcttactgtggcctctacctcctgggttcaagcaatcctcctgcctcagcctcttgagaagctgggactacaggtacatgccaccatgctcagctaattttttgtgtttttttggtagagatgggatattgccatgttgcccaccctggcctcaaactcctgggttcaagctatcctcctgcctcagcttcccaaagtgttgggattacaggcatgagcgactgtgttctgatgcatctttttaaaattcttgttactttgcctgaaatgaaacaaccactacctcaaaatgcagataacatttattttattttttctcaccctgtcttacggtgctgaaccatttctgaatagtttgttccttggcttttaaattggtatctggacagaaattagcagtgagtttagtgtcccatattgagttctgaaaatggaataggtagtaatctttcaaaaaagaagttttctttctcctacaattcccctttcttggcaaataattgatgtttaaggtttcccatatcctttttgagaagtagatatgatatatataataaatgaataagcatccagatcattgcagtaatttctttgaagaagagcaagcttatttgagagttatgttcttctaccatgaaaatgaaattggtttgtgtgcctgtgtcttttaatttagtaacctgagttggaattcgatgaggcagagccacagtgggaggactgagtaaattcatactttatctttattactcttataattgacatgtttttctgcagtgactggtactatgcaagaagcccctttctgcagccaaagctgagctcggacattgtgggccaactctatgagctgactgaggttcagtttgacctggcgtcgaggggctttgacttggatgctgcctggccaacatttgccaggtactttgaaggattgcttggtttaaaagacaggaaaagagacatttgaagttttgaagattgccaccagtctactcaaaacaattttgcttgctcagtaaattacacaaacctgttcaactcttattccagctccttttacagactttgttgaatcatgactaacaataacatctgaaggctccaaccttaaaccaacttaactggccagggcatgagtcagtggagatgtgtattgcaaaagccaaggctttaaaatttttttaaggcacttgttgttacgggcattgggggaggagtgggctttttcccgtgcctgttcttatggagttattacagaaggctcctaagcagtaggagaggaagtgaaagccacagcttgtccacataagggttgcaggaaaggttgctgcatttttgtttcttctttttttcttttctgaggccatcaagccagccatatcttacaccagtgtggcactcacataccaccagagtccttacatgagctccaagaaggaggtgtgaggaacaggctcagaggatcaggggacttgacaaagtcacctagctggtgggcagcaggcctgggacacctgacttgggttaaaatcaagtccagtgttctttgttttgttttgctttctgtttataaggcttttaaaatttaacattcatattttttattaggaaatacttcatgtatagagaaaagtggtgactatgatagtcacatgcaaaccactaggatttaattttgccatattcagatgtcctttttttatttttattttttgtagggacggagtcttgccatctctcccaagctggtttgaactcctgggctcaagctatcctcctatcttggccttccaaactgctgggattacaggtgtgagccaccacgcctggcccagatactctttttaaaacttttacattttgaaataatttcagaattacagaaaagttgcaaaaatagtacaaagtactcatctatccttcaccctgattccctagttatcgatattttactataattgttcatcattttttctatttacatgttgatttatttcctaagccttttgagagtaaattacagacttgatcctcttttctcttaagtacttaattgtgtattttctaaaatcaaggacatcctgttatataactcagtacagttattaaaatcagaaaattagcattgatacaatactgctatctaatttacagatctcatttaaattttacaaattatctcagtaatgtctctcataatctaaggtccaatcccagatcacatattaattgttaattcattaattgctatgcctctctagtcccctttaattttgaacagtttttcagtctttgtctttcataacattgacatttttgaaaaatacaggccagttattttgtaaaatgttccttaatttgagtttgtctgatgtttcctcattattggatttaggttaagtgtttttggcaggaataccttacctgttgtgtccttgtcagcacactgtatctggaggcacacagtgttgatttgtttcattactaatgaggttaaccctggtcatttgggtaaggcggtgcttgccaagtttctccaaaagttactatttcttcctttgtaatgagtatatatcttatgggaagacatgctgaaattacattattatccttttttctcttaaatctgtcctgtattagttttaataccatttgatcattcttgcctgaagcagttattaccataataattaccagagtgattttctaactccattatttcttttacattattagttggcattctactgtaaggaagatctttttctttttccccatttattcattcatagcagtattgactcatggattcttattttattcaataggttgcattctgtcactgtcattatttattttgaagcttacattatcccatttatccaattaccccagtggggagcccccttcaagctggctcttgtggggaggtttggttacatctgatacttttttaagaaataaaatattatagatcagctaaagccccaccccaatgccatcctttctcctttgttcccctttcagaagtaatcatgtaatcaatgcatttcattctcagatcttatgctttcattattaattgtgtatttgtaaatattttatatatgtatatatatatagttttattttgtaaatgttttaaaattttacacatgttgaatcatgtaatagctatcctttgcaacctgcttttttcattttgccttgtttttgagattttgtatctgtttatacatggagttctgtaagtgtagagttgggttggcaaagcacagcccagagggctgtgtggaacacagctttgcccatttactcacctgttgtccatggctgcttttatgctaacagtgccagttgagtgacagagaccatatagcccacaagaccaaaatatttactatctggcccttttcaaaaaaaaagaatgccaacccatggtgtagagaattctgttgggtgaataagccacagtgtatctctttccatagcagtgtagagtttgtttggtttccctttttccagttacagtgctgccaagagcatccccactgtctccttatgtacatatgtgactgtcttcagggaagatactgtgaagggcagttgctgggttttggagactaggtttgaacacacaataattttagatttaggagatgattctgatgaagtaaaaatgtgtttcgtttccagtgttcctgctaaacgagagttatcacacaagcctttgtatttctaaagcagtgccatccaatggaactttctgcatgagggaaatgttctgtatctgcactgactggcctggttatgtgacctagaagcaggcctcccagccacactgttgctgtgtcatacagagcgggcagctgagcccccaagcacagtgtgactcttatttaccaaactgactgctgcttgttcctcactggcagacaaactgaggcaggcaccaaaagctcaaggaaaatttaaaccaaatagtgggaaatacatgttcacttaattcttttttggcagtgggaggaaagccatgatggtaaaactctagccatggaatttatctgttacagaccagtgtagctgtgctctttggtggaatctgttggctttgactttcttacattctacctgggaaggcagccccctaccaccacctggttgcctagtgaccagcaaggcctccatgtgttaggtttcctgctctgaatacaggtatgtctgttttgtggccccacaggaggacgctgaccactggctcttctgcttacctgtggaaaccccctagccgcagctccagcatgagcagcttggtgagcagctacctgcaggtaaggccaggaaggctgggaattatcttcctatagcttctaccagggtatgtccttgcccctagcaactcaagggtgatgttctcagatgcccgttgttccagccagagcaatagaaccactcagttatggctgctgttcccgggagtctgggtttttcaaccaaatagaatctaggctctcttaaaattacattcttctaaatgattttaaagtattttaaaagaagcagtttagcaccgtggttaaaagtgacaagagtcaaatcctgattctcacctaccagctgtgaccaaggggaaattacttaaccttcagctctctcatccacaggatggggataataaaactcattctagctcataaatgaggagtgcgcatgcacttcttaagcatatgttaagtacttacgggcttgacatatgcaagggctcagtcaatgttagtaggtagtggcagtttgttaattttttttagaaatgtgaatttatcacagctgtatatagttctgtggaaactgaatagcaattaaaaaaattaaaatgatcaatataaggagcattaagagtagaaaatagatgaatcttttaccttattttgtggcttaatcatgccaggagttgcagttacgggtatggcacaatgaatgaacaacagcttagatataactgaatttatctcagagacaacgtccattaagttaataaggctgaagaaggctggatgggaaatgcaagtctgtatctcagtggagctcacatgggtggcctcatagctttggaatgtgctgctgaatctgtggcagatgctttgagcaaagggattctagtcttttgaatagttctttagactaaccttagggcaggtaatgcctgtatttttacctctgctctcattaaactctaaagcttttctaaatagccctgtagcttcatcctaaagccacttgtcttttgtgttttccctcccagactcaagagatggtgtccaactttgacctgaacagccccctaaacaacgaggcattggagggctttgatgagatgcgactagagctggaccagttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaaggtgcaagagggcagccaggaggaagagctccggcaggccaacagggagctggagaaggagctacagaatgtggtcgggcgtaaccagctcctggagggcaagctgcaagccctgcaggccgattaccaggctttgcagcagcgggaatcagccatccagggctccttggcctccctggaggccgagcaggccagcatccggcacttgggtgaccagatggaggcgagcttgctggctgtaaggaaggccaaggaggccatgaaagcccagatggcagagaaggaggccattctacagagcaaggagggcgagtgtcagcagctgcgggaggaggtggagcagtgccagcaactggcagaagcccggcacagagagcttagggctctcgagagccagtgccagcagcagacccagctgattgaggtcctcacagcagagaaaggccaacagggagttggcccacccactgacaatgaagcccgtgagctggctgcccagctagccctgtctcaggcgcagctggaagtccatcagggggaggtccaacggctgcaggctcaggtggtggacctccaggccaagatgcgggcagccctggatgaccaggacaaggtgcagagccagctaagcatggctgaggccgtcctgagggagcacaaaacccttgtgcagcagctgaaggagcagaatgaagcccttaacagagcccatgtccaggagctgctgcaatgctcggagcgtgaaggggcactgcaggaggagagggccgatgaggcccagcagagggaggaggagctgcgggccctgcaggaggagctgtcccaggccaaatgcagctccgaggaagcacagctggagcacgctgagctgcaagagcagctgcaccgggccaacacagacacagctgagctgggcatccaggtttgcgcactgaccgtggaaaaggagcgagtggaggaggcactggcctgtgctgtccaggagctccaggacgccaaagaggcagcctcaagggagcgagagggcctggagcgccaagtagctgggctgcagcaagagaaggagagcttgcaggagaagctgaaggcggccaaggcagcagccggctcactgcctggcctgcaggcccagctcgcccaggcagagcagcgggcccagagcctccaagaggctgcacaccaggagctcaacaccctcaagttccagctgagtgctgaaatcatggactaccagagcagacttaaggtaatcctagcttcaaccacttgggctctacccctctccctgggcaggcctggtgggtccatgggaagatgcacctttagccatgaggcaggtgagggctggagaatgtactgtgggtgcaggcaaacaccttgtggccctttcctatcacagctcccagtagcatctttctctctgcaggaatatgttaggcgcagaacattgggagtgatgccttagcccagaagtttaaactcaagaccattgcaaacaagattagcccacacagaagtttgtaaaactagtagccaacattgaaagagcagggtgtttacaaatatagtttgagggcttttgaaagcctgcgtcctcaccttgcccccgccctgtggcagcagtcagcaggaacctgagggtgtctgcccactttaaaggaggcacacatcctctgcacttttccttacactggtttctgtacttgcccagccccgccgggcatgtgagtgtgagagccctgacttggcctctaaaacccctgcagagggccagcagttcacagctgcctcatgtcctatctctgagttcttaatgaataaccaaccccatcaggtgctctcctgacagcagatacagggaagggaacaagctcacttcatttttacaaggcccttgggacagacaagttaatgagatgagcagttactatgtgcctttgatagtacacaaagatgaggggttaaggactgtctagagtgaagacagcgcagaatggcctggggctttggtttccagggcttgccactagtctgtctgcatcaaggtctgtgcactctcaggctactcctaaccctcctctctgaggcagctccaccgcagtgccacagatgtgcctccccacccagtgccaccccactccgtgaaactccatgtggcttatagccaactttttcccttgcggaaattaagttctaagtttggggaccaggctaagtctcttttcttagtaagcttgaaagtgtttcactattaataaacccaaagctcattgaggagccagtttgcagggaaaaagagaaagttagcttggttttatctgtttgggtgagggggctgagggatcctcagagcaaggaccctacttttatgtcctctttctttcttgtcctctctagaatgctggtgaagagtgcaagagcctcaggggccagcttgaggagcaaggccggcagctgcaggctgctgaggaagctgtggagaagctgaaggtaggccctggtagtgtagacctgtcagggagagggcatctggtgtggttttgactggaccatttaagagggctccctgcatgcctccagattcccaagctgaagccgtcctcagttcacctttgtagacaccctagtttgtaccctgaccccctccatccattccctggacacctggccggagctgccaaatgcagaaaggaaataagtgtcctctttggccatctctatgggtgatcgccagccagtgattctgaaatgggtgggagcaggggtggcactggatccacagtcttcagagcagtgacttgttcaggtgaatcctgctccctgccacccctaccttcagtgttaccctgggaattctggtacctgccacttgccaaccaccacaactagttgcagttgaggccccacaaatatagagcagaggttcatggcctcttgaacttaataggaaacaaccctccatttagaagtgacccagccagatggggtggatggcacaccagccactttatggtacgttgcatggccttctgcaagctgagtgtcttctccctgacgtcctgtgccaggccacccaagcagacatgggagagaagctgagctgcactagcaaccatcttgcagagtgccaggcggccatgctgaggaaggacaaggagggggctgccctgcgtgaagacctagaaaggttagtcacagtccacctacgtagctgtcggtagtcttcagggaaggagtgtttggtctcgtcatttagaaagtcagtcactcatattaggtttaggaagtccttttgcaagaaaagccacaaactcagaaagtgcttctgctggaagcatgccacagagaacctggttgcctgcccatcacaacctatacacggctaaagcacctttctcctaactcaattttcttctctctggcagtgcatatcatacttcagtaactgcaagctttggaaaaactaaaatgaaataaaagttagatcataataataatggtaatagtagcagcatgtatttaaataatgctgaaaacgtggccgactctgttttgaatactttgcatacatttacccatttaatcctcctaacagtcctatgaggaaggtgttatcatctatccccattttatggatgaggaagatgagtgtgccaaggaccaggatcagcctgtctttgtgcagactctgatgccatatctgtggatagcagatcacgctgccacccaaggcctccttgaccccctcattttcaggcttggggccatgtggagttgtgagcctaagtccaccatgtggtcatgggacacagctagttgagccaggacctgattaagaaaagatgtaacagggaggaagacctgattttaaaaaggtgtagcagggaggaggagttgctggaatcgaattgcatgtgtgccaccagcaaagataagcacaccaaattgtcccaagtctctaacttttctatttatctattacctcttcccaacacctgccttctaggcctgggctctggctcagtaggagatccaggatatctttgacatttggtaacctggacatacatttttcatcttacccttctagtgttcagatcctacagggcactggctgcccttagttaagtcatgttcatatgacaatttaaacagagtctgagttggtggcatgaaaacatgataaacagtggttttttgtaagatctcagagcatttgtttcagttgctcaaagctgtacagtctatttgccaacttattttattcagtgtgtgtgtgtggtgtgtgtgtgtgcaagcacacacatatgctgcctgtgtgtgtgggtgcacctataaggccattttggtggacagggtctactaaacaacttcctggcaactttatactagatgtggaaggtgtaaagtaatcagtctctctgcagaaccctttgtttaatggagcttttattatgtcccactggaccatccttggaaaaccactgccttaggaaatagctgcattaaaaatggagtgggtggggtgaggaagacagcgagattcagccagctccctctgctatagactgagacaccctgcagcacccaaaacggaattccctgggcctcaggggggctatcaggtagaacagctggcagtgcagattaagactgagtgcctgctgtgggcccagggccatgccccatgtgtagagtcccaaggacgtgtggaagacaggccctcctctgtgtggccacctccaggaagctacacctctgtcctgcctgtcctgactcctttctcctcctgcccatcctccccatcaccagcccatgagccttgcctatcaggcttctcttgcaagcccagcccctgtccaggagccaaggggtgcagagttctattcacttagggtgcttctggcaacctggggtcagcctgctttccctcccagaatgcccctttgtatgtgggggtgagaggagagtctcaaaagctaggggactgcataagctgtgagcagataccaaggggctcccccatggcggagggcagtagcacccctcattagagtcctgggtgagcttagagccctgggaaagctggaagtcctggctaatcaagaaaacttaccactcctcccccaggacccagaaggaactcgaaaaagccacaacaaaaatccaagagtattacaacaaactctgccaggaggtgacaaatcgtgagaggaatgaccagaagatgcttgctgacctggatgacctcaacagaaccaagaagtatctcgaggagcggctgatagagctgctcaggtgagtgctgtgtcaaaccagcagctggggttttccccacactggggtttttctctaaagaaatgcagctgttcttgaaagcatacttcagaaatttccccactttcttgctgctgtctcaggagcccctctctccttctccatctcactttccccagtactagagtcccaaactccagcgcctgcaggtaccaggcagctgatacaagtggaagcttgtatcaggaggggactgtgagaaactgaggacacagctgggctctgcttctgccatatgtcttggcctagaactgccagaccaccttacttcttgagagaaggtggaaacctggatcttaatgtgaagtgtcctgattttttaatgctgacaagtcattcaaaacttattttaacttttccttatggaaattttcaaatatacaaaaatggaatcatgtaatacacctccaggtacctgtcacccagcttcaacagtgttcagctcagggccagtcttgattcatctgtagacccacctgcttacccaccttcccagattattttgaagcaaatcccagacatatcatttcatccataaatatttcaatatgtacctctccaaggtaaggactcttttattttctattttttgaattttttttttttttgagacagagtctcactctgttgcccaggcttgagtacagtggcgtgatcttggctcactgcaacctcttcctcctgcattcaagcgattcttgtgcctcagccacccaagtagctgggattacaggcacacaccaccactcccagctaatttttatatttttagtagaaataggcttcaccatgttggccaggctggttctgaattcctggccccaaatgatttgcctgcctcagcctcccaagtcctgggagtacaggcatgagccaccatgcctggtgccagaaccctccattttaaacaaccacagtgtccttattacaccttaaaaaatgaagtataatttcttaatatcatcaagtgtctagtcagtttcaaatttttccgattgccttagaatattttcaggtcgttctaatcaggatctaaattagattcatctattgcaattgctgtgtctcttacatcccttttagtcaatgggtttccctatcatctctctacttttgccgattgcatccccatggtgtcatttaacatgatcatccatcccttgcatttcctgtgagtccatagttagaactattgcagtggttctcaatcctggctacatattagaatcactaggaaagtaatttaaaaatgcccatgtccaggccccaccaagactaaccgaattggaatttctgggagtgagactcagacaccagtgagccagagctgagaaccatcattctactggcagcttgcttagactcaggttcaaaattttggtaagaagccttcatagaattggtttgtagtttggggtctttccttcaagaggcacatacaatctgattagccctgtttttgtgatgttagcagcaccatggatcagcaaagcctagatatgctaattcattaagtgttagaaaacagtgatattaaaattataaccaatttgaaagtttaaaaactctgccttcttatcatcaatatacagagttagaactcagggtatttgtgacctgaggggtgtgatggaaaacaccagctcctggcagcattccacattcccaaagtttgggtggaccagcctagagaatgaggctgcttcagagaatgagtcttcctgcttcctgacaatttcaagtgtccttgaaaaagccagccaagcccatgttcaagcttttttatttaaggcaaaagatctggggttgattgggagttcctggtcagtgatggagcctgtctctctcaggacctgagtggctcgggtgtcacattaccggtggctgaggtgctgctagagccacgttagccctgaggatgctagctggggctccatacgagaaagaactaaacttcacatgtcagaaaccatcaagcctgaacatgctcattagtatccctgaggaagcctctgttcacatcctccccctccagtgcatcaggcacattctgacactgccagacctttctggaaagcctcacacttctttgagtctggcttcttggagtgaccttaccatctctctgaggggcagaggaggctaacatctgatcagattttcacactaggaaatctttgatcttctccactgattaattgttacttggatcaaccatagaaacataaagggccccaagcacattaagattcaggtgggaagtacattcatggtccttgggcttactgcacgccgtcggcatggcagcacgttttagcttaaactcccagtggtcccccagcactgttgtttaggtgcctgagtggtggctctctttggtgctggcagctctttgcatttaacagtgccttctgtgtacatcttttgcctcccgcatgttctcacacatgcggtgtcagttaagtctgcatgtcgggggagatggaggagacttagcatgggctggggcatatttccaaggtgaaagtgaattttctttctatgacttaggaaatttgataccagtcttttgaaatgaagaaggatcatcctattgttttcatggattctctctccttttcttccaatgtggttttgtcccagggacaaggatgctctctggcagaagtcagatgccctggaattccagcagaagctcagtgctgaggagagatggctcggagacacagaggcaaaccactgcctcgactgtaagcgggagttcagctggatggtgcggcggcaccactgcaggtcagcagggagctcgtgggttggcaccaacaccctggtggggcccaggaccagagcagacagctccaaaagaggactctgtgataggtgttggcaccatggctgactatttaggaagagcacattgcgttttggctttaagggaaccaggtaaggaaggtgtattagttgggatcctaacaagacactcagggctccctgaaaggaaaaaatacagagatgtggatggagttagggggccccgcagggatggggcatacccagagactagcagttcttctaccattcctatagggaccagaggggagcagcattactggaagccagcaagagctggcctgaaacctcactagaggaacacaggcagtgccaggggcatgaaggccagagaaggatggataaagatgaatctcgggctgggctgggggcaggtgcagaataatcagcagagctgtgaaggtctgtggtctcttagagccttagcttctgagatatgggaggcatacctacaacttggtgccagggaaggtgggctcagccacactttgtctccctgcctcccaggaccttaggaagtaaaccatgctttcaccaagctgacaagaaggctttgttggaatcttatgaaatgagctcatggccacatcctaacttgggggcagagccaggtctgatgagagtcacatggcatccagagcccagtttgggtgctgagcagatcacacaagatcatagtgtgtcatcctcacagcctgggcttgttttgttcccaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggtcagtctcctgctactactgcctactatgttctctaggtgccacttcctcccctaccgatgttgtggctagttagtgctaataagctgaattcagtgttttctaaacttaggtattaaagaggtgctaaaatatattaccaccaacttgagactttcattttgatatattaggattgaaagagaattgaaaaaggaataactttgccctgataagattcagtgtgatttaacctgaagtctatgtacctgttaatgcacattcatgaaatacaccccatgctttggagaatgccgtctaccagagctgcagccttggcatccagagtaactcaaggctaggagttgtgtctggaaccatccatatccttcagtctcttcctgaagctcgctcttccttcatgtccaaggaggatgtaatctcctttgtgtcctcccactcagcccagtgaaggaagtagagtttgggttctgctgcttcggttttgagcacaccctagcagacaggcctgggctgcccttccgggcactggactttgaatgtggaacacagggaggcagagctgagacggcacaggcagaagtggtctcagctcgtctctgctcgagcatcattgccatctgcagctggtccctgtgaactcctccttggcctctgcctggatgcaggccagccagcctttagaaatactgtccattcctcttttgtttgagtggattaccaagtggttggcaggccccattatgttgttgggtacaaagaactgacaaggatggggagtgtactttgcacagctttagtttatcttcttcaaatcttttgcccattttaaaatgttttttaagtattgaatgttgagagtcctctgtatattctctatgcaagttctttgtcacatatgtattttacaagtattttttcccaatctatagcttatctttatattttctttcaaagagcaaaaaagtcttcaaagagcagaagtttatcattttaatgaggtccaatgtatcaggttttttctgttatgcataaatgtttttctttttgttgtcatgtctggctttacttagcccaaggactcacagaccttcttctgttgtcgcttagaagttttacagctttagcttatacatttaggcctatgatgcattttcagttatctttgtgtatggtgcaaggtatgaatagagattcatctttttgtatggctgtccagttatttcaacaccattgattgaaagactgttccttgcacctttgtcaaaaaccgaccttatttttttttatgctgccatgagaaagtaggcaattgaccttatatgtgtggatttatatctggacttttattctattccatttatctatgtgcctattctttcactaataccaaactgttatgatgaccatagttttataaagcatcttaacatcacgtagagtgactccagttttgttctttatcaaagtattggctattctaggttttttgtttttctatataagttttagaatcagtttgtcaatttctacaaaaaatcctggtgatatttaaattgagattgcattgaatctctagttcagtttggggagaattgacatcttaataaaattgactcagtccatgaacatgatacaactttctatttatttaagtctttggtttctctcagtggacatcattttagatccctgctgtctgctttcccttccctctgccagccttacaaggcaggttcaggagtgtggctgaattgatggaaaaaaaaacaatccctggccccttttttcagcctatgcctcaagctctctattacacagacttgaaacaagaagaagaacttcacttctaaagcagggcctgccttagtggtcatgtggcaggtccaggtgggaactttaagctcacctgaaccatttttcttgctaaacaccccaggaactttgcatgggcttgccctgactcattagtgaccacagagtgctgcggtcacttgttttgatttttgacatttcctgtctactcatttatttatttatttatttatttatttatttatttatttatttttgagactaagtcttgctctgtttctcaggctggagtgcagtggtacgatctcggctcactgcaacctctgcctcctgggttcatgtgattctcgtgcctcagcttcctgagtagctgggattacaggtgcccgccaccacacctggctaatttttatatttttattagacacagggtttcatcaagttggccaggctggtactgaactcctggcctcaagtgatccacccaccccggcttcccaaagtgctgggattataggcatgagccacagcacccagtgtttttttcatttttgcctcaaacctgctctcacatttttccgtgacatatgctggagagtgtttgtgggcagatgactggtacaggaacatttctacagtggccttcctactaagtggtttgcacagtcggacacaaggcccctggttggaaacccagtgcctgctgcaagcccttgagcactgggaggttctttcccacgcatcagtggattaagggaaaatgcaggtcagacagactcctgctttcaaaaatacatgaataagtactgcctgtgtcttacagagcaaggatttagtggcatagaagtgtgttttctgttattaggttctttcttaataagatttttccttctaaataagggacctcagagaatatgcaagaggttgaaacctctctaagcccctgactttgagaagtctcttaggttgtacattccatttcgtctgtaagccttcctctacttttttggaatgttccagcaaccaaccatttctctcaactctggacagaatagctgtcagttgagtgaccacttaaattgtgcctcagcagcttgttctgcatagctgcactctctcactttcccaagggcccttacccagcctatgcataacagtgtgttgtgtctcttctctcctgatctgcctctgctgcccaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacagtgagtagaggtcacccccatttcctgagtgctcattacaggcctggcccctgtgctttcttatcaaaggatgaggaaagtgagacactggaagcaggattgactgtccttgcctaagggaacagtgcttgcgatggccttgaagagcatcggcgctcgggaagttgtcagtgttgagccttgcagagagttcctgagagatgtcagtggccccaggtttcagcatcactattaaggcctgtctttcttggcttgagcgactatattagtttgcttgggtgctatataaaataccgcagaccgggtggcttaaataacagaaatttaccttctcacagctctggaggctggaagtgcaaggtcaggtgctggcagggctggtttcctgcaagatgcttctccttggcttgcagatatctgcccccttgctgcctcttcatgtggctgtcccctgttgcatgcccctggtgtgtctccatgtctctcagtctcctcttcttacagacactggtcgattggattagggcccaccctagcggcatcatcttaacttaatcattcctctacaggcctcatctccaaatgcagtcacagtctgaggtactggtgcttagggcttcagcatgtgaataattggggcatggggagacgattcagcctataacagcaacccttgctgggccgcccttggcaattgctcagagcaacatgctgctctttaaaagccttgctcccaggcccctgtgctcctggtcttactcaccttaccacctacccacctggcttgctgagtgatgaaggcagagtatggcttagtgctaatggaatgaagcatgccctagggaccactggactataggggttgggagaacactgcaggctaatactgtcagggaacgcatcagagcaggggtgtccagtcttttggcttccctggaccacactggaagaagaattgttttgggccacacataaaataaactaacactaacaatagctaatgagctttaaaaaaatcgccttaccccccccaaaaaatgtcataacgtttcaagaaagtttatgaatttgtgttgggctgcattcaaagtcatgggctgcatgcggcctatgggccacaggttggataagcttgcttcagaggaaggtgttccaggaagggaaggcaaggcccaaagtcacagaggcaacagtgagtaggggctgtcttgggtctccagtttggtgattggattggctttgtccatgaggctccagcacggtgagtttagttcatcttttggaaacactaatcaggcttggcgaggatgccatgagaaaggaagctcggatttagttgcaattgtctctgatagatgcgccctctcagaggttcctttagctgcagataaacccactcaaagcctcaaagttttagcagtaagaaaaatatggacaggcctattactctgtaccctgtggaacccaagggactttccactcacctagcctgcactttgccctagcactggtattttatgctgcttttaatcagtgacctggatccactgaaccttcctgactgccgcaagaatgctatagcttacacaggcagagcaggcttcagagggacaaagcagccacggcaaggatatccttaagtacttattctcccttggccttctcatttttctagtgtagctatttgccaacaaggttttcaaggagagtttcacaaggtcagtttttaaaaatatgagttgtataaagtgccaccatgttaaaatgtcaagagtttatgacatgggacccataagaaaaggaggtccttgcttgatgtttctcagtctgtgttgtctggctttagagcagtttacaaaaaagcactggctgttcagaacctcaagaaagaatttatgtgggtcccaggtcccagacgtttcttgacccattttccctctggttaaggacattttttatgatgctcctgcctcaacattgagatctgtccctcttttcctgcccagaattcagaggagagctaggactgctctgtcagattgatcattcaggatttctgctgcatgtctttaatcttcatgacgctgccattgtaagggacttcgggcttacatgtatctccacaaccctctgttccctgactagagaataactgaacttatcatgttatagcttcatggataaagccagcctgatcaccaaactcaccagacccaagatcatgtctacttctgtcacttctgtgactttaggcttttcctttccttcctgggacacccctccaacccctgaccatgtaagcctgcagtgttctcccaacccccatggctcaatggtccctggggcatgttccattccactagcactaagccacactctgcctccatcacctggaaagccaggtgggtagatgataggtggtaaagtgagcaggaccagaaacctgggggcctgggaggacattccggcttgaaattctcttcttgcttcctctagcctgagtgagaaagtgactatcctacagctctctctctccttacccctcaccttcccctgcccagtaggaacaaaaacagaaggcattctgactgctgacaaatatgtgtggtttggtcttgggaaatcaggaactgttccagggaaaggaaactgccagtgtgctggtcttcggccaccaaggcggatctgggactaactgataggaacctgtaatccctgcacttctgttagggtgaagagccacccttccaagtcagttaaaggctgcgttgtcagacactttttttgtgcattagctagagataaacccaagcatttctggtagctttttcctacatactttttcttcctaagttttaagacctaaaccaaaaacaccgagagtctgagaaagtgtgggagatctagagccctagatttgtgtaagcatccctggcaagaaacttcgggaaaaaataagcaaatccaaggtaagaagggatccgggagagattaaacactaagtccaaattcatgaggaatattaggccacttggaagtagtgttgttgaaagtgatgctgttgagcgcctcccttgcaccagctgctcttacacgtgacctcactagtccctgtgcagcccatcagggagtggaaattatctcattttataggcaaagaagctgaagcctcaggaggctggataacttctgttgttggaggtgccagaactaggctttagactccagtccactggcttaagattcatttggaagagttcagctctcttctctccgtcccatgtccgcattttgcccatctcccctgccttcatgttctctctttcgcacatgtacacagttttggggctaaggaagttgtttgccttgcccctcctcctggcagagatgggtcaggaaggggtcccaaagtccagcctgccagggagatgtggcctgatgctgggactccctaagcaacctcctagtggtccctgtgcatggctcagacctagaatggtggtgcagagcaggaccacagcccctgacttctggagaaaagatggtattcgtcatagccctccagacacacccatgcacaaccccttttcagtcattcaggcccaccctccaccatctacactgaccaggtgtccagctgttctctggactgaggcagagaaggaaatcaagctcttggcagctggtgaaccaggcctgtggagtaagggctggcaggggcactgggctgtggctccctcagcctttgctcagcctctacccagtcatggcctccttgaggcccggcctccccctctagctaccagatgagcagacagtatggtggtgaagagcttgagctccagaaccaaacatacctggtctgccacctccaggctccatggctctaggtagtgcagcccacaaactcagtttcctcctctataccgaagagactggaacagcactcacccctaggggtgttaggaagattgcatgagaactgtgtgtgtggagcactgagcccagcccagtgtctaatgcctgggaagactttcatggagttatgttgctttcctgatgtgtcatcaggggctgagctgtgtgtgctactgctaccacctcagtaccttgcactgcgcagcccagtcgtctcctgcaaagaagatccttcagatacccagatgaccctaagtgagcttaaactctcccacagaaacattccctgaaccctcagagcatctttaccagtaattgcttcagaactggtgcttcatggtcagagtgtttaggggagctgtggtagatttgtcacccaccaggagatttgatgtttggtatctcagaaacaaaatgagaacaggatatggtgaatggttaaggttacaaagccaccttgcgcgtgggttgacccaagatctctgccttcagctgaatacagaggtgacaggtaccctgtggcttgtcagtggcaggaaaccttcttggagccaacatttctgggcaaagaaaggctgtttactgagattgtagtcctagctctgttgtgtgagctttggcaggcattaatctctctgaactagttttctcatctgaaaatggggatgatagtgccaggccttctacaaaatggcattagttaccagggaccaacaaggactaggcagctggaagggggtgctgctttgagagccccttggaggaggaggccagagtgactgccctgaccacttctgggccccatcctcttcgctttgcctccacccctccagtaggggtagctccaggcttttcccttctatggcaccatctcctcagtccagaacacctacggaggacacctgggcccctagcacccaggtagcccctagagtcagtgtcatcttgtgttccccacatctcagatgatgtggccattagtggcctctgccatatctctgaagggattggagcccataagtactgcagccacccccaggtgttgggaacttggtagggaaagagcacatcctttaccctccaaccctgaggccacaccaaggcagtatggactcaagcagagcccacacccagcctcatcccctcccccaaggcctctgatgccatgtgctggtgtggacaagcagaagggagagccaaatggaagggagaagggtgggctgagattgggaactggctctgccccacacatgacctcagtctcctctgtggaatggagcctgtaccaacagcatcttctgcttcctgggctgtgatgtggatggagtgagatcaagacgtgaaggccctttgtaatctgcatgtgctgtgcccgcgtttattcccctatccaggggaaggggttggtaaactgacatctactccaaagagtggcaggtaagggcccagacgcataggatcaattagtggctgaggaggcagggaaggcaaagaaagattttgctgctgtgctgttcctggggccaggcaggcagggctttcctaagctacaaaaggccagtgcagggaccctgggagggggcgggcacctggtcagggaaagccccatggtcccagcgctgcttttctgttgctgtggccaggcaggcccaagcatggtgcttgcagtgtgctggccgtgctcatgagcaccccaggagggaaggccttcatgagccagtggtgtaggtggtgaaccagggcttgggtcaggggtactgcatcccctgcacaggggtacatggtggtggagctgtcactgaacactgtcagagtgagcccagagcctgcattctcatcacacctttctgcatctctccatggggactcgtggaaatgctgcagggccctgtctcctgactctacttctgcctctgtcccttgggccgggacactgtcagggataccagggactggtggcccctctgtcagaagtgttccaggttaacatgaatgcacaaagggggaatgacagaaactctctttgaaagccacttaaaagataaatgtcagccttgtcaccctaaaagggcagattttgtagttggaggaagcactcggaggtccatgtggcctgagtacagtaaaactctgcttgtagacgcatttaggcatgtttatgaaacagtaggtaggatcatgtgggctctgaaaggcccagcctgtgctcagctgcaccaggtgcacatggtatgccacacacctggaaggcacgatacaaaccctccctcgcctcgctaacccacggagctgacatggagggcttccattttgtgtcaccagttcttgtaagaaataataactagtgctattttttggaccttttctccccaaatgcaaactgtgccaagtgttttacatgcagtgtctcaggtattcacaccaacccatagaggtggtgctgttatgatccatgtttcaccaaaaagaaaggaaacaggtgctcagaggctaagagattcgcccaaggtcttacaaactggtgagtggcagggattcagctctcgtctattcagccccaaaaccacactgttaagtcagttctggcctacttctctgcgcattctacttagctgttgtcagttggttctccgtattttggtgagtgattttgggatacataagcccaaaaaacatctttaagcctattgaacagactgccaggatttaataaacatgcataaaatctgacatttaaaactatgcctcatcctgtgaccacattctggaagttaaacaaatgtgccccacactttggacaggaggttagaaaccacagtgaaagagcagggtcattatcactggtgtattccatttccgtgatagagcaatgccatgaaagtttacgacttatttcccgggctctgagcccaaaagtaacttttttgtatattccaggcataccacattgaaatagaatgtgccgaagtgtaaaagtagtttggagactttaacagttttatttcttagctatgaaactcatatgctagtaatatatgacatatgtgtgtatgtgtgtgggtatatacatttacatacgtttgtgtggcagacattggaaaatttcatttttaaaatgcaaagccaccaaagagtccacttcagaaatgctgcttagattcattacagtcttaaacgctgttttgcacatttttcaagcattccatggaccactggaattatcagcctcttataattcagttttgcccattcatagtccctggtgctagttattctggattaatcaaagcaatctgaacatctacctatacaaaagtcaagccccaaggtgaggcagagcctgatctcatttctgtgaggtgcctggtggtgccagcacttgttttcactgctgctctgatctacactctttgcccagtagtcagaagagccttctgagcttgggcacccagtgtgccacctaccatcaacagctttgttggccgtgctcacctcttcaaccttcagccccagtcccaatcaaggagaacctgagatcataggagtcacatgtcatcccccttggtttcagcattcttggagatggaggaaggaaagtccttaaaaattttagaccccctacttgggctttcagcatgagtgttcaagaagagaacagtacatgttcatgcctgagaagaagcattccaaaccagccagagtgtctgataacttctccatgagaatgcgcaagctataaacaaagcctgcctcaccacatcaagagggcacagccatgacttgcaaattccagagcagcttctcgaaaccctggcaaggcctataactggaacatgctggtggcctccacattgtgggaggcagaaaaagtcttggaattgtcctcagaagatttccattgatgtgagaccccaaggtaagggaggcaaccaatgtccttcacaagtttccagaagttctttcgaaacttcaggctgacaaaggcatagagcacagggttaaggcaggccctcaggtatgcgatggcctctgtcaccatgatggtgtagtgaaagctggtcatggcatagtattcccagtgtgtgctgcggatgaacttcatgaggttgaagggcatctgggtcagcaggaacacagccatcaccaggaagatgatctttagagatctgtgcttctggaagcctccagcatgaagcagtgttttgattatgactgaatagcagacaatcatggtgagcagtggcaagaagaaccccagtgtcatctgggtggcaagaaccacagtggaaattgcctcgtcatggtaaccacatatgagcttgtcgagattaaagacattgccatagataatttggggcaaggaaaccagcagggatatcacccagatgagcaagctggtgaccttgccccaggtcatcctcttggcttgctggttgtaggccttggtggccttaaccactacaatgaaacgatccacagtgatgcaggtgaggatgagcatggacgtgtagaagttaatagtgtagatgcccagtaggctcttgcacatgacctggccaaacacccattcatggatgcctgcataggcccagaagggcagagtgcagacaaacaccaggtcagccaggggtaggttcaccaggaacacatccgtcaggctctgcaacttatggtagaagatggatatgaccagcaccagagagttccccaccagaccacagacaaacaccaccaggtacatgcagggcagaaagaccttgctgaactgcaggaagtcttgatgctcctcctggctgctgtcattgaaactgctgaacccatagtcttcatggtaatcatgctctgccatggtgtctgttctgatgaacacctgtgagtcagaacccaggaattatatttggggctgaggatggcattctttgtcttcctgctatcccattgaccacatttagggggcaaatagtcatcttctaaacccacccactgggatgtgtagaaacagcacagtccagtatattgaagataaccaattctgaggggaaattgctcagacaggatgaggactctccattagcctgaaaattctcaggatctcacccatctgggagacaactcataactgacccctaagcacattccataaaatcctgtgctcaattattttgaaaccaaaagtcgctttgctgccaggtgggcacagtgctgtttggaagagcaacactgatgatggatggttgagcccactgataatatgagctcatcaatggaacatgcctgttttcatctccccctgcctcaccacagttgcccacccatcctgagccccatttcctaataaattgtgaaagctaaagcaagtgcccctaccagggggctctcctatcaaggagactcctggagaccacaggtgtttggggatggcaagactgctctgcctgggtaggtagtccttcctgcctttacttcccctcaattgcatagattttcaaaggctactaatggggaaacaaagcatagaaaagcccacgactgcccagcactttggctgagctggcttcatggttaaagcattgggtggttctcctcacttcccaactaaactttccccttcatcagttaacacagtttatggcattctaccatcagagcctcatttcctgaagacttctgaacaagaagtctcttaaaaggtagatttccccaaagcggaaccttgccttagctcctgtgattggcaggttaggacttaggggcctcatttaacaagcagaaaacccaattgaaatgggatgccagatgggcaacctttcttacccagggcaccagcccttcaagatgtcacttctctctgacccttccctctgccctgtgaccctgccaaagaccatggacaggacaagggatcatgtaacctgtggtgtgggagcaggggcagctgcggcaacatcagcccatgagtgccaagtctgcccttgctacaggactgcagatactcaacatgcagcagctcatttccagtgacctggagccatgtctggccagcacctctagaagatgtatgaagaagagcaggtgtttggacagaatctctgccagcaaagtcaaaatattgcctgaccagacaagtgcatataaacgatgaggttacctttcctaatccactcagaaacacttctgtcgctgactttgagtcctgactgggagcagtgtctccgatgctgctgcttgcctctgtctttccagggaccaaagtgccctttctctctagcaaggaaggatgctgcctttgggctaagactgcttaataaaaatccttgcccttacgtcacaattgttagatctctaagggtgataggtcagccagtagacatcctgccccccacaagctctctggggcactgtattaagtaggtcagatgatgtgtatgtgttattgattcacatgggcaaaaacatattttttcatcatttaaaatatgaaacaggtggctttgctcttaagaataatgttcagctccccattattgcttgactcgctctcgcctttttttggtatcttcctgttccagcttttgctggtcccttatgctgccattacacatttcctcaaaggacctgtgcaaattcatgtgtaataattggtaaactttgatgtataataattggtaaacagattgggcctggacagtgctgtgcaaatagagtatgaaaaattactttcccttctaggcgaactaaaaacattcatttctttatcctctataattaaaatcctattttgttttctgaaaattaaaaaaaaaatctacaactttggaagtagtgtaaaagtctgataatgatgaagcaaattacaattcatacataaaatagaatatacttaaatgtttaggaagtatttttactgattttggaaaatgcaatacagttaaattgctaagaacagtgtaaacacaaagtaaatatgcaaaataagtattaactattactattacaacaaatagatgtcaaaaggatataaaattgtgattcttaaccttttttgaccataaactcctttgagaatctcctaaaaactgcagaccttttctcagaaataatgtatatatatatacacacacacacacacacacagacacacacgcacacacacaaacacccctacaattctgggagtccatgaaccccttgaatccttctgccatgtattctgtgggccctcacataagagttcatgataaactatgtgattttaactgaccgtacttttagaaacctggaaaaaatgatcacattttattaacagttggcctccagctggtggaattatgggtgacttatttcttcctttttttaaaatagttttcaaagtttctacagtagtatgttgatttatattgaaaaaagaacataaatgataatctgataaaacagcctgtcttatgcaaaagaaatgaaaacagagattattcattgagcaaatatagacaataactagattctccttatctccctgggtgggtctgactatgccattactagcagtaccatcagcctgcaagcactaactgtgtgcctggaaacatgttcagtagttttcatgtttctccagtttaacccacacagcagcaaatggcagtgatggaatttgaacgaagagcagctgagctccatagcctggcattttgcactgtaccctactacagacaggaatctgagaataccaacaatacctggggttagtcctccctgtcttcttttcaatataaagagtaaaacaaatgactcaccagcagagatgctttgccagtttgttccagagatgagcttgctcatgaagcaaggtctgcctctacttctgtgatgtggttcatgtttccgctgaacattttttaagagccctcagctggttactataagagacccaccccctactcccgtccttcagatcagaatccatatgaccaacccgcccctgtgtaacgcgtgggtcagagatggatgggtgactgataccccacactcccttcattctgctttggggctgattcttctgtcagggcctgacgagctttattcgtaaactaaaggggaacaataaggaggtttggctctggccatccaccgaagatggtggcatttgtaccttaaaattacttaattcactagtcagacatctttttggaacagttagggtctgggccaatgctgagtccatggtatgggctgggttctgcgtgcatatgcagctccagcatatgtgatagctgttaagccccatagcagccctgcagtggatattatcctgcctttatagatgagaacactgaggaccatagccaaaataacaagccctggtgcacacagctagaaactggaaaatcgaagatacacactcaggtatctgtcattaccagaccaatcaacagcatgatgatgggtctgccagagggcctggtgcagccccacctcctaagcccacaccactcaggcactcagcaggcagtgcccacccaccctgcgtaggctggctggaatcatctggtttccttgggctgccctctgtactcctggaattccccagatgttgactactttgatctcagtacagttctagttgtcagtctccatgatctaacattactgacccttctgggaaataacgctggaaggcaggaattggaggcatgtcagcctgggtcacatgccccagtgccttgtagtggagagggtactagggagaggcatggactcgatgtctgctttcccagaagcagctgccttcttgtggaggtgcctggcctgccttctctggctctgcactcccattcaggctgcttctctccaatgctgttgctctctcccacctgctaggcaaaccttctcatgtggctcttcctaagggcaaatgtcaagcattgggagcagggaccaggagcagcctcaggatccagagactaacactcatttctaccgcaagcctggccctatgctggatgcttctatgtacagccatctaatcctagtcacgtacagataggcaaacagaagattagagagattagcccacttgcccaagaacacacatccctggcagtcacccaggactgtcaggctgcaaagccagtgcttcctgccctgctctgagtatggagctgtgccagggggccctgataaaagatctgaagacctctagtaggtttgcaggcctttttgaatgaattcgttcagactgtcctttctaccaaactggtacaaatgagtgaggtgttccttatgggcatgaaccatgaggccgcatagactacataccgatggacagatggatgtagggaatggtggacaaatgaataaaggaacagactgagccaaatatgcacctgtcttcctgaaagagaactttcaaggcagggtggcaatttaatgtaaccctgcctgacatttaggaatctttaagctttgagagctgagttttacccagggacaaccaaccatgccattcaagacaggtccatagggcagtgttagaatggcctgagccttgtcaagcacccttggccatgcttttctcagcaagcctttctactccatggggaaaaacaagccagcacctggggccctccatgactgtgtgtacatgtcaatatggggatatgtgtatttgagaaagcatggcttgtttatcgtggccattctttaatagaaacttctctatagtacaaaagactttcacctaaatttgaggagctgagccacttgcaggtttggggctaaaattttattttaatcactttacaaaatgccgtttactatctgccaatttatagtgttaattgttttaagggcattacttttatttgaaacaaaactttgaacttcctaagggtgggaacccaatcatatatgtcttagatttccccagaaatacctaaacattttctaaataaaattgagggaagagtaaaaaggaagtggcagacatacctgctgcagatttatcttggaagtcagactgttggcctgctctccttacctgaagacctggcagagctgttatcagttccaggattcagggatgagacatttacagttgttggcaaggcattggtggatgatgggctgtgatccacagaaaagtagcctaaccagccaggcgtggcagtgggcacttatagtcccagtactcaagaggctaagatgagaggatcattgaagccaggagtttgaggccagcctgggcaacatagccggcagacctgtacccctgcaagtcaccaggatgagctgagagatcatctggtgggagcagagccactatggctgagaggaattgttctggaggaacaattgttctataagcaggagagcaggagaaggaaaccgcgtacaggggttgactacctccagcggaagaaggtgagttgtaggagtgtcttaccactagggaatgtgtctgagtcatgtggcaccaaagtatgttagcagcagcaaatccatatgggtctgcagcaactcaagtcttgcctccttggaggaaagaatttggccgaggggcagaagtaggcttaaggcagagggagagactgaggcaagttttagagcaggagtgaaggtttattaaaaagttttagagcaggaacaaatggaagtaaagtatacttggaagagagccaagcaggtgacctgagagatccaagtgccccatccggcccttgacttgaggttttatacattggcatggttccagggtttatgtttcttctcccccgactcttcccttggagcaggctgtccgcaggcatggtggcttgccagcacttgggaggagctgcatgctcagactgtttactggaggtgtatgcatgctcatttgaggtgtttttcccttatcagtcgtttctagaggaaggtcacataccggttaaactgccattttgcctcttagtgtgcgtgcttgagcccactcgcccaactcctgagatcttgtcaggaagctgctgattaccagcttcagatgttttctatctattgggagactctttctctggctctggctgcaaccagttattttagagagacagcttaacaattgcctgaccattacttgatggtcacctgacattcctgggggaggggggccctctcctgccctgctcatgtctgcctagctacctactctaacactaggaatttataagcaatggattagcaaagtaaaatcaagttaatacaataataataatttgatagcaaaatttaaagatgcccccagatcacagagtgaatatgatgtgtgtggtgtggttcagcccaaccttccaaacctgcactggtcagtggagccttctgctgtgagagacctgtgctgtacctgcactgcccaacacagtggccaccagtccaggtggctagtgccacttgaattgagcacttgaaatgtggctaatgccaccaggcagccacatttttagttaaatttatctgatgaatttaagtttatatagccacatatggctagtggctactgtattgaagagtgcagttctaaactgaagacatctccatttcacaggagactgttcacaaatggaggctgaccagagggacgatgggagcctgtgtaatcaggaaaacaacacttctcactctgcggggcttagcgaggctgaggggagatggcaccctctggggaagattggcagcaaggcaccttgggccatagggattttccaggcatctgttcctccctcagctagtttctaaacaagcagatctgtactgcaggcagtctgcaggattaaagttgtgcagtaattacataacaaacaggctgaggccatttgagtcgtgacagggaaggactatagactcccatttgtagacaccaagctgaaggggctccaccatgactcagagaggtgtggactccaggactacagtgccaggggctgcctgatttgtgctcaccactttattctgactcgcttctaatgtggagccttgggtatgtcctcctttgggagcatttgggacagaagaaaaccttaccctgagacaaataatgtagatattcactgggcatgggctgtgtgcacagcaggctgcccaggaatgccaggatggcacccacaaagggacagacaagttgacggactagaacatgtgctcaagagatattcactcaactgaccacaggctgcagacagaaactcggaaggaaagggtggcatgccatcagccaagctagcagtaggctgccatgaccagagcaaggggaggaggaaagccgcgtgggcagtgagtatctggtatctttgctgaggctgcctcaatagcaaggaaaggaagcagctgtagtaggaggtggggtgccctctagtggtcatgctttggttgctgtcctttctcaagctcttacatcccttgacatcctctgagttgcttgaacatttcctacaacatctcatggtaagaaatacattttgcacggctacctagtttgcatgtgtgtatacatatggtcaaaacaagagcctcgaggctggcctcagtggctcacgcctgtaatcccagcactttgggaggccgaggtgggccaatcatgtggtcaggagtttgagaccatcctggccaacatggtgaaaccccgtatctactaaaaatacaaaaattagctgggtgtggtggtatgtgcctgtaatcccagctattcgggaggctgaggcaggaaaatcgcttgaaccagggagtcggatgttgcagtaagccaagatcgtgccatggcactccagcctggcaacagagcaaaactccatctcaaaaacaaacaacaacaacaaaaaaccccaagagcctcataaatacttatcctcacaacatgcaatatactattgtattttctgttttattctatttctcttttaatgttggtcataacctcctaaactgattcacagcccactaaatgggtcatgacctacagtttgaaaacctattgaaaagaaagccctctgccctaattgtcacctttgagactgcatcacccacctatcccattcctacctcactcatgcagggcgtctgtcggggccagcaagggtctgggaaacctgctctgtgaatcatctgcttgcaggtaatcaggcgttgtctgtcatcactgtggtcagggaggagggtgatggaggaagagaggaaattatagattaggacatcttttatcctgaatgcgggaaaattgggagaaccaagtacagctttcagtgtctctctcattctgtgttatttctttatctcatttatggtatttacgccttggacaaggatgaaagcaaacaaaagcaggcctgagtgaccctggcctgtctcctctggacttgtgcttccctgctgtcaagtgggtggccgcacaagctggctccttgagcagcttcttgcactgatgttccctgtttctgtttgtcccgaggtgagggtgcgggcctggaaaccagcggctggaaagcaaaaagaaggaggtgttaggcaaggaggaagacagagagggggttggggccaggaagaaaaagaaatgccagagtgacaagacatgcccctggtggcagcaggtgctgcagcctgcgttcttcctgcaccttccctgagaagagcagcggaggctgtgggcaggaagctgctgaccagagcaagcccacttctttctgagccagtgggctcacacaatgctatctctgagtcctttaaaacttacagccttttcaagccatcagaacccagagtccatctggttacatttgcttccatttagagaaggaaaactggggtctcaggaggaaagagctcaccgtgagtcacacagtcacagtgctgaagctggaaccacaatggaccccactacagtcataccatgtcccctgcccttgggggccacagagacctccagctagagggagccccacttgctcagggctggtggcattcagctcctggaagagcacagattgtttcagcaatttagaaagaagccacactgcatgggagatcttcctcattgatgccttcacatgagggcaaagccattttttcttttctggacctaggtttcctctttggcagaactggggagtggagctggttgggctctgaggcacctgagattgtataagtccctggctgagctggacctggaaccccacagggaaaacactaagttgcagtcagggtatctagttctggctccagttctgcctctgaggaactgcctgggcctctgtgtccccatcagtgaagtgcagggacttcaatttgccaaaatgttctaaggatccgtaattcagaaggtgttaaaaatctcccctgggtgcctgttcttgtgccccagggataggccagaggcttctctagttgtgcactggcactgagaaggcaggacccagtggtgctggtaccttggtcctgtggcaacagctctgctggcgtgggctaggagagtggttgatttgtgtttctgctcacccttcctatagcaggaggtatcttccctacagctgctccagggaaactgctgtagccctattgtcttctccttgtccacctgcttggccctggcccctgcagccctccctctacccacaaaatctgccagggtctctgtcatggcctctatgattaaaggatcccccatgcatctggatttggctgcctgtgactccaagactgcggaccccaggatgtgagaccctgtgtgttgatagctaaatgactgtgttctcatttgtgacatttcagggatactacatcaacctcgctaacgcctgaggacactgaagacatgcccgtggggcaggattcggaaatctgcctgctgaagtctggagaactgatgtaagtggcaactgctgcctgggccctccccaggtgtggcattgggaggagcactggcctctccagtgccggcgctggggaccacctcgggggctctaacttaataccagtggggcttcgtttattcttttttttcaggcatagcttatatacattaagattcaagcaagtatacagtgcttgaattttcattaattatacagtgtgatcactaccgcaattaagatatagaacagttccctcaccctaggaagttgcccctttataatattcctcccacacctcatgttcttttttcaaaataactttgttaatttttttattgtatgagcagtacactttcattgtaaaaaattaggaaaatagagataagcaaaacattttggcatatagccttccagtcttttttatacacatatatgcatataatttttgacacaaacaaatattctaaatcttattttgcagtcttttaaaacttcctatagcatgagtattttcccatatcatcgagttctccagtgttgtgtccagtggctgcataattgtcattaaatagattcagtcactcattcacagatatttattaattatcacaatgtgccaggtactattttaggtgcttagagcatgtcagtaaacaaaaccaagaaaggctgacccctcgccctcatcaagcttatattccagcaggggttgacagatgatacgctataaacataattaaataagtcaatattgtataaatgttacaaggtagtgcttgctatggaaaaagataaagtaggataacagggaaggggaatttgccattttaaataaagtgacagtaagaagataagacttgaaggaggtgaaggagttgccaggcatctatctgcgggtatagcatttcaggcagagggaacaggcagcacaaaggccctgagacaggacaatgcctgacatgttcaggggctgagaaaagggccagcgtgcctgcagcagagagaaccaggaggtggagtcagagtggaaatgagggtcccagcacatagggccttgttggccattgtaaggactttgactttgaatctgagggaaatgggacccccaaaatgaggtgtgtagcattaagagtgacttaatctaatttacagttgaaaaaggattgttctgattgccatgtagagaatagatgatggaggatgagagccaaagtggggagaccagttgggagggtattagaggaatccttgttccttggaccaagtgttggcagagagggcagagaccagggcaaattctggacctattttgaaggtggtgcagacagaatttcctgaaggtttagatgtggtcgtgagagaataatctattccaccagtcctcaggtgaccttggaccacacttggacaaacactatattgaattatggggcagaccaagcaggaagaattaaatagctagcccactcacaagctgttgatgctgggggagtatgaagtgtcagggccaccctttctggagagcaacttggctgcagaatgtaccaaaagttcaagaattgcattttctctttgatgcaatgggcctgtgtctgggaatttatcctgaggaaataatgactggaggtgcaaagataaagctaccaaaatgtcccttgcatgctactcacagcagtgacaattagaaatagtaacagagaacttgggtggtcgtgaatggctgttgaattttgccagatcttttttctacatcaattgataagatcataggctttttcttccttagcctgttgatatgatggattgcattgattgactttcatatatcaaaccagccttgcatacctgggataaatcccactggctgtggtatataattcttttcacacactgctggatttgacagaatatctaaaggatgtttgccagatatagaattgaaagttcttttctttcagcatttgaaatatgtgtgctgctacttccctctggcctccatggttttagatgagaaatcccctggcattcaaattggtattcccccatagataataagttattcctctctgcctgctttcaagttttttctttgtcttttgttcttagacgtttaattatgatgggtcttggcatgaatttctttgggtttttcctatttggggtacactcagctcttaaatctctaggcttatctgtcatcatatttgggaagtttataaccatcatttctttgaacattttttcagatgcactctattttccctctccatttgggactccagtgatacaaatgtgagatcttttgtccttgccttgtagattcctcaggctctgttctttttccttgcaccctgtcccccaattctcttttccctgtgttgttcagattgaggaatttctgtttttctctcttcaagtataactgtcatctttattcagctattgagtgtccagtgattttttttttattttggttattgtaattatttagttctaaaatttccatttggtacttttttatatcttctgtttctttggtatgagttttccactgttttattgtttcaagaacatttaaaattgttactgaagcattttttttgatggctgctttaaaagccttgacagataactccagcatctggttgatgtcagtgtcggcttctgttgattgtctttcctcatgcacactgtgattttcctggctcttaggataacgagtggttttttattatgtgtaggtggggggctcagagacgctaagctgttgtgattttcctcatattctgggggtccttaatcagtccgccttccttctcctgcccttcacttttactacaactgctgaatcattttcagtttttttagtggcatttaatgggaaagaacagggaaatgtttgaaatcatttataataaaactggtaaaaaacctaccctcaagtaaaggaatgaggaaagttatgagatttagaaataactagaccacacagatccaaggcaggtctttgaggagaataagacagtatggagaataggtcggctggacatgggaataaaatgcaaggagaatgacaacaccttgaaagttatttttttctgcctctttcaaagagagtgacagcaagctaaggattagcaacaacatcatgagagcatctgaaaacatgttaaaggttgggattatctcagaacactgcaaatgtgttggtaccccttgactcatgtaaactgaaatttcttaggtcactcagtggaattcacatctgtgacatgagccttatagacaataggcatcttaagattatattatatttgagcaaacctttgatttgtttttgttaagatctgctttggagaggctgagtattgtccttgtcactgaatagatgatgtctagatgatgtctagactagatgattgaggcacaatccaaatacctgggtgccaggggagaattctggagcataaaattataaaatgctccagcattaatgtattaatggggcattatgtcagggtaagtgactttttacatggtaatatggtaagatttccacattacaagaaagatgtctgttccagaatggaccccccaaacctgccctcagattcttgaaaattgtaaatgttggtcgagggttcttaattagaaataaaatttaacacatggagaagtatcgcattgaattgaattctcacaaaggtgagtattggagctgttctttaaagcatcctggttttttaatcatttcttaccgttctcattagctttggggagtctgtccattcatctccacagctttggaggcagatgaacgctcagcaccaccacttgctgcgcagtgttgggcaagttacctaacctctttgaagttaattccctcccctgtgttaaaggggatagtaatacattttctccacaaaaggcagtttggtatggtaggaagatgatggctttgcctcagacctgtgtgagcctggattgaatttctcaatcttttagaatcttagtttcctcttttgtagaatggcaacagtcatgccttcctcaaggagccattgcagtaacatgcaaaattgttgagcacagggcgtggcctatgatggccgccaccttcccatttcacagttgagaaaccgaggttcaaagtgagtgagtgactcacccaaggccacactgctcctaagttgcagctctgcactggaggctctgtctccatgatcatgagctaacctagctgcctccagagttgcacagtgtaggagtggtgccactcggcctggaaggggccctgaggagcaagctccctgggttcatcttgtaatctagtccttgcagcagtcctgaggcaggtgtggttgtccttgtttggcagatgaagaaactgaggcttatgcagcagggatgcagtgaggcaggtcccttggcccctaacctcacattcttcacgtcacactctgggtccagcacagaaccccaaaaacagaggaactcactgtcaatgaaccttataaacttcttgaagaagcttttatctacccagggagagtaagaacaagcttttctccccaaaaccgttgtattacttgcaccacccttgcattataaagagtatgggatgttggcatttgaggaaaggtcagggtgtccatgtggaatcttacaatggacgccagatgcagctgagaagatggactatatcagaaggctgggaggcttgtactaattaggtgaaagggcgaggcagggaactggaaggagaaatggcagagaaaaaacagatggctgagcagcagggcatcttcaggagagcagcaaaaagctgtgcctcggcacttgcttcctgtccatgagggccgtggagcaggtcaggccatcctcagttccttagttcccatgggctttaacctccacacaggcaaaggtgtcatctgtattttttactgctgtctcctccgtgcctagacctatgccaggcatgtagttagcgctcaggaagcatttgttggagtgagctgcccatcccataattaagcatgttggccaaggttacccagggcttgtcctctcaagagtctccgaagtctccagccacctctgagccacagatgacctggccagtggacacaaacactttgcccagtcaatcaggtccctctctgtatttttattttaggatcaaagtacccctcacagtggatgagatcgccagcttcggggagggtagcagggagctgtttgtgaggtccagcacctacagcctgatccccatcactgtggccgaggcaggcctcaccatcagctgggtcttctcctctgaccccaagagcatctccttcagtgtggtcttccaggaggccgaggacacaccgctggatcagtgtaaggtaaggctgggctccctgcctgtgggctccttacacacacatctgggtacttgggcaggcctttctcaaagcagggcagtggccatcctatcctctgctgggcaggcctcacttggaatgttctgggcagtatcatgcagagaaggcagagcacctgggccttgtccagtttggggagagaaagacccagaagttctggaaagctgttctcaaatgtctgaaggtcacacctgtgtgaaacaggtacagtctgcccttgggatagatgggtaggtgaaagaggaatacagacgtatgactcaatttaaggatcattttctaatagagctgtgcaaagcaggaatggatcaccttgggaggtggtgacctctcttcctctagtttttagcttagggtgcatctcaacccggaaaggtgtcagtagagacaaccccaatgtcacttgggtggtcgagcttgaaatcttggtggcaggtaccagtttataaattcctaagacattctaggcatggaatgttgacagtgcccggactgttgttctcaaccttggctgcaaattagagtctctaggggtgggatccagacatctccaagtgattccaatgagcagccaaggttgagaaccactggtgtagatcagggggttgaagccaaagtggaaaggatgaggtggaatccagaccacagggacagaggttgggcagggctccatgggtggctgattcagtatggggcaaggagaagggagacccatgcctgaggtctgaatttgatgcctgcatctctgcagagaaagggtgtagagggatatgggagggagagatggtttgcatggaaacacaagttccatttgaatcattctgagtgaaagaaatggtaaaagccgttgggcctgctggactggagctgaaaatggatcctagtctgggaatatgactgcagaaatctccattttgcaagaattgcaaggatcaagatagggaaaagctagctgaagtcatgtgaaacaagagttctgtgaagtctttgcagaaacatctaatagtcccttgtgtgtttggtccactgggtgccctcgaggggcttgaggctgagggatgaggagggcccagagcaggagagcccagctaggagacacattgggccacacagcagttcctgctgtggcgctggcatcccatagaggaacacgtacccgtttgggtttgctctcctgccatcctgccctgttggaatctgctcaatgcagggatcgcttttgtcatttctctgcttttcaaactcactctcaaaatgtaactctactcccttgggttggccttgtttattggaatctcatattctgtcttatttaaaaccgctctgcccatcttattcttttggggcttgtagccagctcctcctacctacctctggagcccttccttcttgagcagttctgagcccccacccaggaggtcctggtgcggccaacatgcctgtcagctccacactaacaaacggcagcactgccaagagctgcccttgccactcaccatcacgttccccagacccaccaggcccccagccctgaatccacccagatcagacaccgtgagtgtttgtggcagggagggaagggacgaaatcagggatccaggcctttgctgttttgcctgcccatatgtggctgggctgtgggcctctccccttgctcagtccctacccaccgagtcctcagcagcctggggttcctgtgtggctctaccaggaatcaggaacttggggacctactgagccttcctcctctagcttccagggggccccactgcctttccccacagtgacaccagggggcagaaggggcccgtgtacaggatgcttaggtgctcctctgccttcacaggccactgtcaccaaccacagatgggggtggctgttatctctgcctgaggtcccccaaagagaccatggccagggtagcctgtttccagacatgtgccctcaatatctatcccggggactccccgagtgcactcctgaccagcctgggccttagaggaaatgacagatgcagtgcaaattgcagcactcagacttcatgattacggaggtatagacacaaggaattatgctgtgtatttgcaaccatttattgagtgtgtcctgtatactggactctgtagggcccacgggggatagaaagatgaagggataacatgggatctcccgttgaggagctcactgtgtaatcagagagagactctaataaatagacatttgtgattccaggtggtttcatgacaggggtgggtgggcactgtgggtacccctgggaaggatgcctagcccagcctggggaacagagatgaggaaaggagacccctgggcgatgatgaagaccacagtggaggaaaccagaagcagcattgtgaggtgaggcgagggacctgtgggcttgaggagaagcatccaggtggatggaatagcacagcagaaggccagccccgtttctaggggcacctgtcagacactctccaccctgtgccaccctctctccagacccacttcctccattatagtcatagactcgacactgagattggagagtgtgaatctaggggaggcacttgatgaaagaaattatgaaccaggttaccagtgtacacaccgctggcctgaggcccagggacaaagtggagaattggatccagactctgtcctctctctgggcagaggatccgtctttggccagaggtcgatggcctgttggggtgggcttcagagggagtcagaggaggaatcagctgacagcaaggacccttgactttgttttttaaaacagctttattgagatataactcacgcacttggaatgtacagtttaatggtttttagtatattcacagagttgtaccaccattaccactgtctaattttagattctttccatcactccaaaaaagaaattctgtgcccattagcagtcactccccaacctctgcccccagtgaccactaatctattttgtggatatgctgattctagatgtttcatgtgaatggaatgaatgaaaaacagctggaatgaatgaaaaggctacagagtaagatgttttaaagaaatgaagagtatcattttcaagaacgcacattaatctatgttaaacatgccctcttcaggggacctgccttaaggagctcttgatgttgcttgtaatcaaggtagtgagtgcgagggtgtgcagggtgggcacaccaaggtccccatgcaaacagcaagccttcccctccagcagctccttcccatacacccctgctgcagtgtctgagaccaggccagagttgttaggttgtggatcacagaaacagaaccaacccctcactctcccgggatccttagtccctggtggaactagaatgtgatagaatattaatggaagtaaatgagacgccgtgtgcagaagaggcagcacagagcctacgtgtagcaggccctcagtgtacactctttgtacacctttgtcccctccagccttgtcaggggcccgtcctactccctcaccactaccagctgccagcctgagcaagcacactgttgtgttaggaacacaatgctcgctctccctcccatgcctttttgattccccttttgatttcccttcgatccacacgtttgaatttgttatttagttttcaaatattttgagattttccagagatctgctcttgatttctaatttaattccattgtagacctagaacatactttgtataacttgaatcctttgaagtttgagaggtgttttcttaatggcctagaacaagggtgtccaatcgtttggcttccctgggcctcgttggaagaattgtcttgggccacacataagatacactaacactaacgatagctgatgagctaaaaacaaagacaaaaacaaataaaaaaactcataatgttttaagaaagtttacgaatttgtgttgggctgcattcaaagccttcctgggccgcgggttggacaagcttggcctagaatgtgacctacctgggtgaatgtgccgagtgcacttgaaaaggatgtaccttctgctgttgttgggtggagcgttcttttttttttttttttgagacagtttcactcttgttgcccaggctggagtgcaatggcgcgatctcagctcactgcaacttctgcctcccaggttcaagcgattctcctgcctcagcctcccaagtagctgggattacaggcatgcgccaccatgcccagataattttgtatttttattagagatggggttttgctatgttggccaggttggttttgaactcctgacctcaggtgatccacccacctcggcctcccgaagtgttgagattacgggcgtgagccaccgtgcctggccggaatattctattatagatgccaattaggtcaagttagttgatggtggtgttcgtcttctgtttcttcattgagttcctgtctacttattctatcaattattaagaaagaggtattgaaatctccaactataattgtgaatttgtccatctctccttgcaattctaccactttttgtatcatgtattttgaagctctgtcattaggggcataaacgtttaggattattgtccttttaatgaactgacatatttatcattatgaaattatccctggtaatattctttgatataaaagctgtgttatgtaatattaatacagtcaaaccagcattcttttggttagcatgctagcctggtaatcttgtttacatctgtttacttttaacctatttgtgtctttatatttaaattgcatttcttgtaggcatgatagggttgggtgttgcttttatccagtctggtaatctctgccttttcattggaatgtttaggctattttcacttactgtgattgctgttaaggttaggtttgagtctgccatcttggtattcattttctcttatcccatctgttttttgtctctcttcctcactaagtgagggcagttgttgggctcaccctattcctgtctctcagggatcactatcctgcattgcctgataaccagtgtcttgaaaactgtcctttcatatgttttctattttttgttttgttgtttttgttgttgttattgttgtgttgttgtgtcctgggagggtaaatcttagatattctcccatgcctttaaatatgttgtctccactgccaggaacagccagatcccttctcattggctaaattgtcctaactcagcatcactttttccaagaagtttcccctggcattcagcctcctctctcccacccagatgctagaatggcaccccttgccggttctcccctcatggtactctcaccccagtgtaactgaatgttttcttctctgtgatcaccattaaaccacaagagtcctgagggcagagtcctttgtgggaattcacttcactttgggaactgtgtacccaacatgtagagtttagagaaagatgcagctgtgttcaagattaagttgagaaagtaatcgcatccttatattaacaactattttggattcagtcattttgtacaagttaaaaatgtttaatgggaaaaaattaaaactgaatttaataaaaattgtatttctgaaaaagaagctacattttattttgtaaagaataaaaatggtcacttctggggaagtttacctcattaggaactcaaagttgctaagatgctgcttccgttgtctgtagaccttctggtccatataaccatttatgtgtagtcagtcttaaatggaaggcttagggacactttataagacaagatcctctaggtgctagtcacttcttaaaaaaaaaaaaaaatgtaagggctgggcgccgtggctcacgcctgtaatcccagcactttgggaggccgaggcgggtgaatcactaggtcaggagtttgagaccagcctggccaacatgatgaaactctgtctctattaaaaatacaaaaattagctgggtgtgttggtgtacacctgtaatcctagctactcaggaggctgaggcaggagaattgcttgaatccaggaggcacaggttgcagtgagccaagatcacgacactgcactctagcctgggcaacagagtgagactccatcttaaaaaaaaaattttttttaaatgttggttggctctagcctagcatggtggctcacacctgtaatcccagcactttgggaggctgaggcgggcagatcacctgaggtcaggagttcgataccaacctggccaacatggtgaaactccgtctctgctaaaaatacaaaaattagctgggcatggtggtgggtgcctgtaatccctactactcgggacactgagaaaggagaactgcttgaacctgggaggtggagattgcagtgagccaagatcatgccactgcactccagcctgggcaacagagtaagactccatctcagaaaaaaaaaggaaaaaaaaatgttgactggctctgccttatctcctagaatattttcagttttaaaatgaggcctgtgtcttagctggtaagtaggttgaagagcctgccctggtggggaagaagtgagccattcaaagacctccctctgagccctggccctgtctagcacacaccctttgcacagattttgtctctgacagtgaggcccttcaaaaatcgtctgaaaaaaaaatcaatatcagtgtctcctgggactaatttctcattctcagggaaggcagagagtgaataggaggctgaggcccaggcacgggaagatgaaagggtcctggggcacatggaccagccaaagcacagccaggagacaggcctaggtggagccagagatgtcgagcctggaggagagtgggcccagcagctttgtgcctggaagattgttatctggaaggaggtctcagcctgtcctgcgagacccaagggcagcaccaggaccaacaggagacagctggacagatggatcccacctagactaagcttcatatcctgaaggcagaaaagggcttctcctttagcccatggagtgttctagcatcttctatgttcaaggctaggggatcactccttaagggtgctgaccaagtcatgattctggaagaaactcatagccacgagtcatcaacagcctcaggttgtgggatggcactgtgccactactggggctggtcacagctccggctctgctcatctgtgacctcaggcaacacactcagcctcctaccccaaaataaagggtcttccctgaggatgccgagggccctctcagcctctgtgatgtttttgcctacctgctttccctcccaggtcctcattcccacgacccgatgcaactcccacaaggagaacatccagggccagctcaaggttcgcacacccggcatctacatgctcatcttcgacaataccttctcaaggtagggccacctcaggcaccagctccacgtctccaggcctctctttcacctcttctaaagagcagaggtggacactcaaaaccaattatttgtcagtaacttattattaattgttctttgattgttgacccctctcctgtggtgttccagtgttctttagagattttgtgacacacaggctcatgcttgcagagtcttaccatgtcactgctgaggggtagaggagtgacactcctaagtcacagagccagtggtggagctggatctgaaccaggcggtctggccagtctgaactcttcataaccaaggtgccctttccctctctctgatattgattcccactgctctgccactgccctgcccaaagaaggggcttaggaaatacaatggaaagactgaatgaatgaatgaacgagaaagggagaaataaaagaaggaagggcagagcttgagataagcaagcccaaaactgcaccacaaagcccctggccatgtggcgggagcgacaggtgccatctctgggaagcactctgagaaccagctaaggttcaggagtgtataggttgggagatgggggagaagctggacaagagaatgagaatggagggagatgaggccagagggatagcaggaggggagtggagacaggaccagcattgactgagtatctgccaatcatttggagaggggctgggcacctgcccctgtttatgtcttctgcttcagcacagaccccttaactggaaccagctctttagagagaactgcctgatctgtttctggccacatcctctctgagcaaggtcctgggctaccggtcacatccccagcatgggtacttggctcttagcagaataactagacaggacactagggaaaacctgagtcatcccctcaccacctccaggccttgaactgccagggcttgtggccaagagtgcccaccagaggaggggttggaagatgaacttcccacctcaccccctcctgcccctccgtacactcccaagtggaaatgaaagcacccctggagttagcaggacctcatggcatagacctatcatggccagagagctctctttggagccaccctctaccccaagagtggacatgagccccagcccctcttgaacaggatagggcagtggttaggagaatgggttggggaccaccaggcccaagctctgctcttcccccagcggcccttagttgagtctccatttcctactctgcagtggcaaccacactgtggattgatggagagaccaaggagagatgtgatgagggcagagcaccgtcccaagcccgagcaggctcccagttatccctagaggtggccatggtgctgtgacaaactctggccttggcccatcgaggtcatctcaggggcctacttgagatttccaaactatggatatcagaactgagttagctgccgagtaggaaaaaatccgtgctggcctccaccatatgcctcctcccattgcctgctcctcacaccaccatacacacactgtgcagtccccaccaccagctgcttcagagcagccaggtgagggaggtgatattcacagcctgtgatcaaaagggcatttctgcacccaagcctcaggagagtccacagtgatgtcccgaaaccctctgaccctcccagggagagaactccactagacagacaggaaatggggcatggggctccagcacccacacccagccaggtcactgcagtgaccacagaggcctcagcagcagctgccacccctcggactttcagctctcaggtaacaccctccctttccatttctgtttcctcaggtttgtctctaaaaaggtattttatcacttgacggttgatcggcctgtgatctacgatggaagtgatttcctgtagcttcagcacctcagtaacttcacttcatccacaggaaacactgctcttcctcacctgtcacataaagcatttttttaaaaagtcagctgctccaaaatcatcaactcagcccctgggctgcccctcagaggcggtgtctggggaggactttgtgctcagcactctgcaccggccactcttagcccccgaggcgttgaagggctcaggcaatgtttccattaagtagagactcagctgttgtcacacccaaagggatgctctgccaaaggtttaaacacccaggagaccatcagcctctcctgggagcacagttggctacaggcctcttgtggagagtttcacgggcaggggtgattccaacttctgcctgtggagagattttctgccctgccccaccagggccctgcatgttggagactgagctgggtgcactggccatgccctgtgaatcctcaggctgtgacgccctcaggtactcctgggaaaaggaggtacacagccatcatgcgagtcggtgccaggggaccccccggagatcctgaccagctcctccagtcatgctcttgtccctcactgccccagtaagctggaggctgctccagaactcagcagtgttggaggggcctctaagctgcactctctttctggcccttttgtctgggtgattctgtcctcaaataaagcccttcactcagccagacctctccacagctcaaagcattgccctaagaatcagaagtaaagataatccaagagcaaaacccactgtacttggggcctgcaatggctgtgtgtacactacatctaatgcccaaatgccagccagtgtggatgttgtgaccacagagcaggattgtgcattggctttagagctactcctcagctgatggcccacttttgtttatataaataagagcttctgccccacctgcagacatgtttactaatgatcatagccaggattagaaccactttcaaacattggggccttcttaacaaaagtctttgataacttaagaaccaaagtaacagagtaaacagaggcatgatggatccctgggccccactcccctcctgacaggttccccaacagcccatttgcccacttcccactgctcagcccacaccagacctccaggagacatccccccttgaggcagagagatcctgttccctattcccagacaagaattatttaatcttccctgttctctgtggtccttttcttccccaacaacagatagctcaccttggacagctcttcgtcccttgttcatggaaccagctgcctgcagtcaggccccaggttcttccatgggtgaacagagcatctgacaaaaggtcccagtttggccaggggtgagggagagagcaccagacaggctatccgagaatctgagagctgggcccggcagttcctccagctacccttgtgacctaagtccagtcacacatttcccaaagtttctctttgtcataaccctggtctggctggttttgagggcttgagaatgggtcagggactccaggccaagtccaacagagaccccaaacccaccacacaccagcagccacaacctcaccaccaacaaagaggacttttgtggggccacaagtaagaggtcatttctggaatggactcagacctttaaacaggagagttgagcacttccagtcagtttttaagcaaggcatggggaacagggaatagaacctttcaaagaggttgcccagagaaaagctgggcctcttgcattcggcttccttggagcagcctcttctggcagaaagccatcaggtgctcaatcatcttctcctggccaaggctctgaccatgcttagtactggaatagaggtggccaggcccccagcgactcttcttggcctgatgtttgtcctcacaggcatgccacgtggcctgagatgattcagaacaaatcatgctaactttgaatccatccagccacttgcaaatgataatcagaagtcagcttgttcactgttagaaagaaactaacaaaagagaacccagagcaatctagaatctttgagtgcttggctttccaaggatactgcggagactctggccaagctgatgaccttctgaagtgtcactggcaccatatgcaacaagaaccaccattcactgagtagctaatgggtttggggcctgggacattccatctgaggtccttcctgaacatgtcactccacagcagaggaccggttgcagcttacccagaaccactcctccaggagagctggatgttttgcgtgcaacaccttgagcactgactgctattgttcaaaaaaagcctttgctgcattcggaggactgccccgtgccctgaggtgacttcctaactatgtggtttcattagcgaatttattttttgtgctgggtggacatttgtattttgttaggttgctgtttaagctcaagtttgctgtgctctctgcagctacaaaacatcttggcatatttaagagtggcttttataaatagctttattctgatattaatcagattcccaactttactgagaattaaggactggggtactttaaagaaatgcaaatagcaattgaagaaccactgctgcaggtggtagccctggctagactgaattacactagaaatcagccagaaggaagcgtccttgggatcccagatcactctttttttttttttttaaaaggggcagccccttgatggctcatctctctgaataacagttacgtcttcatatcgataccagatgccttcttcatcatgccactgaagccactcaccaccttcaagaacatgccaacctctgtcagattcacttacccacaaacaaggaggcacgtttggcacaaagtgttgtcctccaggtccaagtggactctacagagtgcttgacctcaacacactggattccaggtggactggaccaagagcaggcaaagacacgggaactgaaaaactccacagggtttggagaatagaaatgaaaagccacgtcatataactcaagaataaatggtgttttggaaattttaaaattatcatcgaaggtggtgaaactatttcaggcccaaatgaaaggaaatcgccagttggggatgaaatcacagagcctgtgttttatgatatggttggatgtccactgatgaaattttaaaggagtttcagttttaaaagtgcgcatgattctacatatgagaattctttaggccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacattt

SEQ ID NO: 38316 - DNA, 883 bp, Homo sapiens
ggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgcc

SEQ ID NO: 38317 - DNA, 77734 bp, Homo sapiens
cttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaaggtgagtcaaccgcttatgtcggccgcttcccaccacccggccggcctccaggcgcccccgggaaccccgtttctccagcgcccccggcttcccggcgtcgggatgccagcgcgcggtggtctgcgggcttggaggagctgcgtgcaccacgcttctgcaaagtctgggcttagatatttattgaataaaggaatgaataattaaaaaagaaaactccggttagcttaacacggaaacagtagcagggggttgggactccacacccaattagggccagaaattcaggtggtcaggtatttttttcattctgtgaatgataatggaggataagggagggagaaggtaggggagtggaaagaaaaagattggtgtgggtttgggagttacttccgtcatttctgtaacgcagcaacttattcttgtgaaattaatagaggaatagttttagaagtctaatataagaagatgggtaatgcagtggaaaagactctgaatttgtagattttagagggtctcaattgggcaagtttcttataacttctgcgttgcagatgccttacctgaaaaggagagatttagagtaagtcacctaaagtcctttcctattctatgattatatgccctaatgcagtgtctttgttttgcaaaacatttgatagtgttcctgtaaatgaagtaaacttttttgagatgtctgtcactaaaatattcagaatcagttcatgtatgcagagcaactttgtaaaaaattatcctagtgcgactgaaaataaaaaatttcatttgcttagtctgagcttgtactttaattcttaattcattgggtagagtggacactcttcattattgttgcaaacatcctgatggatatgatggttttttatcaagtgttaaaggttttaaccgttattaatcaaaatagacgcttgcttactgaaccttgtgaaagctatatgatgtatgtacgtaacagccaaaatgtgagccaaaatgttggctgtatataatggagacaatctgtccttgtatattgtttgtggttatgaaaacgtcacccatccttgagaagaaattgatttacagccttgtttttcagtttatgtgtaagtatgtgtgtattggccctgaatgaggaattcatcttctgtgagtggacggaaaggtttcagaaacactgatataaaggtctggaaagtagctgtgaactttgaaaagtcaggaattagctttgcttttacattttactagatttcagaatcggtaacaggtttatcttgttttttgtttttgcagagagcatttagaaacacatgtaatcagtatagggttgatacccagactctcttaataactattacaaatcagtaaaaaaaaaaaatggcagtactgtttataggcatttcacgtgaggaaacctgaaaggtcaataaatgatacttaatcttacaaatcaggaaaaagtaagccagtgaggtaccactttatgttcatcaatttggcaaaataatatgacaatatggataattgttgcagagaaacaggaactcttataccacttggtgggaatgtaaaaatatgtaactattttgtagatcaacttagttgatgaagttggaggtatatattaaatatatcctttgacctagcagttttctttctaggaatatattctagaaataagtattgttctcaagaattgtttattgcagcttcataataacaaaattgaaaacaagtgagaccctgcctgtgcaacatagtgaaaccttttctttacaaaaaataagaaaacaaaaaaaccattccattagtttgagaatggacaaataaattgtgatattaataaaatgtaatactatcgaaaagttctcacgaatggactagagctgcatgaaacaacgtgactgaattgaaaaacaaacaaaatcttgagctaagaaaacaaggtacagacgaataatgctatgggggtaaagtctaaaaacatgcaaaacagtacttcttttgtttatagatacctatattaaaatatgcatagtagtgattaacaccatattccaagatagtggttgtcatagtgtgtccagaattggtgggttcttggtctcgctgacttcaagaatgaagctgtggaccctcgcggtgttatagttcttaaagatggtgtgtccggagtttgttcattctgatgttcagacatgtctggagtttctttcttctgatgggtttgtggtctcgctggcttcaggagtgaagctgcagaccttcactgtgagtgttacagctcttaaaggcagtgcgtctggagttgttccttccatccggagttgttggtccctctcggtggattcgtggtctcgctggcttcaggagtgaagctgcagaccttcgcggtgagtgttacagctcataaaggcggcagggacccaaagagtgagcagcagcaagatttattgtgaagagtgaaagaacaaatcttcaacagcagggaagtggacgcaagcgggttgttgctgctggtttgggtggcctgcttttattctcttatctggccccagccacgtcctgctgattggtccattttacagagagctgattggtccgttttgacagagtgctgattggtgcgttttatgatcctttagcgagacacacagcactgattgttgcatttacaaacttttagctagacacagagtgctgattggtgtgtttacaaacctctagctaggcacagagcactgattggtgcgtttacaaaccttgagctagacacagagtggtgattggtgcgtttacaatcctttagctagacagaaaagttttccaagtccccacctgacccagaagcccagctggcttcacctctcaatggcactcgccgcgggactttgcggcacctagcttgggcactctagcagcccagagggagctcgtcccccatcaagcccagcaggcacccacccggaaccgcgcgtagcccaggctcctgccggcgcctctctctctacacctccctgagagcagatggagccggctccggcctctgccagccgcagagaggggctcccacagtgcagcagcgggctgaagggctccttgagcacggccagagcagacgccgaggccgaggaggcgccgagagcgagcaagggctgctaggacgttgtcacctctcaataggagaaagctatctaatatttaatgtatttaagaaaatggtgcaaatgtggtaaaattgtaagatgtgcttttagcaaggtttgtgatgtttccatatgtttaagtgtttcataagtggaaaacgttaaagcatataaaaagatgctttaggaggagggtggtagtgatgatagtgttgatagtaacggtgatgctgatgaacataccgctgccgctttaatcctcatattagcctgggctactctgccaagggtttccttttcttgacagatgactgcttttgcagggtgtagcctttgtgtccttcccctttcctgcagttttgctcatcaacttcaggattctcatctcctgtagtttaatgataatggcaatcagttactgagtaccagacattcttttagttattttaccatatcttgaatcacattatttctgcagaataattatgaaaggaatcgatcaatcttgaaagtatattacaacaaactaaagaaaattagttgaacattttgtgttaagctaggcattctttagtttctcaaagtgtgtaaagacaaaaatgtgagagtgggagaagctactgtttaaaataaaagaatgagctgggtactgtggctcatgcctgtaatcccagcactttaggaggctgagggaagtggattgccagagctcaggtgttcgagaccagcgtggtcaacatggcaaaaccctgtctctacagaaaataccaaaattagctgggcatgatggcgcaggcctaaggaggctgaggttggggggtcacttgagcccaagaggtttaggctgcagtgagccaagtgcgccactgcactccaacctgggcgacagagcaaggccctgtctcagaaaacaaacaaacaaaaaaatataagaatgaataagtaaaattatatatgttagataatggtagccattcagttatgaaggtttcccttcttttcctaccttccttatctttgtctcctttaaagaaagagtttctgtttggagggataaacttcaaggcctttgtgaagaccaaaatggcatacaattttcctgataaatgcagtaaagtgtaaccaaaaatgtaagtgaccattttgttacttctttattaagatgtaattcacataccacaccttttatccattcaaagtatactattcagtggtttttgatatgtttatagaattgtaaagctaccaccagttttagaacatttttattacccagaaagaaactccatgccatttagctgttgtccccagtcccccatctctcccaaccctaggcaactgctaatttactttgcctctatagattggactatttttaccatttcatatgaatagaattatatagtatgtggtcttttgtgtgttttccatccatgctataacatggatgagcctggaaaacatgttaattaaaagaagccagttgcaaaagaccacttactgtccttcagtcttttctatggccgaatagaatattgtatgaatttagccattcatcagttgatagacgttcgagttgtttccgctttttggctattataaataatgctgctgtgagcactcctgtacaagctttttttttttgtggatatgttttcatcttggatacttactgaggagtggaatttctgggtcatatgggaatcctatgttcaaccttttgaggatccaccaggctattttccacagtgggtacatgtttttttttttttttttttttttttgagacggagtctcgctctgtcgcccaggccggactgcggactgcagtggcgcaatctcggctcactgcaagctccgcttcccgggttcacgccattctcctgcctcagcctccggagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatgtttttaaaatacattcctacaagcagtgtatgagggtccagtttttctacatccttgctaatatttgttatctttttgattacagctgtcctagtgggtatgaagtggtatctcatgattttgatatgcatttcccagatgactaatgacactgagcctattttcatgtacttattggccatttggatgttgtctggagaaatgtctattctgcctattttaaaatttgtctttttatgattgagttgtaagtgttcccaatgtattctaggtacaagtattgtattagattcataccacaaatattttcttccattcagtgggttgtctttttactttcttaatagtgtcctttgaaggtgactgttttaaactgtaaatgtctcagtcaatactaggctaaattttaaaacttaatatacatcattaatttatattcatttctgtagaaatattgaccatgaacatacctgaacttagaaaccaacactaacatttgggctcttttctacacacactcgctgaaagatctctataagagctgtacaaaacaagatagataggaggaaattctttgtagttggtgaaggtcactgccttccctagtctagtgattgtatcctttgtaccagcctcttttatgttatattggtgtcttaacaaaactgtaagtgcctcaaccccttaaagtatgtttactcaccctgtatttattgattgtgtattacaatggtaaagaaaacaaagggaaaacagtttatccctgccctcagaatttatagtcttgtggtaagggcaaccaataaacaaaaaattttaaatataaatttcgtgtttagttctttgaaggaggaaatctttagttagagggaaatcatctctgcaaggtgacgtttaataaaagacctctttgaacaagttgcgggggtaggggggcttgggcctgcagccactgggaatatgtgaaagtgctgaggtgatacatagctttggatgcaaagagccaaacctggaaatggtcagcctttgaatgcctgttaactttgtttcctaaatttttttttttttatgagacagtgtctcactatgttgccgaggctgctcttgaactcttgggctcaggtgatcttcctgcctcagcctcccgagtagctgggactacaggtgcacactaccatgctgggcttattttttctagggttggcaacaattaaaataatacattatttaaggtttagattttcctcctatttgtaatcatttgttgaaatcatcactttttcaataagctatgttagatatctttcagggaactaattaccattttatattgtattataggttggggggttacatattggttgtgaagtagatagtgggctccttcaggttgtttacctatttcaatttttagctccccagcatactgcgtttgatgaaagtttttaaatattcgttgaattaacattcgtattcactaatacggcttaaacttgtaagatgtgctaaaataagtactgtatattcttggctgttcttattaatttggttttagaaaaatggagaagtgaaagaacatttttcttttttattttttttgagacagagtctcgctttgttgcccaggctggagtgcagtggcgcgatctcggttcactgcaacctccaccttcccgggttcatgccattctcctgtctcagcctcccaagtagctgggactataggcgcccgccaccatgcctggctaatttttttgtatttttagtagagatgggggttttaccgtgttagtcaggatggtctcgatctcctgacctcgtgatccgcccaccttggcctcccaaagtgctgggattacaagcgcgagccaccacacccggccaaaagaacatttttcatttgctttaaaaatatatagcaatataaatcctaaaaatgaagagagtctgttttaaattgacagttcagtggcttttatattgtctgatactgttacttgtttctctttcagagttagaattgaaaaagtaagtagacaatgctagcaccttctaagttcttatatttaaaaggattaatgttgtcaaactgacatggtgactcccatgtagtcatcttgcagcttcaatagttatagtctttcttaacacttaaaaaaacttaatttcttaagatatcaaatattgagccagtatttatttccgtgatcatttcacttttttagaagccatttgtttgaatcaggatccaagtaaagttcatttattgcaattgattactatgtaaataaagttcctttacatctatgggtgccatctgtcttttattttaaatgtattctttgaaaaaatcaaattggttgttccaaagaaattcttattctagaccaggaatttctcctactttctggtttgaggatctctttactcttaaaaattgaagattctaaatcttttgtttatgtgggttatatctaccgctagttactacattggaaattaaaacacttaaaaatttatttaataattatttgttttaaaactataatactaaatcgattcatgttaaataatattttaaaaatttttaattaaggccaggtatggtggtgcatgcctgtaatcccagcactttgggagactgaggcaggcagatcacatgaggtcaggagtttgagaccagcctgggcaacatggcaaaaccatgtcagtactaaaaatttaaaaattagccagacgtggtggtgcacatctgtaatcccagctacttgggaggctgaggcacaagaatcacttgaacccgggaagcggaggttgcagtgagctgagattactccaagcctgggtgacagactgtatctcaaaaaaaaaaagatttttaaaattacaaatggacacattgtaattgtatgtatttatgggatacagtttgatgttttgatagatgtatatgttggtctaatgatcaaataagggtagttagtatccattacctcatgcaattatcgtaacataacatttttaatgaaaaccaattatatttgctaaaaaataccagggaaaggagtgattattttacatttttccagatctttataagatctctcttaatagaagcctgctgaattctcgtgtctttttctgcattcagtcttgctgtatcacatgacctctgcaaaacaacactgtacgcttgtgagagaatgagagtgaaaaaaggcaaataatagatgagcattcttgtgaaagtagttctgacttaattgaccccatgaaagtgtcttgaccccctggaatccacagactgttggctgagaagtggaccattttctgaatattgataattagatcaagagactaggatacattgctttgccttaagcagacatatccctctaaaatattaattccccagaaaagcagaaactgaatttataaaatttccctttggcccgtaacgtaattttatttaggttctctttcctgtgacgttaaggttttttaaaaaaagttgttgatttgatgtttttacatctgattcaacaaattatctctacatttcttataaaaataaaagtgtgttcctacattaaacaaacaatctgtaattttacaggctttttttcttgataaaataaatttttcattcaaaatgtacaagtagaagtttcttctgttggttttctggccgggcgcagtggctcatgcctgtaatcccagccagcactttgggaggctgaggcgggtggattgtttgaggccaggagtttgagaccagcctgggtaacgtggcaaaaccctgtctctactaaaaatacaaaaattaacagggtgtggtggtgcatgactgtagtcccagctacccaggaggctgaggtaggaggattgcttgagtctggaggcagaggttgcaatgagccatgatctgaccagtgcagtctggcctgggcaacagagtgagaccctgtcacaaaaaatacaagaagtttcttctattaggtttctttattcaagaaatacttgttgacctccttactgtcttagtgaacaaggatgattgagcagataaagggacatacagctgtgttcatggagcttacatatcagccaggcaaatggactttgccaaactagtaactgcacagtaatacaaaggagaaatgtaattgggaacctatcctagtttatggaatcagggaagggtcctttggtttaagatttgaagtatatgtagaatttactaggagctgtaccaagaatatagacataggttttagctgttgtaatcatttgaatgtggtgttatgtagaacagcattatttgacttttcaaattgaacatttctgttcataagtcctttctggaggtagacaggataatacacatttagataaacttttatttatttatttatttttttgagacagggtcttactctctcacccaggctagagtgcagtggcatgatctcaactcacagcaacctctgcctcctgggcttaagcgatcctcccacttcagccccctgagtactgggactataggtgcacaccaccatgcctggctaataattttttttgtattttttgtagagaccgtgtttgccatattgcccaggctggtctcaaactcctgggctcaagtgatcctcccgttttggcctcccaaagtgctgggattacaggcatgagccatggagcctgggctagataaacgtttagtgttttatgtctgaaaataagtgacttaaggtgtgtgtatgtgtgtgtgtgtgtgatatatatatatgtttgttgttgttgttcttgttttttgagagacagggtttggctctgttgcccaggctggagtgtggtggccaatcaaggcccactgcagccccaacctcccaggctcaatcaatcctcctgagtagctaggaccacaggtgcatgctaccatgactggctgatttttttttttttttttttttttttttttgtagaaacagggtctagctgtgttgctgaggctggtctcgaactcctgggctcagatgatcctcctgtcttggcctcccaacgtgctgggattatagatgtcagcatcatgcctcaccttttttatttatttttgtttgttaaaatgtattaagaggattatacagaaaaaagaaaaatagaaggactataatgatgaattatttatttagtcaccttgctgtcatctgagctttttggtcattttggttctcttgcataacttgtggctgttctaaggtgcctgttcatcttgttctcctttttatagctttttcttctttgtatctgtaataactggtaatttttttttaacaaaatggtttaccatacttacgttgaatgcttggattttccaggtgtatttctaaaaatacttatttagtaggtaatatgcaaataatatgaaatttaaaaggcaaaaaaggctgggcatggtggctcacacctgtaatcccagcactttgggaggccgaagtgggcagatcacttgaggtcaggagttcaagaccagcctagccaacatggtgaaactctgtctctactaaaaatacaaaatttagctgggtgtggtggcaggcacctgtaatcccagctacttgggaggctgaggcaggagaatcgcttgaacctgggaggtggaggttgcagtgagccgagattgtgccactgcattctagcctgggagacaaagcaagactcccatctcaaaaaaaaaacacaaaaacccaaaaggctgtaaagaatgttatatgggttctttccattcctattccctccttaaccatttctctacccagaatcagtctgttaacagtttaatggcattgcttcattttaaaaaatgattgcattgtatttcattttatggatgtgccaaaatttacataattgttattctgttgatgaaagtttaggatgtcagttttttctattaaaatttttctattaaaatttataaatttatgtttgttagtaaatattctagtattttcttaatggtttcaggtgatgatttaagagaccttgatagaagtgctaggcattagtgtatcacacaattttgtgaaaagttcatttttacctctacccatttgaaatgctaccttaagtttttctgtgtatctgggtgtattttcattctcattctgttgcattgatctgtccactcatgttgcactgttatactctttattatgttttcatgtctgataggacatccaccctctcagacatgcttttttcccttcagcaattactcttccctgtttcagagttttcttgtgtattcttattttgtttctctatataaattctagaatcaatttgttatttataagaacaaattttttgatatttctggaattatcactttaatttgttacggtatctgaaagaatgtacgtctttataatggcaaatgtcaggctgagaactgtgcagtcttattttaaatgtgtatttgtttaagtgattttcagatgtcacttcatgatgctttgtaaaaaatctctaaagagtatcatgaaatgcacatgtaagtttgaaataattgtctaactttgtgctaaatgtatcttacttgattctcgtacaggctaatagaaggaagtattgaaggattaagttgcattatgaaaaaagacttaaaactgaaaacatcaattagtttttctctaagttgggaaatgatttgtattgattgatttttgtgatggcacactttggtccagttaaaggaacatcattttgcttcagagtatagtttaaaaataccttagacatttaatctagcaaatcatttttgtcaaggacagtatttttgccaaactatcaaaaaatttcacttttcttagttgaatatcatgaggtattatcttgaacagcatttgtgatggttaattttctgtgtcaacttgactgggcaacaggatgtccagacattcagccagccatttctggatatgtgtgtggaggtgttttctggatgagatgaacatttaaatcagactgagaaaaacagatgccctccctagtgtaagtatgccttatccagccagttgaagacataaatagaacgaaaaggttgattcttcagtgaataagagagaacttctgctgactgcctttgagctgggactttttttttttctttctttttttctcctgcctttggactcaaactgaagtattggctgctcttccaggtctccagtttgccagccttcagacttgaactacaccattggtagtcctggttctaaggcctttggacttggactggaactactccattggctcccctgggtctctaggctctcctgcagtctgaactgcagatcgtgggacttgtcagcctccagatttcccatggccaattccttattatcagtcaatatttctctctctccctctctctctgtcctattggttctatttctttggagatccccaagtaaaagtaatctgagcacttcatctagatttactaacattttatttatttacttacttacttattttgagatggagtctcgctctgttgcccaggctggagtgcagtggcatcacctctgctcactgcaacctctgcctccctggttcgtgattctcctgcctcagcctcccgagtagctgggattacaggcgcccgccaccacatctggctaatttttttctatttttagtagagatggggtttcatcacgttggccaggttggtcttgaactcgtgacctcaagtgatctgcctgtcttggcctcccaaggtgctgggattacaggcatgagccaccatgcccagccaatagatttactagcatttaatcggtaaatcaattagtgtgggtgtataatttgatgctttatatggtgtttttactttctgtcataaatatgctgatgacttgatgatctttttttgtagccccagtctcagtgtcactgaatggcatttcctaaacatcccaaactcattgtgcacataaacccttttttgtcatcttcccccattcccattcctcttccctgttgctctgcctttcctatttcagtgaaaggcattactaatcttctagttgcctatgctcagaacttcaagattgtttcaaccccttccttcatagttttctcaccttcagctttttttgttgttgtttttggcagcatctcccttttcctttttcaccccactgcctaggttctcatatttactaacattcttgtagtagcctcccagcggatctccttgtgtctaatctcatttacctactagctgtcctccttactcatgttaacatagaattactatatgacccagtaatttcactcctaggtatatgtttacgagacttgaaaacaaatattcaaacaaatactttataagaattctcataataggactgttcatagtgaccaaacgattgaaacaacctgcatgttcatcagcagatgaatggataaataaatatggtatatccacacgctggaatattatattcagctataaaaaggaatgaagtactgatacattctacagtgtggagcaacctcagaaacatgcaaagcagaaggcggcagacacaaaaagtcacgtattttcatgtaattccataatatatgaaatatctagaataggtaaatccataatactccgggggctacagtgaagagaggaatggggaataactacttaatgggtgtgggcttgtctttggaggtgctgaaaatattttggaactagatggaggtaatggttacataaccttacaaatgcactaaaaacccctgaattgtatgctttaaagtggttaaatttatggtatgtgagattcatttcagttttataaatgatgtaagtatcttgtactttaatgtgtctgtgtgcttttatatactttttcttttctctatttctcctctatcccctagtctccagactctcatgacaactcctctctgcaggtttttatagtctctcctgggaagaattaattgttcacccaccaatcatccctagttctgttttttgagatgggttctttaaaactttttttttaatttaaactttaaaaatttaaatttataatttcagttaacctcttaaatttgaattgaggttgggtgtggtggctcacatctgtaatcccagcactttgggaggccgaggcgggtggatcacgaggtcaggagctcaagaccagcctggccaacatggtaagacccagtctctactaaagatacaaaaaattagcgaggtgtggtggcacatgcctgtaatcccagctactcaggaggctgaggaaggagaatcgcttgagctcgggaggtggaggttgcagtgagctgagatcgtgtgattgcactccaccctgggtgacagggcaagattccatcccccccgcccccaacaaaaatgaattgataccaacttatcttcaatagcatacaaaaactctgttcttctatagccctgtcctccttttatgttatcacaaagtacatctttatatgttgtgtgccatttgataaacatgttttatgcatttgatttttaaatcacataggaaacaaaaagagaagtgacaaactaaaaatacaacaatattggcttttatatttacttagggagttacctttattgatgttcgttatttcttatggcttctagttactatctatctagtatcctttaatttcatcctgaaggactgtctttaggatttcttgtaggtcaggtttactagtaacaaactctgtcagcttttgtttagcttgaaatgtcttaatttctcctttagttttgaaggattgttttgctaagtataaaatcttggttgacagtttttttttttttctgttaggatgttaaatacattgtctcactgttttctggtctcgtggtttctgatgagaaattgggttttaatcttactgagactccttgctgctttcaagattctcgttgtctttgtttttgactgattataatgtgtcttagtgtgggtttgagtttatcttgcttgaagtttgttaagctttttggatttgtagattcacgtcttcaagttttggagttttcagtcattagttaatcatgtatcatttcttcatccctctctcttgcttttctttttgtaacttcataatgcatttgttaactggcagatcccttaggctgtgttcatttttcttcattctttttctttctgctcctcagactcaataattttaattgtcttcaaattcagtaattttccctgcttttgacattatccatggtgtcatgtacttttaactgttgttattatagcatttatctataataatgtgttgaatttcttattattggaggactgaacttacttctttattccctcagaacctagcatacaatagacacaataactatgtgttgaatgagttactgaatgaatgttggaaagtgtgtagaatctgagggttttagaattggaaggggtattagagaatatttgtttttttcttttagaactagtgtatgatttaggaacttctggtatcttgagccaaataatgaacccccagttatattttcttggttgagaaagacctgaaaaatttccagcctttttagtctattatattgttccacccttttcatacttaaccctttttagagcagtagtctttaaaatatggtcaacagacccctgtggatcaccaagacccttttagggggttatatgggtccaaaaggtcaaatgattttgatactactacttaggcttttttgtccttacttgctatattgacgcacgtcttgatgatataaaagcataggtgggtgaaaaccagtagcacctaatcattaattaaggcaaactgtactagtaatcattgtacagttttccattgaacaacataggtctgacctttgtgggtccatgtatacatgaattttcttccatacacagcaagaccaccaactccctaagttttgggagggtcaaaaattatatgcaggtttttgattgtgtgatgggttggtgcctgtaacacctgtgttattcaaaagtcaactgtatttttaatgccacacacccacagttaaaaaaaaaaatcagttttacctaatgtgcacattaaaagcagtaaaaaaaaaaaagaaaagaaaagaaaagaaaaattgattctggtgtggtagctcacacctgtaatcccaacacttttggaagctgaggtggttggattgcttgagcccaggagtttgagaccagcctgggcagcatggtgaaaccctgtctctacaaaaaaaaaaaaaatacaaaaattagctggttgtggtagtgtgtgcctgtagtttcagctactccctaatgactaataatggtgagcatagtttcatgtacttattgactatctgtatatcttttttggataaatgtctattcaagcagtttgcctgttttgaattgagttgttttttgttgaagtgtagttttttttttatgtatattctggctattagtctctgagaagtttaatgatttgcaatccatatatgacacacatcttgatgatacaaaagcaaaggcgggtgaaaaccagtagcacctaatcattaattaaggcaaactgtacttgtaatcattgcacagttttccattgaacaacatactctgaggttggaggatccccaactcaggaggttgaggctgtggtgagccatgactgtgccactgcactcccgcctgggtgacagagtgagaccctgtttttttttttttataaatatgtataacagaatttacaatttcaaccttttttcttgtacagttcggtggcgttaagtacattcagttgtgtagcactcatcattatctccagaacttttttccattttcccaaactgaaactttgtatccattaaacattaactccccattttcttctcccccaacaacccttttattttctgtctctatgcacatcaaaagcacaagcagagaccacttcatatccattagaatggctattatcaaaaaacagaaaataacaaatgttagtgaggatgtcaaaacaagaaccctggcacattgctggtcagaatataaaatggtgcagctgctatagaaaactgtatggcagtttctaaaaaatttaaacatactattaccgtgattcagtaattccacctgagtataaactcctaaagaataaagccaggactcaaacagatatatgcacacccataattccaatgttccacagcagcattattcacaacagccaaaaggtgaaagcaacccaagtgtccaacaacagataaatgaataaacataatgtagtgtatacatacagcagaatcattcagccttaaaaagaaaggatattctgacacatgctacaacacagatgtacctcaaaaacattatgctaagtgaattaaactagtcacaaaagaacaaattgtatgattctacttatatgagacacctagagtagtcacattgataggtctgacctttgtgggtccatgtatacatgaattttcttccttatgcagcaagaccaccaactccctaagttttttggtggggggggtcaaaaattatatgcaggtttttgattgtgtgatgggttggtgcctgtaacacctgtgttattcagaagtcaactgtatttttaatgccacacacagtttaaaaaagaaattagtttctcctaatgtgcacattaaaagtagtaaaaatggccaattttgttaaatcttgatccttgagtacatttttgtgtgtgtgcattttttccttgtaaaaataatccatgggagggcatggtggctcatgcctgtaatcccagcactttgggaggccgagggaggtgggtggatcacctgaggtcaggagtttgagaccagcctagccaacatggtggaaccccgtctctactaaaaatacaaaaattagccggcagtggtggcgcatgcctgtaatcacagctacttgggaggctgaggcaggagaacaacttgaacctgggaggcggaggttgcagtgagctgagatcatgccactgcactccagcctgtgcaattcagctcttgctgaatgcacttattagctgtaaacgttttttttcataaattccttggggtttgctatgcagataatcatgtcatctgcaaataaggacagttttatttcttcatttataattttttctattttatttccttttcttgccctattgtacttgctagaatttccagcaccatgtgtaataagactgatgagaataaacagttattgccttgttcctgatcaacattcgatctttctccattagatgtaatgttagctgtaggttttttttttcttttttttttttaggtgctttttatcaagttgaggaaattctctattcttgatttctgagggattttatcatgaatgattgttgaattttgtcagaagcctcttctgcattaattgatttgaccatgcagtttttctttttagtctgttaatgtggtgcatcacattgaggttctaatcttgaactagctttgcattcctggaataaattacacttatctgtgttgtaaaattctttttatatgttgctgaattttattcactaatattttgttaagaatgtttacatttggccgggtgcggtggctcacgcctgtaatcccagcactttgggaggctgagatgggtggatcacctgaggtcgggagtttgagacccacctgaccaacactgagaaaccccgtctctactaaaaatacaaaattagccaggtgtggtggcgcatgcctgtaatcctagctacttgggaagctgaggcaggagaattgcttgaacctgggaggtggaggttgcggtgagcccaggtggcgccattgcactccagcttgggcaacaagagcgaaactgtctcaaaaaaaaaaaaaaaaaaaaaaggaatgggtacatctgtattaatgaaggtggttggtctatagttttccttttttggatgctgtgtctggttttgatatcagagtaccatagcactaacttcataaaatgaattgagatgtgttccctcttgtagaagagagtgtgtagaattttaaagattctttaaacatttggtaaaaatctctggtggaaaccatctggacctggagatttctttttggggaattttaagattgcaaactcaatttccttaattgttatagggctattcaaattatctgtttcatattgagtgagttgtggtagcttgtattatttgaggaagtggtccattttatctaagttgtcaaatttatatgcctagagttgttcatagtatttcctttttatcctttggatgcctgtagggtctgtagtgatatcctgttttattcctgatattgataattcttgcttccctcttgtttctttgtcattctggctagaggcttttcagttgtattgttcttttcaaataaccagttctttgcttcatttaattttttctgcatttttatgtttttgttttcattggtctctgctctaacctttattatttcattccttttacttgcttgggttagttttcttcttctttttctaggttcttgaggtgggaatttactacagattattgatttgagactgtgtcttttttcatgtgtacctttggtattcagaatttctctcagcactgctttagctatgccccacagatttttgttatgttgtattttcaacatattttatatgctagttaaaggatttttatgatggctcttgctttatttatttatttatttatttatttatttcgagacagggtcttgctctgttgcccaggctggagtatggtgatgtgatcgcagctcactgtaacctccaacctctgggctcaagcgagcctcctgaatagctgggactacaggtatgagccaccatgcctgtctaattttttaatttttatttttgtagagatggggtctcactatgttgcccagccttggtggctgctttaaagtctttgtaagatcattttaacatctctactttgtgttgggatctgttgatggttttttccccattctgtttcagatcttcctggttcttgatatggggtgattttttttttttttagtggatgcatggattttgggaggttatgttatgagactctaggtttttttttttcagatgggctctcactgtcacccaggctgaagtgcggtggcaccatcgtggctcactgcagccttgatctcttaggctcagcagtcctcccacctcagcctcctgaatacctgggattacaggtgtgtgtcaccacgcctggctgattttgtttttttttttctgtgaagacggggtttcaccatgttgccccgggctggccttgaactcctgacctcaagcaatccacccaccccggcctccgtatagtgctgagattacaggcatgtgccactgtgcttagccaagatggtagattttacttaatcttaactgggtttctctgacactgccccatcaggagaaggaggtactctggtactgttgtgtgcaagtagaagttctggctttccagtaggtctccactgacaccgtggggaggggagaaggagtatatggtcccattattgctgtaccatggtgaaagtcctgttgttccactaggcctcctgtgatacagcccagtggggagtgtttctttattgctgagtgggattggaagtctaggttccctactttgctttctctgacactgctctggtagggatgttgggctcattacagtactgtgagggtggaagtctaggcttaccgttttctttgctggtatgggtgtggcagaagattttttcgatggtgtttggctggagcagagctgtttttgtgtaaaatgttttctgttttgctgttttagtagaaaaatcatgacctatattaaaattttaatataatcataaaagctctatcacacctaaaaaagttaactatgactcttggttatctgaagcccagtccatgttcagtagcccagatttcctcaaaaatgtctgtatagttagtcttcaaaatagaatccaacaatgtccacacatgacttttgataaacaggtctcttaagtgcccccccttttttcccatgcagtttatttgttgagaagactgtgtcacatggattttagaatttgtctaatttcatttggctaattcagccctcatgatgtgattcccaaggaatgttttattgattgttggttgtgcatttctgttgcatcacattaggagacaaataatgtcacattattcactaataatagttacttagacccatcatttcatcaggttgcaaagttgcgaatgtctaattctttcagtctttctgaatttattaggtgtgatagagctttcagtctttctggaagaattagaaattcttcatttactatttagaattctctaacagtggttctcaaaagtattgttcccaggctgccagcatcagtatcacctgagaacttactgaaaatgcaaattcatgagtcctttcccagacagaaactatgtaagcagtgaccagtactctgttttaacaagctttcttggtgattccgaggcacactggaatttgaatacctgttctacaagagctttccttcatcagcctttggttattctgaaatacagtacatattaggaaaagcagggtaattttttccctttgtcaattgagttagttttttttgcgacctctattttttaatatatatttttatttttgagacggagtattgctctgtcacccaggatggagtgcagtggtgcgatcttggctcactgcaacctccacctcccaggttcaagtgattctcatgcctcagcctcccgagtagcagggattacaggcatgcaccaccacgtctggctaatttctgtatttttagtagagacagggtttcttcacgttgcccaggctcatcttgaactcctggcctcaagtgatccacccactttggcctcccaaagtgctgtgattataggcatgagccaccatgcctggcctattttttttaaaagttatcattttgaactcatggatttgtatatgtttgtatttcagactattgtttttatttttgatgcccttttgtcagtggcagcctcttggaagattgcttgtgtcctttggatacaattgcagtttttaaaatcacttttatcctttgtagcgtgccaagatgtccttggtacattttgtgcatttcctgcttttatttgccagaggacatgagacttgatctgcttttatttattttattttttatattttttgatactgagtctcgctctgtcgtccaggctggagtgcggtggtgtcatcttggctcactgtaacctccacctcctgggttcaagtgattcttgtgcctcagcctcctgagtagctgggattacaggtgtgcaccaccatgcctggctaatttttgtatttttagtagagatggggtttcaccatgttggccaggctggtctcgaactcatgtcctctggtgatccacccgcctctgcctcccaaaatgctgggattacaggtgtgagcttctgtgcccagctttgatctgcttttattaatgaaatgttttttagggaccacagtgtggggcttgagagtgctgattgatttcactgtaatttacatttaattacagtttccctttgaacaatatgggtttgaactgcccaggtccacttctatgtgaatttttttcagtaaaagttacatgagtgtgtctgccttcctttccacctccttcaccccttctgcctttgacactcctgagacagcaagaccaaccgctcctcttccccctcttcctccttagcctattcaacattaaaatgacaaagagaaaacctttttgatgaaaacacctccacttaataatagatgttttctttctatgattttcttaacattttcttttctctagcttactttagtgtcagaatacagtatatagtttatataacatacaaaatatgtgttatttatgttatcagtaaagtttctgctcagtgatagtctgttagtagttaagttttttgggagtcagaagttatacatgggttttttactgcacagggcgttggacccctttacccccaattgttgaagggtcaactgtactttaataattgtttcattggtaaaatgaggataacttaccttgtagggttgttttgaaggttaaatgagatacataataaacttagaacagtgctcaggtcataaaaattgtagtcaatattatttctttcaatttatttgtaaaacaaaaaagttttagtctcaatttcattctagaagtgtaatgtgaataaatgggtatggtgtatattcttccataactgttccagttgacagtgtattttatggtggtctaatggtccaggatgaagtttattcttctcaggacttttataattcatttgttgcatatactgaaattgaaggtttaaaaattatttttttcacaaaaatttctcaggaatttgcatttcctttggccttttagaatggaaaagatgttcctttgcctggacctgggtgttcttttgttctccttaaccaagcattgatacaggagaagccatggataaatgcacctacaggacaaagtcagttggtggagtaccaggccagcactatgctgaagcctttttcagcatgtaggctcagattaatcatgtaatatataatttgtatgtttctcttttataacttaattctttgttggtaactccccttcttcccccccccccgattcttcttgatctttcccaaagatatagttattgtttactgtgtttgtgtgtgtgtgtaacttaatactatgtctttgatatttttccatatcaatacatcaatcgctttcatttttgaacagctgcagaatattgtgtagattgtatggatgtgccatggtttattcagttctttctcgatgctgtcatgaatatccttaatgatttctttgtgcatttatgagaaatatatccatatccataggataaattcttagaagtaaaatttgcaaggtgaagaaggtatgtgcatttatgttttctgatagatattgccaagtcgtttttctgagaggttgtattaatttatgatttaaccaccagtgtctgaaggtatctaaatttggtcatctcacccatacttttgtcaattttagttggtgtcagactttagtcttggtcactctagtaggttgaaaatggtagttggttttaattctttaacatttgtgtttctttgtacttcctgtgcacatgtcttgactgtttttctataggttattgctttgtaagaactgtagagtgaaggaaggaaaatgaaaatagttgaacttcaatacatttaaaaaacgtacgaatgagtgctaaggaagtttgtctttcataatctgaattaaaaattgttgaggtttctgacagcagtgtaattttacatgtgttcccctctctgctgtgctggctgaggttaatgatcagaaactaagttactggaacaagtaattaaagccacaggtctaggccaaaatgtattcagtaaatgttgatcaaattaggagctagctgttgggtttgattctggtagatttgacagtcattgctctcaatggaacttagtttagttgtgaagcactacatgaaataaaaataattatagttagggtagatgtgccataggaatagtatggagtgctatgaaagcatctcagggctgcctaacctatgtgggctcgttggtcagggaaaactggaggaacccatttaactgaggtctaaaatatggtaggagttggggaacttggaggatagtgttggaaaagagtagtgtaaatggtggagacctctttgtttaaggcctttggttcatattaaggattttaaaatgctgtttggaaaacaatagaaaatcttcaaaggcttgtaagcaagaattgacaggatccatccctactgtgtaatttgaaatgtgaacctgaactctcccaaggaataggctgccaaatctgagacctcctggcagtagtacaggagtacatcacctctacccacttttcacccacctctgctgtggagaagcagccagctgtgtctgactgaactctttgtcctgtctgggacagatagaatccattgaagaatcatctcttgatatgctttctgtggcaaagatgttgactaacttaaagcagtttttggctgacaaccacctatccatccataggaacacgtcttccccacaatgccacaggcggaaggaaaagtcttgaagttgttagaatctataggttttggaaacaggttcagaaaaacactctcaggatacaagtctgcacagcacagacctttcatttttgcctcagaaaatgctgatttccacaagtgtgtgtttttaatttgtttgttgcactacattttaaaaatgaatgcttaggtataaaattatcttagggttaaggaactgaattagatctatctccatgcttttctgaactaaaagaaacaggatttagttgagagagaatctagtaagttggagataggcctgctgtggggagagtgattactgcaataggacttaagatagcatgaggataccaaagaattcggagaaaagggttctataagatggaagataagtttagggccttttaaaagccatacttaagaggaagtgctacataattaactccttggtttcaggagagatacgtggggattattaatgaaaaatttttatgatttttaaaaatgtttataaatggagcccgtgtaggtgataattgagaaaacctgaagattatccagaaagttaggaacaggttccttttgattaattgttctagtatatttgagactatgcagaaaacctttcttcaattctcatttgaatttcactcaacttcaagaatacttaatgtagtagtattctgcattaaactctaatggggaattctttttttccacctgaaattgagcagtgtttgtagttcattctgaaagacaattactgtaaagaactatttaattctagaaggtgtagtaaatattttcttgttaattgcttccttttagagtggaggtgcaacaaatgagaaattccaattggagattttgtcaaacaggaatttactgtaagtgaataaaaacacttttcttctatgtaagtaccacttgcctaaaaagcttagaaatttttagggatgattagatgtgggtaaggaggtactgcatagaaaaatgaaaggcaaaattcctgtgatcacaactctagttttgaattctttcttctttccttgcctattgcagtattcttagtgttcagtgttacctacttctagatttcatgacgtacctcagggtatcccattcacccctgctcccaaattaaaacttcagtacttctctttttgtttataaaatgaagctgaaacacttgttagcttggtgtttagtttaagtcttcccttctttgcaactttacacttcattattccctcatatataatgtacagtgcattcattaggtcatgaggggagcttctttctgccaagaatattcttttcactaatgtttcataacacatttacacatatggcttaagtagacttttatcaacttgaccgttgagtcgtcttttattcctagtagctaatgcggtgtctgtgaatggtagataccaagtaattatttgttgactgtatgagtggcatgagatcttaatcatttataattatcctttagttaaatgcatttatagttccacctaactcaaactttaggaagataattaaattacacttaaaatttgaggatttaatatgtgtatactatataagcaggatatatagaatctttttctagtctatagtcattcattttaccagggaaataaatgaggatgtctagtaattgttaataaatctttaatagatttttgtttcaaaatgacttttctcctgattttcttgtacaagacctgtagtaatgctcattcctcccattgatatgtatgtgtatgtatatgtacatgtgcatatatttctgtttgtgtgtgtgtatatgtgcatgtgtgcatgcgtgtgtgtgtgtttccttattcaatttcctgctgctgctttccatgtagaaggtttccctcggaatgatggttcttatgtttatagataacaggattttagctgtttattgtatttatcagcattgccatctactgtagttttaaattcagtcttcataaaccatggatgattaatttagattatgatattttgcagcatataaaaatgagtatacatatggtatgtacaatgtaagaaaataggtaacatttctcctaccactttctaccattatgaacaactaaaactatgaactgattatgaagtagtggaactagagatgacattttaatcctttcactgagtaagtctgtttcatattgtttaatagtctggactctgatttctttttgaagcttgttaattgatcttttagatgaattgtttgtggtaggttatataactgtctcctggttatatgatgaactgaacatttattaccatgccccttctgggggatgtgctcaactttttaggtaattgtattagtctcctctcacattgctataaagaactgagactgggtaatttttgaagaaaagaaatttaattgactcacagttctgcattgctggggaggcctcaggaaacttacagtcatggcacccaccaggcccctcccctgacatgtggagattataatttgacatgagatttgggtggggacacagccaaaccatatcattccaccccggcccctcccaaatctcatgtccttcttacatttcaaaaccaatcatgctttcccagtagtcctccagagtcttaactcattctagcattaactcaaaagtccaagcccaaagtctcacctgagataaggcaagtccctcccacctatgagcctgtaaaataaaaaacaaattagttacttccaagatacaacgggggtatcataggtatttggtaaatgctcctgttccagaagggagaaattggccaaaacaagaggggtataggccccatgcaagtccgaaacccagcagggcagccattaaaccttaaagctccaaaatcacctttgactccctgtctcacatccagggcacactgatgcaaggggtgggctcccactgccttgggcagctccttcatgggatgatgttgactgcctgtaacttttccaggcacgaatgcaagttgtctgtggatctaccattctgaggtctggaggacagtggccctcttcttgaactccactaggcagtgcctcgtggggaccccatgtgagagctccaatcccacatttcccctacgcactgccccagcagagattctccatgagggctctgcctctgcaacagacttttgcctggacatccaggtgtttccatatatcctctgaaatctgggtggaggttcccaaaccttaagtattgccttctgtgcatccacaggcccacaatcacatggaagccgccaaggcttggggcttgcaccctctgaagcaatggcccaagctgtgccctggccccttttagccatggctagagctggagcagctgggaggtagggcaccaaatcctgagattgcacaaagcaacaaggccctgggcctggctcaggaaaccattttttcctcctcggcctctgggcctgtgatgggagaggctgccatgaaggtctctgacatgccctggagacgttttccccattgtcttgaggatgaacatttggccccttgttacttgcaaatttctgcagcccacctgaatttctcttcagaaaatgggttttcttttctgttgtatcctcaggctgcaaatttttcgaacttttatgttccatttctcttttaaacataagttccaattccaaaccgtatctttgtgaatgcctggaactgaatgcttttaagagggcccaagtcactttaatgctttgctggctagaaatttcttccaccagataccctaaatcatctcttttaacctcaaagttccacagatctctagggcaggggcaaaatgctgcccgtcttgttgctaaagcatagtgagagtcacctttattccagtttccaacaggttcctcatctccatctgagaccacttcagcctggacttcattgtctacttcactatcagcattttggtcaaagccattcaacaagtctctagggagttccaaactttcccacatctttctgttttcttcagagccctccaaactgttccaacctctgcctgttacccagttccaaagtggcttccacattttcaggtatctttacagcagtgccccactacttggtaccaatttactgtattagtctgttctcatgctgttacgaagaaatacctgaaactgggtaatttataaaggaaagagatttaattgactcacagttcttcagggctggggagacctcaggaaacttacaatcatgacagaagaggaagcaaacacgtccttattcacatggtggcaggaagaagtacagagtgaagtgggggaaagctctttatgaaaccatcagatctcatgagaactcacttactaacatgagaaaaacatggaggtagctgcccccatgatcagttatctcccacctggttcctcctatgacatgggattatgggaaccacaattcaagatttgggtggggacacagccaaactgtatcacaagtatatgttatttatgattgtttctgtgttggtgtgatatattcatggggagaagaaataaggaaaaaaaaagtaacattttagtgatgtgacctatcatctgccaatttgtatggaacttgcaaactcctgattgaacaggaaacgttaattttagtctgtacttagcgtggtccctggtacatggcaaacattaaaataataaatgctatttaaattgaatggacggtttggaaaaccggtgtttttggaaagaaccccatgagcaacagaaacataggaattaactaagtcagacctgtcacttagtcttacattctttgttgccaacagtggcatttctttgtggaattatgacatggtttgttttccctttctgttaactgtttctcttttaataacaatttatggctctgttatttttaaaaatatcaaaattcatttggaaattttttgtgtgattttcttggattgcttgctgtgattaccgccattaattatttgctgtatgtatagggacacataattttaaatggaagtaaatttctttccctgaaaatttagggaagggcataagttgtgatgattgctgggtatttttcatatttttgcttggtcctacaaagataaaagtgaaaatagtatcttggtatttggaccccatgctcaatcacctcatatggaatttgtcctttggaaaacactggtaaatatatttttaaatcttgtaaatttttattttagtgtatattgtaaaagcaattctgaattctttgagagattgatataacccatgaatttaaaaaacattctagggccaggcacagtggctcacaccagtaatcccagcactttgggaggcctaggtgggagggtcacttgagctcaggagttcaagaccagcctgggcaacaaagtaagaccttatctctacaaaaaatttaaaaaattagccaggcatggtggcgtgtgcctgtggttccagctacttggaagctgaggcaggaggattgctagagcccaggaggtcgaggctgcagtgagcctttagtctgggagacagaacttgtctcaaacaaaaaaaacaaaaacattttttttgtttttgtggtaataaatattatttaccatcttcattttttccgtgtacagtccagtagtgttaagtacattgttgtgtagccagtttccagaactgttcattttgcaaaactgagactctgtacccatgaataatttcctattctcctcccattcccacagcctttggcaactatccttctactctttttttctatgaatttgagtacctccaataagtagaatcatacagtggtttgtcttttttcatgactcgattatttcacctggcatgatgtcctggagattcatccatgttgtaacatgcgtcaacatttccttcttctataaggctgaataatactttattgaatatataattcacattttgtttattcattgatcagtgggttaggttgctcttaactcttggctattgtgaataatgctgctaacattgtaaaatatttttatttcagttgctactttttgttttgcattgttttatctttttcttcttttcagttgctacttttgagtctcaaagattaacatgcccttttaattatgacaggaagcatggtctagttgttaagagggatttgcttggctgttggactttttggattccaatcctggcttatctcttcctcattatttccctgagggcaaataatgtttttggctttgtttgttcagctgccaaatagagacatattgttaggattgagataatgtatgtaaagtgcttggaatagtgtgtagcacatagtaaaagtgcagtgaaaggattgtttgttcaggtacccattcaaaagtgatgcaggcaatctcccaattagataatacaaatttgagtttctaaactcatttgacactgggaaggcaaaaatctggattgaacaataccaatctattttgtgggtgggattgagagggcaaggatgggtacaaaagagacaggactgaatgttaggatagggtcccgatatcttaaccagttgtacactgtggtttatctaaccagacaaggagcctgaaaaccagaagctggtctctgttatagccatctcttcttatttttattccatgccagcaacttgcaaaatcatgaaaagtggtagacagcaatttaaacagacaaaccaggttatacagtggcatggcacaggtttgtaaagtttgatcagttgtgacttagtatatgagaaggttgggcttctggttgctcctcgagaatgatgtgaactcagaggtgactttttaatatgtcaaatgcttaaatttgtaaattgaatacttaacatctagaggaccacatgtagcctgatcaagatttttgtcttaaatccaataagatagcccacatcaataggatactgcataattggtcctgaccataagtttcctacaccactgtactatggatgccacaaggtatgatgcttctgaatataactgtactacattgagtgattcaaatttaattctagtaaaatataagaatagtataaaatattatgttcaacactgttttccttatgtataatcttatttgagtcatattcagtagtagtatgctatttaacattgtaaccagtaaaaatgtactgtggcccacaactgttgaaatcttgtctatttccttagagaaatgactacacccacagagcatagtgagtaggggaatatttttgtcataatgaattcagtttaaaatttatggccatgtaatctaaagacagaaacatctaaacttttcccatttactctccctagcagttaatctattagcttggcaaatatttattgcataaacaaaaaatagtaattgattgaagggacatctctttcaacctgttttacatttcatgctcttctgttgtttcacaatagcttaataatgatttcgaattaacatgtctattaaaacaatcctaaattcaatgtaggatttagggtgccatcttaataacatgagcaatcaccatcttattttaaatgactatatttcatatagtttgtaatggttttactaaaatttaatacaggatagagtcaccgagatgcatttttacatagacattagttctggcgattttagcagcagtgactggttagtttggtagtaaaatgagagactagggttgaaatgatacataaaggttagtagggttattttagttctcaaaatgcttaatttaggtattgagaaagtttgtccaagtaaagatgttttaagtagatttttaactttttcttatttttcagccaaaccaaacaggaagcttacttttctctacctagccaatgatgtcatacagaacagcaagaggaaggggccagagtttacaaaagattttgcaccagttatagtggaggcttttaagcatgtttcaaggtatgatcatagttttgggtattaggtaatctgttttaaatgtaccatatgtccttttgctaaaatttgccttaaactattaaaataaaaagtagggaatatagttttttgatgcttttatttgaaaagacttccctctacatggcatttataaatgtattaaatgccttctctgaaggaaaaatattttttgaactgttgctaaggtgggcctttggagtacttgaattacagctttcctttaagagaccagaaccaactgctatattggaatgaacttcattaaaaatgaatgaaggtattgaagtaaaaatttgtgtgtttataaagctatcagtcttgtaacaaatatttccatatacacttagtactgtttctattcttttttttttttttttttttttttttgagacagagtctcactctcacccaggctggagtacagtggtgcgatcttggctcactgcaacctctgccgcttgggttcaagcgattctcctacttcagcctcgcaagtagctggaattacaggtgcctgccaccatgcctggctaatttttgtgtttttagtagagacaaggtttcaccatcttggccaggctggtcttgaactcctgacctcgtgatccacctgcctcggcctcccaaagtgctgggattacaaacgtgagccaccatgtctggcctgtttccattctttacttgccctctgggtaattttgtacatcgcatgtatttggttattctccacaccgtaatgacttacagttttatgctccagtccagatttttttttgttccaaacctgtgtgcccaattgccttttgacatttttacttgtatgcgtctcaaacatttcagactcactgtgtctgatacagaactcattatgtccttgcttcccaccgtacttgtccctcctgtaggttttatactctgtgaatggcaactcgatctatccaggtgcctatgcaagaaattatgttacctttaaactcttctttctccttcagtccccatatctcacatagtacacattgactcggttctttggatttctttcccttttagttaccataatgtattttcagtataattttaatgccctttagtattgtttaatttctttagaaaactcgacagagttgcagagctggtcataatacttccttgcctttgagtggttcccatttgttttagagatgaagtctaaagtcctgagcaagacttaaggtgttccttcgtggcactgcctatctccccagacctctgtctcgcatttattccacacagtctatagtctacagtttaagctaaattaaccttttttagttctttccgccttaagtcttctatatatgttgcccctccctagaattcagtaaaatatttattggctgcataaatatttattatatgcaaaaccctgagtagtagtgaccaagacagttttgttctactggagcctacatttcattggatgacaaagttaataagtagatagacaagtgaatgcataatgtcagatgacaaatgctagcaagaaatacaaagcagggaaggaactagatagtatgagggcgctcagttatgtgatgagataaagaacaactatttggggaaggtggcatttgaacaaagactaaaggaaggggtgaaatgagccatttgactaggcagaaaggattctaggtagagagaatatgtggccgaaaaaatgagatagcttatatgctggacatgtttgaggaccttagcaaggagatttgtatggtactaggtattagggagtgtgtactgagggactgccagaaagcagagcatgtgggccttatggcccagagtaaggattttggttttattcttgatgtgattggtagctcttggaggatcaagagctgtataatctgatttacattattaggatgctttgtacagaatagagtaaaagagtagaggctgggagagcgtgagaagactttacaaaattctaagcaagagatagtagtgtttctgtctacagtgatagcaatgaaggaggtaggaaacagttgggagtagtctgtttttcatttccccatatgtctagtcttaagatctcaaattaaatatcatttccttaaatactcttccggatatctcttaaacagggccaggtctgtcttaagcactttgttctcttttgtgatacttataaataacaactgccataagctgcatttgcatctccatgtcaaagatagtaactggatcaataagtatttgttgaataaatttaaaaaaataacctatgagaaatcttccttagccccatgtccaggccccattaggataggaaatccctagcagccagtactaaaacttttacagtttaaactttttttggttgtgtaataatatgtttataaaatgtttactagaagcaagcagtgtgtctagatcacttcacttttgagctgctggccacatagtgatgctaagtagacatttggacagttttttccagggaatgaatgtctgattatatttaaagttaccgttaaccttttcaataacactatgcattgttactgttaacatttttctttttttctttttttttttttttagtgaaactgatgaaagttgtaagaagcaccttggaagagtgttatctatttgggaagaaaggtctgtttatgaaaatgatgtattagaacaacttaaacaagctctgtgtaagtgtagaatcctgatctcttaccttgatctcttcattaaaatgtattctttcattaatacttaaatgttctttcatttcagatggtgataagaagcctaggaagcgaacttatgaacagataaaggtggatgaaaatgaaaactgttcctctctgggatctccaagtgaaccaccacaggtagaaattttaccctgttaaaagagttacaaacttttacttcatgttgccaccaagctttattaatttcgtttcacttctgtaaattgatttctattatacttttaggtacaagaaagaagccacatgaatatctcttcctcattaacaaattgcttatgttaaatgtagtatgttgtatattgtatattttgcatagaaatcatgttttgtatagaaagaggatttttaattgccaaatatggttagatgtgagatgttagctatttaaactttttaaaataaaacaaaacatgcctattttgttatgtgattttttttttttgagacggagtttcactctgtccccagggctggagttcagtggcactatcttggctcactgcaacctctgcctcctgggttcaagcgattctcctgccttagccttccaaatagctgagactacaggcacgggccaccaagcccagctaatttttgtgtttaatagagatggggtttcaccatgttggccaggctggtcttgaactcctggcctcaagtgatcctcccaccttggcctcccaaagtgctgggattataggcatgagccactgtgcccggctcatgtatgatttaaatacactaaaattttcattcttggacataatcactgcccctttaagtatttttgtttttaaatgtaaaaagtagtgttagagtggccgggcgcagtggctcacgcctgtaatcccagcactttgggaggccaaggtggtcggatcatgaggtcaggagatcgagaccatcctggctaatatggtgaaaccccgtctctactaaaaaatacaaaaaattagctgggcgtggtggcgggcgcctgtagtcccagctactcgggaggctgaggcaggagaatggcgtgaacctgggaggcggagcttgcagtgaaccgagatagcaccactgcactccatcctgggtgacagagcgagactccgtctcaaaaaaaaaaaaagtagtgttagagtgatatatatgtgttcatacatttctttgtaactatatagaactatgtaattctgtggaaaaataagttagaattattatcttaacactctgtgtcctcctacatgttggtatggtatggtattccttaaccatcagattaattccagaaagacttttttttttttttttttttaagtgggcattgagtctttaagcttcctccttctatgtttcaaacatgtaggcgggacagataaagtgtaaaatgagaaaatgaagacataaccatactcttaaaacaaggcgaatgtattttcatgggttagaaattgtacacctaacttcataggtgagacaaaacctggctcctgctgagccctggtcccgaagcagacatggggttgccagaaattagtatcctttaaggtcacaggaactcacaagggcaacaggaactcacagtgctccgtgggagttagaggactggttccaaattcactgaataaaatcagaggctgggaggagctctttcccccatgaaggtgaaagaaaaatacaatcaattactacctgtaactgtggatttatattagtctcagtactggagaagcagaaggaatcagaccaaggccacgacctgagtcagcctacctgtttgttcagtgataggaatgctgaagcccattggccactatggacaagagcttgaatagaaaagtgataagaatgttacatttggaacaaccaaacactaagatttatgtctcttcctatttggtaataactcatgacagaaaatcatttttggctaagagcctcatgattctatgaacagtgttttacctaagttctagataaaggatctggtctccttccgctctccctgatgaaagggtaaccacagttgcatatcttaggagtatttttaagtaatcatctgcctctcctctagtacttgtgtaaaatgctgttgctctttgttttataatgatcgttttttagattagttgtgctgcttaattatcaatggttcagctttgtggtcttcatttttgtgtgtgtgttattctttataagaatggctaaaatctctttgtaggttcccgttaaactcatttcattctcctctggtaggaagtagtaggcttagtattgtttcagacaactttgctttcttatctgatgcttgatcaggcattgggaacttagaatgtactcatgtaggactgtgaaggtgtgatgagatcaggttgtaattaaagcatcaatgcattgccaagacaataaagccagatttcttcttagaactccagacaattagaattttctaagaatgattttaaaaataatatattagttgtggcaagatgagaaacaagctttctggtaattgttgttactcttaagcacaccttaattgtagaggggatatatcttacaacaaaattattttttaaaatactgaaattttaaacacttctaatgagtgagcacacgtaggatagtatatttcttattagtttcattcattcctaccacatttgatcatttgtcatgtgctaccctttttttcaagggaatagtttaaaaatcttaatatatacacagaattactaatatcctatattttttaaagcatatgtgtaatttcctagtgtttctgaatctagtattagaaattaagaaagaaagatgaaaaagatgggctggagaatggaaactagtaaaaataaaatttaattgtttttctttggaataactttatagacattatgagttgtgaaatcaccagcaaagagttgcgcttccctcctaattatagcttgtatgaaaacagtggaagtaaaatattttaatgataaaataatttcagtactggttaagcaatatatattagtcatcagattatggaattttgaaatattttaatcttattaacaagccataggatacttgaagatatcatatttgaacatattctagaactacatttctcttgggctttaattacagcatttagaaatgaaatctgggagactcttctgtgttgtagtagatgatttgtaaccctctttccataatatccaatttaatactaaaaaaacttctagtgtacaatgataatgtaatgaatatatcatacataaaacttgtattctctaggttgatgttatagcctaccttctctttcaccactgatgtatttgccatataaatcctcattacctcattttagtactcaaataattattattactctgtctccaccactggagtaagctctcttcaaggtctagggccttgtcctgtttatattttcaacacctaacatagtatagcctccttttttcttaacatatgaaagaaattgattgtcttcaaaagcagtttatattaggagctttgtactagtaaatagcccatagggatgaaagaatatgaaattaaagtcttttgcacttgtttaagctcaatttattttggttctgaagttgtgtactttttagactctagatctcgttagagcattacaagatctggaaaatgcagcctcaggtgatgcagcagttcatcagaggatagcttctttacctgttgaagtccaagaagtatctctattagataaaataacaggtaagaaaagaaaatgtgatccagaacttttttgggagttgggatgagagaacagcatatgtcattgtttttgttgtataatattttattatcccgtgcttttcttagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagtgcgtaacctttttcttctttagtgcttatttatttaattctctttttgttaggaattttaaaatattttaatctatgtgcacattttgcattttttaacatagacctttttaagcagtagcccaggtaagcttctccttgtattaatggtttttcttctacttgaaccaaattaatcttgcaagtaaacttagaaatttggaattagcaaaattgattgcatttaaaaattattcttgtgaaattccatgcaactataatttatcttaccagtttaaccctaatgtatcacagaaataataggaaaatagcaggtggcagtcacttgtagtaggatttatttagtttctgttttgagaagatgtagtcttttaggtataccattaagtctttaaattactcccttaattccacccgccaattctaatgcttacatgttccagccccactcccggctcacactcttaggcagaaattcattgctcctgtaaattaagtaataattaataccgctaatgagaaatctgggagtacaggaggtgattttaaaaaatgctcgtatttcctttgattagagtagcaattgttagggatacatgagccagatttggttttatgtaaaaaaaatctttcagttgatgagttcttgtttaaattgtattgctgtggcaatttcttattgtaataatatgtaggagaatttctaatttgaatccctttatttacagaaagctcactgtaaatttgtaggaatgtcatggtactaccccattaagttatttttattagtgtttagttattgattcagcagtctctaattgtgccaaaaatggtgcttagattagattgccattgctacccatgggagctgctacttaattattcccacctcaaattcccagctctcaagttagcactactcctttgcaatttactccttctctgctcgtataaataccctcagatgatgatagttggtggccactatacctttgaagaggttgcccacttctacatggaaaggaaaagatggtttttttttttaaaagatgaatttgataattaacttgccactatttcaccttgtgatgaaacctcaattttaaacatagtgttaattgttttattgtccacagaattaagggtaagtaatgtcatacaatttttgtctttagtcttttagtatggtttctttaacttctattgagcttctgttgcagatattggacatgggcgtatcttctaacgatgtcgtcaccattagtatattcttcctgctaaaaataaatatcaaaccctgaagcctgtattgtctcatgtttttgaaaattgaagagaagactgtaactttattctgctttatactttctcacttatgatgatggtcatttgtcactgtttacaaaaacagaatttatatttgaagtgtaactgtagaaaatagatcagatgccactccccacaacccccttttcccccagtgccttccagccacatttcatagttgacagtcatagattatgaggctgatgataataataatgttaacattcatgtgtcaggtactattctaggcacttcacataagcaactcatttaatcttacacagcaggatgtattatccacatttgatagatacagaactgaggcacaggaagattaagtaacttgcctaaggtcacaaagagctagtgagttgtttggaacgcagagaatctgcctccagagccagtgcacttcatcaaaaagacacattgcttcctgtttttacttaaatctaagattaaagcaaatgctaaagtcctattttttccaactttttctgctccctctcttctcagaggtaatcactgtcttgaaataaagccttctaggaactttttttgttgttcttctgcataactggattttatattataaagaagaaatcacctcaattatgttcagctgttttttaacaagtaaatactctttacaagtacagaaataaacttgaaagttattccacagaactctttgtaaattatcacttagaactatgttattcctttgtagaagatgtggaaatgatttgagatatttagacttttttgtaccaagtaggtggcatcactttgaagttgagactgagaggtgaagatttatgttttctgaatcagctgtgatactatcaagtaattttcatctattgtgtatctttgaacattaacagtggttgaccagatactgatgtgtcatttgttgctgcatttttgataatggaacataaatttaaagtatcagttcgggaattggccatttcatatttcttaaggaagccattattaaagcatgtgtaatgaatgaaaacatgaagtggtttaaaatttgtgttttaagacaatcattatttttgaaacttctgactatagttggttactaagcagaagcagataactgttgggccgggtgtggtggttcacgcctgtaatctcagcactttgggaagctgagctgggtgaatcacttgaggtcaggagttcaagaccagcctggctgacatggtgaaaccccatctctacttaaaaaaaaaaaaaaaaaaaaattaaccaggtgtggtggtgggtgcctgtagtcccagctacttgggaggctgaggcagcaggatcacttgaacctgggaggtggaggttgcagtgagctgagatcacaccactgccctccagactgggcgacagaccgagactccatcacgcgcgtgcgcgtgcacacacacacacgagataactgttaaaatagactattaataactttagtttacatttataatatttagggattgctataggaatcattttaccattatgaagttgaaagtattgcataaactgtttttcagttagcttattatcttggaaggcatacatgaataggagaattaaaatgacattttgactttgacattgtttcctagtacatacaaaagttatgtttacaactttactgttgtctaagtattacaattacactttactgttgtctaagcattaggattacatataaaattacatataaaaaatgtacgtatcttagttaaaaatgcttcattgctaaaaaagactaatcatctgagccttctgttagtcatagtctttgctggtggagggtcttgccttgatattgatggctgttgactgattagggtggtgattgctgaaggatgtggctatggcagtttattaacacagtgataaagtttgctgcatcagttgacttctttcttgaaagatttctctgtaggatgcagtacatttgatagcattttgcctacagcagaactgctttcaaaattagaagcaattttctcaagccctgctactgctttatcaagtaaatcctttgttgtcatttcatctccactgggagtagattccatctcaggaaaccactttatttgcccatccataagaagcaactcctcaccaacaagttttatgagattggagcagttcagtcacatcttcaggctccacttctgtgtctcgttctcttgctatttgcagcagatctacagttattttcaccactgaagtcttgaaccccacaaagtcagccatgagaattggagtaaacttcttccaaactcctgttaatgttgatattttatctcctcccatgaatcatgaatgtttttaatgccatctagaattgtgaatcattttctgaaagttttcagttactttgccgatattcatcacaggaatgactatggcagctatatagccttacgaaatgtatttcttaaatagtgagacttgaatgtcaaaattgctcttttatctataagtggcagaacacgtgttagcaggcatgaacactagtcacattgtacatcttcatcagagctcttgggtgaccaggtatgttgtcaatagtaattttttattattgttattttggagacagtctcttgttctgtcacccaggctggagtagtcatgcaatcacagctcactgtaacctcgaactcatgagtacaagttatcttcctgcttcagcttccaaagtagctaggactgcaggtgtgtgccaccatgcctggctaatttttaaatgttttgtaaagaagagttcttgctgtgttgcccaggctagtcttgaactcttgggtcaagcagtcctcccacctgggcctcccaaagtgctgtgactacaggtgggaatcactacatctggccaatagtaatattttgcaggtctcaacagttggcttaaaatactcagtaaactatgctgtaaatagatgtattgtcatctatacttgtttcttttatagagcacaggcagagtaaatttagcataattcttaaggactctagaattattcagaatggtaaatgaacattggcctctacttaaagtcgtcagctactttagctcctaatgagggccagcttgtttgttgaagctttgaaggcaggcatttatttctctctagctatgaaagtcccaggtggcatcttcttccagtaccaggctcttttttctacatggaaaatctgttgtttagtgtagccaccgtcatcaacgaccttagctagagcctctgggtaacttgctgcagttcttagttcagcccttgctgcttcactctgcacttcgaagttacggagacagcttctttccataaaccaacctctgctactttcaaactttgcttctgtagcttctttacctccctcaggcttcatagaattgaagagcgtttgggccttgctgtggattaattaggctttagtttaagggaatgtggctggtttgatcttctatccagactactgaaacttcctacatatcaccagtaaggctgtttagctttcttctttgtgtgtacactagagtagccccccacctttttttgagatattgtgtcactcttgtccaggcttgagtgcagtggcttgatcacggctcactgcaacttcaacctcctgggctctagcaatccttccacttcagcctcctgagtagctggaagtagaggcatgtgataccatgcctggctaattttaaaatttttttgtagagacagggtctcactatgttgcccaagctggtcttgaccttctggactcaaaacagtcctcctgcctcagcctcccaaagtgctaagattacaggcatgagccaccacaccaggcctggagtggcgattttagtttccttcgagaactttgcctttgcattcacagcttggctaattggtgcaagtggcctaacttttggcctgttttggcttttgacatgccttcctcactaaacttcatcacttctagcttttgatttaaagtgagagacctatgattctttctttcacttgaacatttagaggccatggtaggattcttaattggcccaattccaatgttgtgtctcagcaaatagggagggagagacagggacagccagtcagtggagcagtgagaacacaatgtgtgtggattaagtttgctgtcttaaatcactgatcacagattaccataatgcataagaatagtgaagtttgaaatagcacaagaaataccaaaatttgacagacacttaagtgagcacatgctgttgggaaaatggtacctctagacttgtttggtgccgggttgccacaaactcagcttataagaaaacacagtatcttgaaagtgtattaaaatgaagcatgataaaacgaggtatggctgtatttgatttaaatttagaatttggtaagatgcagctctgtggatgtttcaaagaagcatgtgactagtttcttaatttatatttttgaggtctaaatattgtcctaaaatattttatgtttaactgagttttttcaggaatcgtgtaatcttttagttgttgataatacaagtaattatttccatcaaagggaaaaagttacttaagcaaaagacttagccctgtttatgggctctgcattttctgtcctttctttttcatgtaatacattatatgcatcttacatgtcattgttttccttttaatatatggatgtatgataatttatttaactgctctgttctctgttacttttttttttttaaatagacaggatctcactttgtcatccacactggagtacagtggcaagatcatagctcactgtaacctcacacacctcctgcctcagcctcccaagtagctaggactacaagtgtacctcacaatgcctggccaattttttatttttttgcagagatgaggttttgctgtgttgctcagactatttatttttattgcttttctattcttaacagaatttcagagaacatctcttcagttaacttttcactcacatattgatccgttaataattctgataaatttctaaagatgaaattgctgattcatgttaaagacttgatcctgttaaccagtcttattgccttctttgatgatttctgaatattatctataagccttctgtccaaggccattcattttctccagaggaaaacacaccagatttgctggttagataacataggacatctgttttttgaacagtgcttttacctcttagcactgtgatttgggtccctagatgcgcacactcttttgctgagcttcttatcttccatcttttagttatatgggataagggttttaccagattcgtgtagagttttagttgatccttcttgtcaaccttaagacttatcattacatattaaggagactggtactgcaaagtccggaacatatccagaattcctcaggatgaattacattactttcggtcattatttcctgttgcagctgtcctcatcttccaacaggttcgtcctttccattcctttccttccccttccattctttcagatggagtctcactctctcacccaggctggactgcagtggcgtgatctcagctcgctgcaacctctgcctcctgggttcaagcagttctcctgcctcagcctcctgagtagctgggattacaggtgcgcgccatcacggctgtctaatttttgtgtttttagtagagacagggttttgccatgttggccaggcttgtctcaaactcctgacctcaggtgacccgctcacctcggtcccccagagtgctgagattacaggcgtgagccaccacacccggccgtccaacaggttcttgacattggtatgctgtggtccactttcctctgtgcttgtggatttctgcctgtgtaaattgctttattattttagtgacttattgggagggagcagataaacatgagtttgctctatcatataaatggaagactttttatgtcttaattaagtagaactgtaacatacatgtttcataactgctgccaaaccacccctgtctaagtggttgtcatgtactacctggcttataagatgatcttctgctccctctcatatctccctacatcattgcaaccatatggatcttttaagaaatcagatcccatcacactcctctttagaaactcatcaatgggccaggcgcggtggctcatgcctgtaatcccagcactttgggaggctgaggcgggtggatgacgaggtcaggagatcgagaccatcccagctaacacggtgaaaccccatctctactaaaaatataaaaaattagccaggcgtggtggtgggctcctgtagtcccggctgctcgggagactgaggcaggagaatggcgtgaacccgggaggtggagcttgcagtgagccaagatcacgccactgcactccagcctgggcgacagagcgagactctgtctccaaaaaaaaaaaaaaaaaaaaaatcaatggtccccattacacttttggatcttattttgaactcagacaccatttaacctcatcttgtatcatcttggcttgcattttgtttttcaggtatatcaagcatgttctaaaatcagagctttttgctttgctgattgttaacagagagggactggaatgctcttgcctcctgctctttccttagctggttccttttccactcaggtttatattcctatgtcaagtcttcagagagtcctacatccttttcttttggtcccatctactcattcctctggccccctcttcccaactgtattacattgtcattttggtttttgtttttcttccatattctttctattaatactttatatacttagttttcatgtgcacctgccactaggatgtgagtttcatgagatgaaccttgttttgtttttcatatttattaccatgccctcaatgcttagagtagtttctgtctcctggtaggcactcaggtgtttgtgttaagtaaatgaatgccattagaaatgtaacttggggctgggagcggtggctcacgcctgtaatcctagcactttgggaggccgaggcgggtggatcacgaggtcaggacatcgagaccatcctggctatcacggtgaaaccccgtctctactaaaaatagaaaaaattagttgggcgtggtggcgggcgcctgtagtcccagccactcgggagtgtgaggcaggagaatggcgtgaacccaggaggcagagcttgcagtgagccgagattgcgccactgcactccagcctgggcgacagagcgagactccttctttaaaaaaaaaaaaaaaaagtgtaacttggaagaggtatatatttaaaattggtaacttacttgtagctaaatcagaaaagaatgatactttaataaataaaaatgattgaaagacacttgaggattttgaataaaattatatccaacataattggttaaatcattttagcagagtccagtacttaaaaagtcttaagtgggctgtgtgttcaaggcatgcagtttgtagagctgcagttgagcattttgaacaaaggagtaaattatcgtcttgaaattgtaaaattattttaccagcttgcattttttccccttctgtaggagaataacactaacaatatgtgagaataacgtgaataagaaatgaacagtagtaatccttagcattgtataagtactgaatttgtaaagagtaatagtgccatctagtggaagagcgggagctacagatgaaaccagagtccttaagccagtgttcattcttttacgttaaagtatgtaacagagaggaatttacactctattgccctttgtgcctgttcactcattcatggaatggaaatgtaatatcaatactaatgctaattactgtcaagagaggcattcatagaactctgatggttaaaacaatgatgcatataggcagttacgctttcttgagacgaagtccttaataaactgctaacaaagattacattttgttgttactgtatcagttcttagaagtgagatgagattgaaaagtagtttggagccacattgtggagggcacttgaatgtcaggcccagtagaggttgataacaggccaaagggaagaaaggagtggtggtgttggcagtgtctgaaaatggttatagttgttgagtggattagattggagagagattagcagtagggagaccagatgcaacttaattagaaaaatgtgctcagcagtaaaagcctgaactacagtgggtggtagcagtgaagtgtgtgtgtgtgtgttttgagacaaggtctcactctgttacccaggttggagctcagtggcacaatcatgactgactgcaccctcgacctcccagggctcaggtgatcagcctcccgagtagctgggactacaggcgagtgccacgactcccgactaatttttgtgctttttgtagagacagtgtttcaccgtgttgcccaggctggtctcgaactgctgggctcaggtaggtgatccacctgccctcgcctcccagagtgttgggattacaggtgtgagccactgcacctggcagtttttttttttattgcaaaagtagtacatgcttatcatagttgaaaaaccattgataagcacatgcagataccatccaaaatttttatcacccattgaataccttttggcaagatttagaaggatagaatcagactgtacatgtcattttatatagtgtctttttgcacatttactataaaaattttcatgtgattataaatctcatttaatagctaaattacattgttctatggaagtagtatttgtttagccagctaactgtttagcgtttatatttcttccagttccttgctattgaagaacagtgctttaaatcaccttttggcatttatgttacttccagtttgatactgaaaacattgctctgaatcacccttcaactaagttttggcttatctgtgatagtcttctcataaattcctagaagtaaaataatttaaaaaaagcaaaaggagatatggttttcatgcttgagttagttacagttttaacaaaacaggccgggcgcggtggctcatgcctgtaatcccagcactatgggaagccgaggcgggcggatcatctgaggtcaggagttcaagaccagcctgaccaacatggagaaaccctgtttctactaaaaatacaaaaattagctgggtgtagtggcaggcaactgtaatcctagctgctcgggaggctaagacaggagaatcgcttgaacccagtaggtggaggttgcggtgagccaagattgtgccattgcactccagcctgggcaacgagagtgaaactctgcctcaaaaaaaagaaaaaagaaaagatattctttgtaatgacatggggttgtggaaatgggaactcttaacatattgttgatgtaaattcatttggtccactctgtggaggacagtttggtaataagtatcagaagcatttattttacatagtttttttctctttgccttttatcagattacttaaatgtatgtagtgattgaaagtaactagtagaccaaattctgggtgcacagggatggtatagttttattttactgttttaaaaaacttcaggtaaaatacacataaaatttgccatattaagcatttttaaatgtatataggtcactagtgttaactatattcacatgattttgcaccttatttctagaactcttcatattgcagaactgaaactctgtacctacccattcaacaatttctcatttccgccttcacccagccaccaatttttctttcagtctctgaatttggctattccggataccttatataagggaaagcatacagtattctctttttgtgactggcttatttctttagcataatgccctctaggttcatccaatttgtagtacatgtcagaatttccttcctttttaaggccgaatagtaatccattgaatgtatacactgcatgttttcatttgtccatggctgtatacttgggttgcttccacctcttggctattgtgaataatgctgctatggactgttggtgtacaaataatatctttgaggccgggcatggtggctcacgcctgtaatcccagtactttgtgggtggattattttatgtcgggagtttgagaccagcctggccaacatggtgaaaccctgcttctactaaaaatacaaaaattagccggacgtggtggctggcacctgtagtcccagctatttgagaggctgaggcaggagaatcacttgaacccgggaggctgaggttgcagtgagcggagatcacgccactgcactctagcctgggcgacagagtgggactctgtctcaaaaaaaaaaaaaaaaagtatgtgaatgtgtgtgtgtgtgtgtgtgtgtgtgtgtgtatatatgtgtatatatgtgtgtgtgtgtgtgtgtgtgtgtgtatgtgagaccctactttcaacttgttgggggcatttactgagaggttgaattgctagattatacattaattctattttcaaattttcttgagaactgacatactggtttccatagtgctacaacattttgcattcccaccaacagagcacgagggttccattttctccacatcctcaccaacatttggtgttttctgtctttgttgatagtagctatcctaatgtatattaggtagtatctcattgtggttttgatttgcgtttccctaataattaatgatattgaacacctttttcatatgcttatggccatttgtttagctttggagaaatgtctattcaagtcctttgcctattttatttttatttatttatttatttattttcttgagacggagtctcgctttgttgcccaggctggagtgccgtggcgcgatctcggctcactgcaagctctgcctcccaggttcacgccattctcctgcctcagcctcccgagtagctgggactataggcgcccgccaccacacccggctaattgttttttgtatttttagtagagacggggtttcaccgtgtgttagccaggatggtctcgatctcctgacctcgtgatccgcctgccttggccttccaaagtgctgggattacaggcgtgagccatggcgcccagccttgcctattttaaaatcaggttgttttctgttgtaagtgatggtgtcattttaggttgatgatatttgttatagtcgggaactagaaagaatttggagaccatctaactgactttttactggaaatgattctggaatatttcctgaaagatgagatagtttagccagcttccgcttggaagtttctggtgtaaagggaacatactgttttgagagtagtctgttctatcttctggacaattgctagaaatttatatgcttttttatttgtttatttttaatatttatgacacatgctggcagtaatagaaatttataagctttttaaagaaattagcaaaaaatatttgtccaaatacatatattcttttatatatgtatgtgtatgtaggtgtgtgtatatttatatactcacactgtggagaaaatgtggagtaccaaaaatcacaggaagataataaaaaccacaaatactgaaaatgcatgacttgaaacaatatcccattatctgagtttctctcagactccttccttatggttttttatggacctgttttgtttataggattctagatagatcattttgttggtgtttaagaaattttatttttgaaacgttttactgtttcattatcgttattcatgcattatttctcacataaaattttacttgattcatgtgtcagaaatgtaaaaaaacttttttttacttgtaaagatattccagaaaaaagaaaaattacattttaatattttaaaataaaggataaaaataaagatgtcatgaagagcaacaaaaatggcgcaggtctttgcatgtctgagagtggctctccttcctgttcacccgtggacaacagcttcactgaatatctttttgtcttttggcctagatattgtatttttttcctttatcctaaactgactagcacctatctcggatattggtctttcattaattttgcttgatatttgatgtgcccttatattgggaagacccaagttgtcttttatttttgcttctcagtttatagtttttttcttaaatcttattataggtatattgaatgttctgaatcttcacgctgctcatcttttgttttgcctcacttttctcattttccttcactatttcctatggttttgttgttgccattttttgttatactaattcttccttactgcatgagaactctgcttgtctaatgttgggaacttagatttttttgtcagatttttgtggtctctgttgaagaaagggatttatcattgtgtttgcttggctagttcacagattgtacaactcaggtcaagtcaagaaggaatcaggagttgtagatgttagtgccagaatttgctgagtcagcccagatctgactgggaccttgcctctatttttgccagcacaccaaccccgccatccaattattctggtattgtactccctgaatcctccctgtacctctggaaaccacagcagtcacagctgtccttgttaaaatgatttggagtgatgactaaaatattcacaccttcagagtttggcaaagtcttgtaggaatgttcggacctatataatgtaaatgcaaaatactgtttaattagcctactaataaacattaatgaatttttacatctttaattattcttttgaatagagactatttaaacaaacttcagtaaatgcagtagtcccctgcttatcctcagggcatgttttccaagacccatagtgaatgcctgaaacttctggtggtactgaaccttatacactgtatatattcatgtgtcacttaacgatgggatacattctgagaagtgcatagttaggcattttttcattgtgtgaacattgtagcatgcacttacacaaacctagatggtatacctactacccactgaggctttatggtatagcctattgcttctaggctacaaacctctatagcatgttactgttgtgaatactgtaggcagttgtaatacactggtaagtatttgtgtatctaataatgccttctggtatacctcttgaaggccctgaggccattttacagttaacttttttttatagagtatattctaacaataaaaagtgtagtaaatacataaaccggtaacgaagtcatttattttcattatcaaatattatatactgtacataattgtactgtacttttatacaactggtagcatggctgtcaccacaaacacatgagtaatgcattgtgctatgatgttaggatggctacactaggcaataggaatggtcactaggtgataggaatttttcagcttcattatagtcttacaggaccactgttgtatatgcagtccattgttggccaaaatgtaatgcagtgtatgactgtactcttgtttctatacagtcacattgtatgggggtggtaacatatacaacatgctggattaagggatgatttttgtcctgggtggaatggacaaaaagatgtaattatgtaagatgtaattacgctactcagaacaacatgcaatttaaaacttaggaactgtttatttctagaacttttcatgtaatagttttggaccaagattgatcttaggtaactgaaatcatggaaggtgaaattgtagacaagggtggactcttacaaaatctttactgtggcataaatagtttatgacatttatttttgctgcatataagctattattttacttataggccctgagcttttttgtttgtggaaggtgcacatttttggcattggcattttttgcttgtgttaattttgggactatctcaaacctctcttttttaacatctgccattgttaatgttggagatgttcatcaggttcttatataattagtttttaaaatatatgtatcttttttatcttgctgaatcaatgttttagcttgtcgagtttttaaaaaacttgacttttgtcatttcttattttggctctgttggctttgtttcttctgctgatttcttaagaatatattttaattatagaaaaaaataaaatatttttacatgttgaagatataaggccagaaaagaggacagtggttattaacttttcctggttgactttggtcttaaattagttaacatttggatgggcagattagctttgtagtgaagagtggggactctggagcagtattacctaagtttcagtcctgcttcaccacttactagctctgtgacattggacaacacatttggcctctgtttccttgtctgtaaaatagggataataattgtaccgactttatgtggttattatgggatttaagtgagttgggtgcttaaaactgccacacatacagtaaatacctcagaggttttagcccccaacaaaaaaaacttggagattttctagctagcatatctctagcgtttaaccagtgaaattatgtagttttatggggatattcttgagttttcagatgtctgtagtatttttatgtctatagcgcagtggtcctcccaaagaggaagtgtttgttttgctagttaaatcttagtatctcagtgattgcaactgggttcccaagttttaaacaatatgttgaatcagttttttgagattctggcttatctgagtcaagcctacttgtctgctgtttatgaaatctatctcctttcaactggaggtaataaagtatttgctgtttacccttttggcacttcttcatgatttcttggaagtagttgtttcagaaatcaagttggtgcgaagtgttttctcctccccatattcccccacctgccagtattctcaaatatgattgatgaagttaggacacttggatacaattaaagtggtgtttgtgccatttccttgcctgatttagattttcactctcttttgtagagaaaacaaaagacattgatgtcctacccttaacttctattttaaggtgttagactgagttgcagcttttgttttgttttgttttttttgagacagggtctcattctgtttgttgcccaggctggagtgcagtggcacgatcatagctcactgaaattttgagctcctgggctcaagcaatcctcccacctcagcttcccaagaagctagaactacaggcacacactaccacacctgactgatcttttttttatttttatttttattttttattttttttatagagacaaggtcttgctgtgttgcccaggcctgtcttgaattcctgggctcaagcgatccacctgccttggcctcacaaaggtgctggcattacaggtgtgtgccaccaggtctgaccatcttcagcttttcctagaatttatagaaaagagaatatatgttagaatataataaagaattacataaaacagtatattctgtccttatattaaataactaacatatcataccatattatatagtatacaaaattcatatattacaaagatgtatgtaaatatatcttacatactacattacatgtctgttgatggcaaagatagatataatgaagggagagaaatgaaatggagacgggaatgaaatgggggagagacagatgaaatgcaggggttgagagggtgcactgtggagttacagagctgcactgttcactaggcagccaccagccacatgtgctgtttaacttaatcaaaattaaataagaattaaaatccagtttctcagtagcagtaggcacatttgaagtgctcactagccacgtgtggctgttagctaccatgttgggtaatgcagataaagaacatttccattgtcacagtaagttctattcataatggttgataaagattgccaaaaagataagtattgatgaagtaaatagagacataggaaatgaagaaattgtatatgtaatatctctgccctaataagagaagaaatgctgtgggtgccccagaataggcagtattcacagaagatggaacagtgacaggattgagttaaagatttcacatcctagcatgtactgttgtaaaggtggaagcattcacacaaacgttccatgtcagaagtgagacacctagaagcaggaggttggaacaacacacagtgactccattgcagtggaatggcgggtaaacccctccatatcctcctttcttgggccaggtagcaatgtgaggagtctgcctgtgttggagcttggaacgggggaaaagggcagtatcttctccaggctgatgagggccaggagtgattgagataatcaatatggaaaaccagttgctgggataatccatgttgaatcttttccatcctactgacggcccaagtaggttattcatacagtctgtactttaagtaaaggtggttgaaccactaagcatttttggaaagacaatacataagaaagaaagctcaaagggaagaacttcccctaggaaatagttaatacaaaaaaaaaattatagtaatgtgaaataactgctgaaaatgcctgaatatctagagtttcctctccctactcccatacccagttagtgtccatcagaaaacagggtgtccttacagccgtgtgctgagagtatcttcacttcttatcagcaaagtaatgtttgggaattctaggcaggtaagcagggaaacaacataagtaacagagtcaaaaccataatggctgtgaaatgagaggagagtggaacaagtgagatattttgtgagattttggaaaactgaaattgtgctgatgtggtttaaacttgatgtagtaagtggtgctctaccattgcacataatgcattcctaaatatatatgaaaatgtcatacaaaatttcagcatcaaatgggtataaaaacatacagaatttcagtatatcaaaattgatataccatgaggggcagttatttttttcctagagagatttttaaagatatatatatatacacacacaaggtcttgctgtgtcgcccaggctagagtgcgatggtgcaatcatggctcactgcagccttgacatcctaagttcaagtgatcctcactactcagcctcctgaataactgggactacagatgcatgctaccatgcctggctaatttttgtgctttctgtagaggagatcttgttgtgttgcccaggctggtcttggactcctgggcacaagtgatcctctcaccttggcctcccaaagtgctagggttacaggtataagctactgcacacagtctaattacaatttttaaaattacagttattgatgctttttaagcacccaaggaatagtttaaaattagtaagatcttaggtaaattattaaaatacagacaatgccttttaaaaatgtagcctctcccagctaaataggaataagtaactttagtagttaagaggaactggtcatcaagttgggaagtttaggttattttttgttttgatttgtatttttctagagatagtctttctatatttcccaggctggtctcaaactctttggacataagcagttgtgtctcagcctcctggctgagactataagcatgagtcatggctcctggcaaatttagtttttattttttatttattttgagatggagtctcactctgtcgcccaggctgtagtgcagtggcgcgatctcggctcactgcaacctccacctcctgggttcaagcgattctcctgcctcagcctcccgagtagctgggactacaggtgcatgccaccacgcccggctaatttttgtatttttggtagagatggggtttcaccgtgttggccaggctggtcttgatctcttgacctcgtgatccgcccacctcagcctcccaaagtgctgggatttcaggcatgagccaccgtgcccggccagaatttagtttttagtagatcgatctggaaattatgatgttgattttggtggtgatctcatttttatcaacttcccttaaatctgtcaagcaaaaatgtgtaacagttatattcttttgcttttttgtgagatgtaaagaagcagtgtccttctctgaatccctgcattccgatcactggaatcttgatgctaaattccaattctgaatcagaaaattctcttcttttcctttagtattgaacataccgtgagccacctgaatatttgccacttagcatgtctgatatctatccttgtttcttgtcacaagtatcatccacattacagaccccgttgtacaaaactgaaattctgactgtaacgccatcatgggatagttctgacctgcttgctagttgatatgtgaaagcctgaattttgcttcaaaaaagccattcaggattaacagtgtattgtgtaataaagtggactttgtgtgaaagttggagatcccttgtagataattcagaactactggaagtttcacagtacacttgtaaatgatgaaagtgttaagagtttcctttgagagtaaaacacagggtggcaagggaacaaaatctgaaagtaaagaaaagaaaaaaaagacagaagaaaaactaggaagagtaaagaagacaggaacacataatacagctttattcatgcctgccagaatgttgtgtccccatccagaagcaggtgtcatataggccagatgactctttttcctcgactctctgtcttagaatgtatcatctgtgggaaggaggggagcatctagttgtctactgctagtgagctaggagttctaggattgtcaggttctaggattgttaggttgggcttagcctgctagattttattctgtctgtattccggcattgttacccctttctggctaatcatccagcaccatttccctccatttgaggatttatagtcataattgggctgggggatgggggactccctttttatcaggtgatgctgcccttgaagcctccaatagcttattagtttcaagattctcagaattcttaggcctctcaaattaaattttccagtactacataaaacatttctatacactgcgggggtgaaaaactaccactctctatacctaactgaaaccttgctatggccaagcacagtggctcatgcctgtaatgccaacactttggcattcagcctttgggaggctgaagtgggaggatagcttgagcccacgagtttgagaccagccctggcaacatagcgagaccctgtctctacataatattttttgaaaattagctaggcatggtggcacatgcctgtaatcccagctacttgggaggctgaggtgggaggactgcttgagcctgggaggttgggagtgcagtgagccatggtgacgccactgcactccagatgggctgacctgtctccaaaaaataaaaccctgccatggcacttaaactccattgtatgtgagatgatactctaaaatttaatcataacataatacttatttagcattagctctgtgccaagacactgttctaagtacttcttctattttcattaattctgtgattgtcataggtagatgctattcttacctattttataaatgagaacagtgaggcacagaagtgttaacatactgtctttaagggaaatttgaaaaaatacattaaaaccatttaaacagctcctcacattttgatgtatttcctttagtctttaaaaaaaatcatagattaaaaatgtcatcgtaaacatagttgtaaaaaaaagaaaaaaacacaggtgtagccatgctgtgtgtacaaagttaattcctgcttggatgtctatcttggttagtctccagtgagtgatatatggagtaaaatcatgaactggtaattgggagttacgggttctagaagttactctatgaacttgaataaattgtatactatcaaggccatttttcattttcatgctgtggatttcaaacttaatgatttataagacctagctctaaaattcagtgcctttaactttttccgtatttctgtctcatagttggatacttctgggtactttaattcagcttataaaagtgatatacagagtttaaaattttctttccttgcctctttttcctaagaattttcccatcataaaaccaatacataattattagagaaaatttggaaaatactgaaaaatagaaaaactgcccacaaatttacagcaatcagtgaaaaccattattaaaattttcatatattttgtttcattatgttttctttttttgttttaaatagttgcaaatatgcagtttttttttattttattttttttgagacagagtctcgctctgttgcccaggctggagtgcagtggcgcaatctcagctcactgcaagctccacctcccgggctcacgccattctcctgcctcaggctctggagtagctgggactacaggcgcccgccaccacgcccagagaattttttgtatttttagcggagacggggtttcaccgtgttagccacaatggtctcgatctcctgacctcgtgatccacccgcctcggcctcccaaaacgctgggattacaggcgtgagccactgcgcctggccatgcagttgtattttttaaaaagtctctgtgaaagtgagtttcttcaacttaacataggtagccagatttatattgtcttctattttttaaatttattttatttctttactttttttgagtcagagtctcaatctgttgcccaggctgaagtgcagtggcagggtcttggctcactgcaacctctgcctcccaggttcaagtgattctcctgcctcagcctcctgagtagctgggattacaagtgtgtgccaccgcgcccagctaatttctgtatttttagtagagacagggtttccccatattggccagactggtatctcttttctttcatttcaaataagagtggaactttttttttaaggtctgtttatctacatggggttaaataagttatacttgttggacctattgaaagaactaggcctacataacaaatggagcagtgggttaccgaaaagaatactgaggctgggcgccggctcatgcctgtaatcccagcactttgggaagccgaggtgggaggattgcttgagaccaggagttcaaaaccagcctgggcaacatagcaagaccttgtctctacaagaaatacaaaaattagttgggtgtggtggtgtgcgcctgtagtcctagctactcgggaggcagaggtgggaggatcatttgagcgcaggaggcagaggttgtagtaagctgatactgcaccactgcatttcagccagggtgacagagtgagaccccatcttggaaaaaagaaaataagattggaagtctgtcagtgtgccattgtaatttattggtggagtgctatcattggtaacaatatcatataaatgtatttaacccctcctagcttttgaagtaagattcatgttagagctagaatttgtctgggtgcagtggctcatgcctgtaatcccagcactttgggtggatcacttgagcccaggagttcaagaacagcctacgcaacatggcgaaacccagtctctacaaaaaaaaaaaaaaaaaaaaaaaagtctgtgtctgtctgtctgtctccctctccctctccaagtgtggtgtggtggtgcgcatctgtagtcacagctacttgagaggccaaggtgggaggatcactggagcccaggaggtcgagactacagtgggctgtgattatgctgctgcactccagcctgggcaacagagtgagactttttcttaaaaaaacaaacagaaacaaaacaaaacaaaaaaaactttagactttattgataattttgatatcattgcattgaagaagtttaactaaaatacgaacctcttaattatatcaaagagcagaatatggaagttttaaatttttttgagttgccaacagctttgaaaaatgcacatatgcacacgaatttacttagaacttctgcttctgaaactcacccatcagtagctaactcacttaaaccatggttaaggtgcattttctgtcgagtaatatacttgacaggtcagaccgttggtctgtaaccagtgcaaattgaatggagatcactgtgaaacactgcatttatttctttatacctttctttgcctaaacatttctagtataaattcccttattttgattttccaaagttaattgcatcagtattgtctggacctggcttggcattatttaatgggagaaagcactgaacaagtatagctattagcatggtgacacagctagtttagtgttaaactacactaataaaccaagtgatcagaatgtggaagataagttctgtttcatcagatgctggttaaaccacagcgggatttctgtcttcaactctggattccatattaccaaaatgaattaacttgccacagtgtatccagaggcagagacaagaacaaagggaaatggaactaacattccttggagaacagttgagggaactggggagatcagagctggggagggatataaattatgtgaatacctatcttcagaacctttgaaagctattagaaaagaggatttgggtttacttctgagagcagaactaggaccattggatgtgttacaggtgacaagaccactctgccatttaaaacttcctaatgtgtaagggctatttaataaagagtgagtcagtctctggcatctacctctatagcagatcttatacacagtctaacgcctaactagattaataacaccttaaactattgacttgtttacctcactattacctgatgtttgggtttcaataagaaattacaaggcctgctaaaagtcaagaaacagcctgaagagagaaagcaagtgtcagaaccagacttacatatggcacaaattttgaagtgatgagactaagaatttaaaataattgaaatgttaaggggtctaacagaaaaagtaggtacaatgcaagaacagatgggtaatataagtagagaggtggaaatgcccagaaaaaatccaaagcaaatgctaggggaaaaaaaattaccgacactgggaggcttaggtgggaggatcacttgagcccaagaggttaaggctgcaatgtgctgtgattgtgccactgcactccagcctgggtgacagagtgagactgtaaaaaaaataataagaatgtgtttgatgggcagttcagcagactgggcactgccaaggaaggaagtggtgaacttgaagactaggtctatagaaacttcccaaactgaaatgcaaagtgaaaacagaatggaaaagaagtccccacaaatagaacagccaagaattttggtaccatttggaaaggtataatgtacatgggcttggaatactggaaagcaagagaatgaagccaaataaatatttgaggtaaaaatagccaagaattttaaaaattagtgacagacacccaaccactgatccaggaaactcaagagaacaccaagcaggataccaaaatgcctacaatctctacttaggcatgccatattcaaagtacagaaaatcaaagtaaaaccttgaaagaagccagagggggaatcaccttaccttacctgtagcgtaacaaagataaattatggacttctcagcagaaccatgcaagcaagaagataagtgttgaaagaaaaaacccaccaacttagaattatatatccaatgaaattattcttcaaaagtgaaagacaaactagtgagtttgctagtgctggaggtggtcaaaaagaggtcgaataacaaggacgagaaatgttgggttcaatgtttgcctaactatattcggtacataagctgttagctctggaagatggtagtatgtgttcagcaaaaatgtatttcagtgattttgaggaatgtcgcaaaccagattgtacttttggaacttcactctgctcagatatggaggatctgagcaggcctgtagcaaagaaccctatttttgcttacaaacataagcccagaatctctgacttttggcctgcttgtgaaaaccttatggaatgatgtttcatggaacacccaatttgggaaacaccagattagatgacatttatgacaaatgagaaatgggattctttattaactggataatatatgtactaagtgagtgaggctaaaatgttagaagataaaggtaacagtattaacttcctcatttgaatttgagtacatgtggaaagactgattatggagggtcatttctttaaattccttctctctgcttgatttgaaatttcaaaaacagaaataaccaaagttaaatgctgcttatcagctcctggcttactctctctgctccatccttccaccctcaaggtcaaaacatcattattaggaggttcagctttcctggcattgggcaccttttctggttgaactagcctgtttctgccttttccctagtatgtttatgttgctgctattactcttgtttaagaaaatttatcacggggcctatatgctgttattcatgggaaaatgacaactctgcttcactagtaggaatgccagagatgttttaaggacagaagtagactacctgatacaagtcagtgtttccttattggattttgagttttaggaacataactagttgtcctgtcactgttctgaacccttagttgaactttcatttggataacatcttcagaatacccacccccaaaataattccaggatatgagagggaggttagcataatggtaaagcatgaggactctgaagacagattatcttaagttggagcccccttttgcccctgtctgttgactttgggtgaagtttcttaatggttaaatgtggtttagtttcatcatctataatacatggttagtaataatctctaccagtgaagattaaatggagcacttggaacaatgtttggcatatagtaagcagatgagaagtgtagtagctatttggttagggtcacagtgtggtataatgaaatcttggaatacataaagtttctttgtaacatctaccctaataatttaacattaccggtttttcaaaacctagttgacaggcattgggttccttgcagaaaacttgataaaatatctttttccacatgttgttaacaatctggaagattaatgaaactctgcaatagtggatttcttaagagaaggaactaaaggaagtgagacagttcgttagatgatacttacttacattaaagtaattcccaccaaaaggtaaaacttctgcagtcaagggggaaaaaatgacagctccatctgagatgtataggataacctgtgaaaagaaatgagaaaggattggctatattggagtttatatttttaaaattgtcaattccaggattagataccaagccaaatttgagcatttgtttcccagaaggtgagggcaaaccactgagatctttatttcctttgcagtctgtcccctggggatggtaacagacttgactaatctgcagtctcagaaacgccctgacatcatggaatgtcttggccttattaaaaaaagaaaatgggtgtgtgtgtgttatatcttgattaatacttcagttaattttttcctctaatctagaaaagggcccaattccaggacatgaaaaatgaagtaaaagtaaatggtgatggatcctaataatgagaactgaagcttcttaatagttctattgaaggcagtggcttaagaaatacttgtatgttaacttcttaaaagaggcaaaggacattatactacagataaatgaggtcaccagagaaaacaaactttgcaccttttttctctacaaattctgctgtttttatcaagaaatgggtaggaagccataggtctgcaatacagtaagtatgatgcttagaattgaccaaagcctttaattgaccactaaagatccccatatggatgtggttgaaattctctcttttttttttgtcacaattatgtaggaaagataaaatgaattattagcagcatctgcaagaaaaaggcagccatgtaaatattttaatttcagaaatattatgtatttaaagcaactagaattttagaacataacagggtcagccctaaaatgaacaagaattccaaatttcaggaaatttattctcttagatgttcttactgcaaggtgattctgatatcatctcagaatgataaccacaattatatagcacttcctaatttgaaaacttccacataatttggccacacagcactgtaaaatagtacccttattttatgaaggaggcatctgagacttaattagataaccttcaggagcccttgtccaggtttacataggaagtagattgaggaaacagtactccatccagatctgacttcatggagtgttgactggggcgtactgttaatactcagtcccctgctggacactgcaagtaatgtagatatatagaaagtgtgttttctaattatgggtatgaaattagaaaacaatccagtagtaattcagaaataacttgtatagtagtatatcataggaagttagcttgaggccagagtcagaaaagattctattgcagtgtttggtcttaatgtaggacttgaaaaatatataaaatttggatcctcaatatatacttagtattagctgtaaagaaatctgtaatggtggttcagatttcaagaagctgtagcccacttgcagtgcacacaaggcaagtcacacctcctagttcactagtgttgaagtattatagcagtgtaaagaaggcttctgcccttggaaagacaagacagacttaacatggattacaaccaaacagcgcagagatagtttcagctaggagcctagagtaaggatgctaagaacaggggaagagttttaggcaaagtgaaaatttgcctggattatgacagatgggcaaaattttggaagactggaggggcttggatatgatcagtggaattgagccttggtatgaagctggaactgcagaaactgacatgagggttgctcatgactgaggtgataacaagctttagggtggtagtggtgatacttgtggcaagtaaagggtaaattaaggacagaaaggtgggccttgttgaatgaggaaaacggaggagaagaagtaaagtggcttcggtcaacagagtaagaagaatgaggtaaagcattggttcccaaatgcacccatgccatggtgccacctgagaacatttattttaatagttacatttttttttttagtttttgagacagtttcattcttgttgcccatgcttgagtgcaacggtgcaatctcagctcactgtaacctctgtcccaggttcaagttgttctcctgcctcagcctcccaagtagctgggattacaggtgccgccaccacacccagctaatttttgtatttttagtagaaacagggtttcaccatgttggccaggctggtcttgaactcgtgacctcaggtgatccgcccgccttggcctcccgaagtgctgggattacaggcgtgagccactgcgcccagccctagttacgtttattttgatgtgtgaatcaaaacgaaaatgagcacaaccaacctgtgattgcatggatattatttcttagaatgaagatgttaaaaaatgagttgatttaaatattatgtaaataacagtgtaagggagtcatggtaaagaacgttatgaaggatggtagttaactaattgaagtttggaaaatagtgattaaaaattgggagaggtggtatgaggaaaatttctggggttctgaaaaagcctatatcttgatctaggtgttggttacacggatgggtacacatacatactaactgaagtatctacttaatagttatgagttttatgttgtgccccaatttaaaaactttaagtagcttttgactaaagatgggtaagatggaaagaagagcaaaatttgtagtagaggaaaaaggtgcaaagttggttttctttgctgatcttatttgtagtagaatagatactcagttacattcattttatttacattctctgctttccaaaaataatttttaaaagcgtgtagctaaatcaatataaagaaattgcttatgaatgttgggtgttgaatgttttgcttatgaatgttgcatttcttaagagatacatatgtatatacacatgtgtgaaaggtttaaccattcaaatgatagaatttttttccctcttttttgacatttcattcatcagtttttttaaaaagtgtattctatatatgtgatatgtgaatggtcaataggatgttaaagcaatacattgttacatggtccgaaaatagtagtgaaagttgagatatgagaaaagtcattggggaatgttcaatatagtttgggatttcagctggcacttggaagtatggaaagaaattggtatcctggacaggtaaaggaggaaaaacttgaacaaaatattctaaataggaatttgtactgtatttggctttaagggaattttgttcatattgggcttaatatcataaaaattctatatagtttaaaataacttcaatatatttgctgtagtggccatatattatttgtaatcttaaattacagatagttcttttttttttttttttttttttttttgagacagggtctcactctattgcctaggctggagtacagtggcacaatcatggcttattgcagcctcgacctcctgggcccaggtgactcccactttagtctcctgtgtagctgggactacaggtgcatgccacccatgtctggataagttttgtactttttgtagagacaaaaagtttcaccttattgcccaggctggtctcaaactcctgagctcaaagcattccacccacttcggcctcaaaatgctgggattataggtgtgatccactgtgcctggccagtatttttaaccaagttgcatcacagtgttgataatacaactgctattctggaaaacatctcaaaatgtttttggttgtatctttttgaatagcaaatgtcgtatcatttgaccagaaataactaagatctattaatttattcatcaattttgatgtatcaaaatcaattatgttacatggtgcctggtgttaatgaaccttgagcagtttatgttcactttttagtaaaagttgaaagatttatattacctgaagggaaaccagcgtgttatcttcagtttttaaagcctcagttttcttatctatggaacgggaataatgatgcctgtgttttagcatttttgtgaagattaagaattatgcaaaacagctttgataatctgggaaaatgtttagtttgtccatcagactttctttaaaaaaaaaaagttttaattttagaataattttaggtttaccaaaaaactatgaagagagtatagaaaattctcatacacttcacatccagtttcccctattgtaacatcttacattagtatgatacatttgtcataagtagtgaaccaatattgacacattgactaaaggccacactttattcagattttcttaatttttacctaatgtccttttttctgttccaggatcccatccagaatatcacattagatttggttgttctgcttctcttgggtgtgacagttcctctgactttccttgtctgatgaccttgatagttttcagcactactggtcacgtccctcatttgggattttctgatgtttttctcacagctaaagtggagtcatatgtttcagggaggaagaccatagagggagaatgccattttcatctcatgtcaaaggaaatactgtcaacctgagtgatagtgttgataggacctttatcacatggcttaggtattgtttgtcaggtttcttctctgtaaagttaatcttttttccctccttttcatactgtactctttggaagtcagtcatcacatacagcccacacttaagaagtgggaaacttttcagatatgaaatgctgtaggtgaacctttttcaaatatcaaattacaatgaatttgttattgcattcttttataagaacttggagacaaggccgggcacagtggctcatgcctgtaatcccagcactttgggaggccaaggcaggtggatctcctgaggtcgggaattcgagaccagcctgaccaatatggagaaaccccatctctactaaaaatacaaaaaaattagtggggtgtggtgacacatgcctgtaatcccagctaaactcaggaggccgaggcaggagaatcacttgaacccaggaggtgaaggttgtggtgagctgagatagcgccattgcactccagcctgggcaacaaaagcgaaactccgtctcaaaaaaaaaaaaaaaaaaacgaaaaaaagcaaaaaaattggagagcagatagtcttagttaaggataattactgagttattcagataatggatgtgagtggtattgttcagcaagccagtattttcataagaaaaaagtgggaaattttccaaatacatgctcacttctctatcctggtatctactattttactgctcttttcatgatccttttcaacattggtgacatttctgcattttgctattagctcacttctcttccttcctgtgtgtactgtgattcttaaccaggagagggacgagggtcatgccatcttttgggtggatacattagaatcatggggggtagtgtggtatgatggaaaagatagaaaatcagatagattcattatatgtatatttttactaaaaccacaaaaaataaagtttgatgaaatcttggctcatggtagatgtgcagaagagtagagaagggaggggcaaaatgattgagaaacgttgtagattatttatataaacctaagtggctcatactcttctcttggttttagctagaatttgtcagttataaagcctaaatctttatttgtagctcagaatactgtaatcacatttccaagtgcctactagaaatcccatggataactcacagttatcatgcttaaaaatgaactctgtatccttctccaaaggagtttgtgcccctctctgctatctcagataacagctccgatatccacctgcttatgaagcctgaaccctcattattcctcacagcagaaccacaaccaattcctgctgatttttctttctaaacatttagtctttgacattaaggtattatttacatataatgtagtttttaaaggacattgctctatccttactactgttggtttggttcggttcaggccctagtcctttctttcctggagagttgcagtaaactcctagctgggtttcttccttagatgtttcctcatctatgcactctctaggatggtcctctcaggacttacctgtgaccacatttggaaagagcgtgaatctccctgccttgtgccatgcactgtggtaatagtgaattgccatggacatatctattttactgcctgctacttccttagaccaaatctttgagtcaggaccctggaactgagatgggtatagtgggaagcttttctctgagtgataccctgttgtgggtgctgagcttttggagaaagggaggggtgcagcagcctgaggttgtcttggcttgcctcttctgctgtggagccaccttcctcatgagttgggggtgaggcttatcagggcccaagtattctcagtcctccacgcataagaaggaacttcttttccaggagtgggggctggacaggagggagtccccaggctcttccctgctctatctcaggacttagcttcagcaccaggtagttggggtaggatgagaggcgctctttctgggaataaaaccctcccactgggagttgcagggagagtgatcctgtattcttggctgcagcagtctggagtggaccctccttgcttagatgggagggcacaggaagggagcagtcctgcttcagacaccacagactctggccattcctactgagttttcatagatgttcttgccaaattttagttaaggtttatgaaaataaatatgtaatttttcttgcccaaactcaagaatacctgaacatcttatatgtcgaggttaagcacattaatgttagtcttctttctactggtgtgaagcaacagctaaagattgtggtttttcttaataataatagtttactagttatatatttccaaagctcatcttttgatgtgaaaactcacactggaataacctttttaaatatggcattaactgagtatatatagtacctgggtttatgtaggtcattattagctaggaagttttttcaatccctgaatgctaatgaaagtggtttgatgttacaggagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaatgtg

SEQ ID NO: 38318 - DNA, 66743 bp, Homo sapiens
agttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgagtgcactgagaagagggaacagcggggccagggtggcgcccaggactcggggcttaggctttggggggtgcgcggtgtcgcgtgcagacccactggtgtgaaaacgcccccagccgccagcctcccggcctcggtccaggctggtgaggacagcgcgttcccagccacccagccttagtcccccaggcttcacctggattctttgagcagactgctctgggtgcaggcacgggtgggagtgggatggcgggggatccccattttgggcaaaacggttggttttaatcagaagctccattgcctccattgcgagtctgccatgcagactgggccaaggctgctgatgccaagtaggctggccccaggggaaaggtttcctcccagcccaggagctggtcttggggtgaggaagaggccagatgatcttggcctgggaggaggcacctggcttcctctgggcgtctaaaagtctgttttattggaatcaccttttgtttgcagacagactccctgggcccaccagggaggtgtgggaagtagagatgtgggaagggtctgtgagctgtgagcacctgtgggcttcgtccctactagccccaagtccctacaggaacggaatctcacttgtaaatcccttccccgggcttagacaccgcgtcccactgacattaactggcactggaaactccacctcacttccacacggaacttgggacaggtccttttttagatggtgtgactggtatcttcttcacttatttctttctgagggagtgaaatgacagtcgggggagagcaaggctcccaataggtgcaaaggccagcattgctgggggctgtgaagtctcaggaaaaggcttctggacttgcagaccgcgttgctgagcagtgacattgacaccccgggttcagctgtcctgcatctgtcctaggaaacccatccctccagctggcctgcatctgtcctaggaaacccatccctccagctggcctgcatctgtcctaggaaacacatccctccacctgctcattggcgggattcagctgacctcagtaaggcctcagccttcctgggcccagccccctccctgcccaggaccgtgctccttagtatctaagtaccaggcatgggtcactgtgctcctggccctcactcaggctctaagaacagtagcaggtgcctcagaggattgactgaggacacatttagagaacatgggatggtgcccggcacacacatggggagtcagtgggtcttactgagtacgacatgagtgactcagaaaaaaattaaaacaaaccagctgaatgtgtgcccagtgaggggctggaggtggtggaagtgtcccagagccctgtgggctaatgggaaaagtgaaattggtgcctttcaaccacaatgcaataacggctcaaataagccccagtctcagtggttggggcagccttctagggccaactgtcttgttcttttcagaagcaacctctggaggaacagtctttgcccctactcctccccactacccccacaccatcactccccctcttaatttcaacatcctggcatcatccagggctggagagggccagagaggtcttggagctcagccattgtccatggtacagatggggaaactaagaccctgagaggaggggcatctttcccaggtggctgggctggctgtgcctgaactgggatgggaacccagctcccacctctcagcaccatcctcctacagcctcacctgggacccatccttgcggtagagactagcactgaggctttaggtgtaaatgcagaactcatgtccatttataaatgaggtttaccaccaactccccagagaactgggagagcagaggggatggcaagttggtgggcaggtggctgaggggcagaacaccctcccagtgctgttgctgctggggccattccagacccttgtggctacagcacagatgtgcctggttcacttgtagggaagggagtggcccttctaggtggaaatgtgctcatttagccactgatgagagctgggggtcagtgcctactgatgggccccacctatagaaataaccatacaggctgacctggacggcagcattcgggaaacagccacaaaggattaaggcagagggcactacagttgtcatctctgccacctcccctttatcagcaagaataacaccacacgacacaccttggctctgagtcagagagagcattcctgctgttgttagcttgccagtttgtttgcccaggcgagtaatcacccacaatcaccattgttccaaggctccccaagcagccagcccaagagctagttaagccaattcttcatccaggaggaacccccaccctgatttcccttcaatttggccaaaaaattaattcaactctttagcggataaagatgacacactactggaattcagcagtctgggcctgggatacccatcttataaaaccagctccactctctcctccctgcctattaatccctgtgtcccgtccctctgccccactatggctattcaactgctggggaaggctggctgtctccaatgtttaaaatatgatcgaatctgagcagtggaacaggcagtaagtggaagtgttttgttcaggaacctcgtgagcaggcgttatctaaacagaaatggaacaaggagcagatagagcagggtggcgtctgccctcccccagcacatactctgggagcccccaccccacccagctagggcaggcacagagcagccctgcactcctcatgggtctagcatattctctgccctcacctccctgagcccatggaggtcgaggcagcagtgagccatgattgcactatcgcactgcagcctgagcgacagaccaggacctcatctaaaaaaaaaaaagaaagaaaaccatttgaaaggggatagaatgggggagggacagatatccaagcagcctctaggacattggttgtgatgctctgtgatctttttatccattcacttcctggtcactgactgtgctctaagaatgtgaagcttgcaagacaagaaaagcaggtttttccttttgttttgcttttcttcctcacacatcatgatttaagtttctcaaactgaggcctggaattttggcttctatgttaggagaagagagggaatgataatgcctcagctgatggtcacactgtccatccattctgaaaatagaatgtcggtgaatgctcttcttatgatcccttttttttcagaactcatgaaaaataaaagtgaatgaactccagtcatgcatcaaataataactttttgttccaattctttagaaaccagaaagtgtgtgctctgtgagagcatcaaaaatgagttcggtagtaagtccatttcttgaccagaacctaaatctgactgtaaaggaacagagtttgaatgctcccagggcattggggcaatctcttcttgtattgcaaacactcaactttatgtttgagagtggaaatgttgacgaatgggtgcaaaaaaattcaacgaattatccttctccatttttatggcataagccagggactattttggctgacttccatgacagctctgtagacatttttattttaaatggtatctgcccagaaaatgtcccttttcatagttaacctcttgtgcaacaaaatcgaagtacgtctccagcacagggggagttttgttagtatttttatgataaacgcttccaaatggtcagcagcactgatgggagatgcttctcagaattcagaagcaaaattgtgtctttttggtggttttgagacttccccctgaaagcacacagattggaccccttctctaatgttcctgagaaaataggttcaagtcctcaaggaaaacttattgaaattacgaggtggtttttaaactttcagttactcacaacagaactcccagtcatccattccccaaagcgtcagtgcccagagcagagctggtctgtctgtagctgcagcatctgagggccgagggcttccctggcacagcctgctgcacaccagggagctgcaagcacagaaaagcacctgccatgtgctgggaacggacagaggtgctattcttgtggagcttaacaataactaatgagacatcaccaactgttaaggggtataaagaaacgttaaagggatggggacaggtgaaggagtaaaaaccacaggatgatcagggaagtcctctgtggggagcgtgcacagttttgcagtgtcccagtgtgcatgcattggtggtgaagttctccctggtacaattgttcctccaattttatacccagcagtaatgtccacatcaatataagctgtgaggcctgtgtgatattgccatatgaaaagccagcaagtggatctgtcattctctgctcagccaccaccactgcatcactcccctgcctcacacccatcaaccacctgacaggatgtacaggccaaggtcctctgtgactcgccgcccactacccaagtgaatgagtctcccctagagctttgctactcagaggggtctgaggacaacagcatgggccaacacgtgcactcgagctgcctggagatcttgttcaaaggcagattctgaatgagtaggtctgggttggagcctgagagtctgtacttctaacaagttcccaggggatgctgccagtccacgaaccacattttgagtagcaagcaagattctaaggttccacctatcttggcttttgacatttggattttccttcctctgtcctttggacattgattgggatcaggtctgatgaacttcaaaaaaaaagggcataagatcatctgaggtttgacttcttggtcatcaggttacctacaaacacagcatcacatagtgcattgggtggggccgctgctctgctgagcagctgagtcacaccagattctcagacaggcaccatggctctttgggaggccaaggcagaaggattacttgagcccaggagttcaagaccagcctgggctgcatagtgagaactcgtctctaaaaaaaaaaaaaaaaattaagtaaaattttaaaaaatttaattagatttgctgagggtgaggcctggccaccagtagtgttaggtgatcctaatacaccccaggcatgagaatccctgctgggcagccccacagctgacctctcgagtaaataaatctcagcacctactgctcatcctgcccagatgttttgttctcccaagttgcatcacttttgcctccccagggaaattatgtggatattcccagcacaagcacatcgccctcacaggcatcaggctcatatgacctccccctggaaccacccccaaacacacacatggcaaacctaaacagccccccacgcccagaggatggtgaaaccttccaagtgctgtggagtctcccaacttttccacctagtgggtcagtcatccaggcgtccctgcccacacagagcctgcagcatcgctctaggaggtctaggagatgcacaggagactctgagctgactatgaatttgctgtgaagtttcctcttttctgtgctgttccctctcccaagaaacttaaggcgagaagcctcaggaatggcgcatttctcccagggttttccattgcaaagcccaaccctaggtgagggagaggagccatgcccctggatggggagatcactgacgttcatcccacagtggaaagaaaatgagagacccgtggctgagtgtgtttgggagagtaggaagtagatcccttttaaaattcgaatgtgggaattttgcatagattcacttaaattcattaaactacacaagtttccagacaagcattagaaaaccatttaacccaagtacagacagatgtcctgagaagtcagcagcgttctgtgttgtctcttactctgtgacttgattggtattggtaggcttctgggactgatgacttgtgatcctgtgacattccaggtgtgaccccgacaagaagcagaaatggggaagaaactggatctttccaagctcactgatgaagaggcccagcatgtcttggaagttgttcaacgagattttgacctccgaaggaaagaagaggaacggctagagtgagtgtgccgtgctgagcccacggagcccggggtccctgatcttcccccagggccatcatatgggtgctgtctgggtgggtcaacagccacgtgcagggtgaagagtgatggacaggaagccaggtctgggacacagctcttctttctggccttggttttctcaatgagaggatctgacttgccaaactgacattcacttgttctctgaatagttttatttcaacttgacccagcttccagggtgatatatcctaagccaggtgatacttaggccacatctttgaagaatagagcaaaaggtgatacatggggaaagtctccatgccattctgaaacacctagatgttggaatcaagtctttaggacagaggctgcccttccacctctcttttcagcaatgccaggtagcatcccgtcctcaccatgggtgaccccagcacggttttgttccactctgcccagtgactgggctaaaacccacccatccttgttcactctatccactgcgcatcttcctcccccctctatcttctgggcccccttatcctttcttgatgtctttagtagattgggtcaccctatgggaaggaagcatatgagggaagtagttaagcaaaagctgagaggatgctcccggcgaaggggggggcagagagcagaggacagagggcagagggtggagggcagagggcagaaggcagaaggcagatggtggagggcagaggccagagagtggagggcagagggccccgctgaagatggcaggagggagcctggtgtgccccagggagagcacaggctggcgaggctggagtggagtaaatgagggggccaggaagagaggcagttggagatgtaacaggtggggggcatgggatctggtgccagtcacgggggtcctgtagagcttcacagggcctcacccttcccctgagtcaccacagaccttcgagcagagcaacagcaagtcctagtttctgtttcacagcggtgggctctgtgaagtggccagatgcactttgcaggcagagccagcaagcttgaccagagatcagatggggggtctccagggtgagagggatcaagggcaacttcaaggttgtggcctgagcaacttcaaggacagagttgaggtcagctctgctggggaggccacagatggagaggtttgggggaaatgtttcaggcatgttgaagtgacatcacgcaggtgtgttgagcgggtgttggatacatacactagtccggagctcagaggagatgcgttacgagagcttcgtaaaggtgaagcttcatatggtgaaacggatgaaaggtatttgtattcatttctgggactgctgcatatgtgacttgtacagtacagatttagtggtttaaaacacacagctgtcctgcagttctgcaggtcagaggtcctaaaatcaagttgtcctcagagctacattccagctggaggctggagggaggacccatctctcggccttttccaggttctagaggcttcctggattccctggctcctggcccctcctccacctccaaggccatcagcacaatgtctaacaatgtctctttctgccactgcctctctctcaccctccctccctcacctgtgcctccatgctcacatctctctctttgactttcctgccttcctctttcccctatgaggagaaatatggttacatttaggaactgcccgtatcatccaggaccctcttcccatctcaggatccttaatgtcattccatcggcaaagtcccttttgctatgtgaggtgacattttcacaggttcttgggactagaacatgaatgccttggggcagggggtggcagcattgttcagctgaccccagcatttaaagctgcagggccataggagaccgcactggaagggaatttggatggggaccagccccggggacgtgagctcaagcatgttgaggagacaaagcaccaagaaaggagagagaaggagcagtagaagagggactttgggttcccatgctgaacagggtccgcaacaaaccgttaggtgaagcaagagcagttcagccccacatggagcaggaggcgctcgtgttggtggggaggggccggcgtcagagcctccccaccgtgtgatcccccactctccctcggccctggaccaccagtcacccctggatttcattatagcccaggtttcaccaccggcctcgggggagggcccaacctgctggccctggtacagccagtaccagcctggtggccatggccggccacgaccaccttctcaaagcctgagcagaggctgcggaccagcatgcagctgaccgcagggctgacaccctgtcccctttactctggcaggaaaatgcggtctcacgggccccgtcctcacccctccactcttgagtctcagatcccccatttccacattctgaagtccctcaccctctctttcccattctctctacgtaaactcaaatgttctctcactgttttcaccagagcagcaatccctgcgtcagctttggcgttcaggctgtgccaagggcagaacatcgttctcattagtagaacccccttctgggtggatccttcccaggtgcatcctgccctgtctccaaggcagccctggctattgtcagcccttatttcaaatggcaacttgtaacttctcattgcctgagtataggcgaatgcagagaaatggaaaaggggggagaaccatgttttccaaggagcagagggagggagcaagtggggcctgggggtcccggacaggcactgtcttccaggggactgctgagtggtccgccctgctccagtccaggcttatctgaagcgggtttagcagaaacccccatgcgtttcctgtctgtggctcacccccttctgacacccgtctttccttatttcatgctcttttcatcatttcacattgcaaagaagggacacacccaggtcacctcccagaactcttaggaaaggacgcacccaggtcacctctcagtactcttaggaaaggacttttgtaagaatatgggttctgatgaccctgcctggtgggccgctgatggccagttggttacagccgaggtcacattgttcattctgtgcctgaggctgtttgctcagaatgagccagtggctggggcgttaattggcccagtctgctatgtgattaggggggggcttgttaagtccccagatgtcttccgatgggaaggggccgcatgagcgtagagtactgtgttgaaaatgtcagtgagcagagaggcagtgctatgaaaagcctgtgtcaaggtagtgttaggtcgagaatactgaatgcccaagtggcattgctatgatgggtcttactatgagagtacatgtcagcaggtgacacatttgggaggcaaagaatcatgtaaaccagtggtccccaacctttttggtaccagagaccggtttcatagaagacaatttttccacagatgtgaggggctgggggaggaggctgggggcagggttggagatggtttcaggatgaagctgttccacctcattctcgttctcataaggagcacacaggctagatccctcgcaagcacagttcacaacagacaactatgggagctctatgagtatctaacgctgccgctgacctggcaggaggcggagctcaggcgggaaatgctctcttacctgccaatcacctcctgccgtgcaattcggttcctcacaggccagggacacttactgggccacagctggggcttggggacccctgatgtaaacagtgtggtggcagaggtagttaagaggtttttgagtttcttattgtttcatttgtgcttgtcttttgttgactgccctattggttaaatatgtcactaaaaggagagctgcctctacctgtgagaagacttttcacaggtgcctcgtgagccccggggagtggcagggccccagcgtgtgggcacgcatcaggtgcaggtgacttgagcaccgcaaggtcaaaacacgcctcgcagtgtgctctgctcaaaccaggtggtgtggacgctgtgcaaggccacagaggaaacaagcatagaaaaaaggctctggttcttggcaccaaaattggttctgcagaggagctggcgaaaataccagaaatccatgatgaaacggaagataactcttacaataatgaacctccttccctgtctttcatcattgctaatctgtgcgtttaaccaatttcaacatgaacagtcatctgtgtgctgccgccacagaatcccgttctctgtagcgtctctctgggtgacatcctcggggtcctcatgtctgctcccggtcaccgagtcttaaatatctgaatcagcaagaggctggatgaagaaactggtgctcgagggaccactaagtaggtggcggtaacaaatgtagcaattcaggagccgcccagcagtttcccatgtgtctcacaaactctgagagggaagcccgtgggcgcgacccagcccgaggaaactcaaggccactgattggagagaggagagaacaggggtgggggaattgtgaaaccaagaaacacaccatcgtttcttggaaagagctttactacccagaatatgcatcaggggaacacagcatgcagactcaaggccagtgccccagaaacaagtttgccagggggttgatttgcttaagagcggattcacttaatgcaccaattatcaaaccaaagaaaatgcatttcttttaacagtcttaaaattagcagatgtgtgtcagatggattcctgctcagtatttctctccagatgtgagcatcaatcacgttgaaggacgctgggcagggtctggaggtgacgcctgcgccttttcccacagcgtcagaacaacacaactttgatttctcctctgtcaaagcagggacaaacaagctggtccagatccctgatatgctggaggaaggagggcatgtgaccctgagacccccatgagcagcatcctgtccccaagccacggaagctcctgctcccttggccaggcctgcccctccctccaagctgtgctgtggacattcggtgacgcacacgcctgacaaggctctccttgctggcccttaggagggatcggtgagaaggaaggggaagccagcacgtcttgatctagcccaggcaggcataatctctctctcaagtcatctgtgccactagggatttgggaatgggctgtttgctatatagagtgggagggctgttcctgcctcccacgaggacacagtgctgtgcaccatagaatcgaaaacttgaagatgtacaaaattaggatgttagcaccactggcatcagataggcattttaggatagatttgacttaacacccatgtcctatcccaggagctgcccgatcagcagccccttctcagcctttgtccctcctgaccctctgcttgtcctgggtgtaactttccccacactctcttgactttactctgtggttagtttgaagcctcctctttttcccgctggcccattattggaataaattgccaatgacagatcttcccggagggtttcgtccatatgctttcatggatggatcttttaaatggtcaaagaacagataaatcctgtgtgatttaaactgcttcacggcagagtgttcactagcctcgccctgacacctcatattgatgaagataaagaaaaatatatacatagccctgttaaatcatcatataaatagacctaaggctgcactgtccaggacagaagttactagccactagtggctattaaaattaattataattaaataaaataaaattataattaaataaaatttagctcttcagtcttattagtcacattgcaggtttttgatggccacatgtggttagtggccaccatatcagatctttgcagaggcccatttggactaaggtagcaaaagtcttaaaagtatgctcacctgttgagccagcaggtcctctgctggaagtcatcataaggagagaatcagacaagggttacaggagagaagaactagaaagaccctaatgtccaaatgttcaggctttggttaaataccaaatttaacaacggatttaacaataggttgctcagcacccaatgaaaataatgatagaaataaattgacattaatagttcacaagacattgtccagtagaaaaagcaagttgtgaaaatgtaattttatcccattttactttttttttgtttgttttgtgagacagggtcttgctctgttacccaggctggagtgcagtggcgtgatcatggctcactgcagcctcgacctcccaggctcaagtaaccctcccacctcagtctcctgagaagctgagactacaggcatgcatcaccacacctagctaattttttaaattttttgtagagatggggtctctctatgttgtccaggcttgtcttgaactcctgggctcaagtgatcttcccacttcaacctctcaaagtgctgggattacagatgtgagccactacacttagccagattttacttttttaaaaaaatacgtagaaaaatccaataatggtagcagaagctcagcactcattgagccctctctggatgtggctctacgtcgtgtgttggagtctagtcccttctctgtctcctttgctggaacttcttggactctttaaatattccctttcgcagggtcgagggccctggcctcaactctcttctctgctctgtgtcactcacttctccagtgaccttgtccagccccaaggttttaaatgagttctagaccagcactgcctgatggaactttctacagtgatggaaatgttcgtatctgcatgacccatgtggcagccactagccacccaaggctatggagcaccagaagtgtggctaatgcaactggggaaaaaaagttttaatcgtattcaattttaattaatttaaacgtaaatagctgcatgtgccctagcagctaggagctactacagcagctagacaacacatctaaacaatgagtcccaagtttacacccacatcagagacacatcctctgaactctgacttttgtaggcaaaggcttgcacgacactgcggccaaagtgttccactgacatctctgtcccagcatgtccaaaacagaagttgtgatttctcctccacctccaagcaccccatccccatcttggatgcaggctgttgccaaagttaagttcccaggactcatggctgtctctgctccttccctctcaccccacaccccacactcagccagtcccgtggctcaaccaatacagccactgctcaccgccctcaatgccagcctcaggtcacgccacactgtctttcttgtggacaccacaggaatccaccccacacacacacttactcttctctccctccaccctcaccgtcttgttgtccattctccccacatcccccagactcatgccttaaaaatgtggatcaggtcatcccccggctcataacccccacagagcttccatcacatttacgatgaaattcgccctcctcacccctgctcaccgtgggacctcactccctcctccatttcctccttagcgcttctccaatgcccagtgagtcatttccttgttagtgtcttatccctgccggcatctaagccccatgagggttctgctgctttggcgctgtgtcaccagcccccagcacagtactgaccatggaacgactccacagctctctgggctcacattggatgatgacctctttcagcttcatctctattgtctcctttaaccctcagacacccctgtgatgtggttacttttactggccccatgcacaagtgagaaactgagtctggggcgggttacccagctgtgatgaatatctggtaaatgtttacttttagcattcgcgggtctatctgcagtgagtgagagcttgctgtgtattggtgtattgtctcgtattattgttcctctcatctcctatttcccccataaatatatattacatctaaaataattcactctaggccaggtacagtggctcacacctgtaatcccagcactttgagaggccgaagagggtggatcacctgaggtcaagagttcgaggccagcctggctaacatagtgaaaccacgtctctactaaaaaaaaaaaaaaaaaaaaaaaaatacaaaaaaattagccaggcatggtggcaggtgcctgtaatcccagctactcaggaggctgaggcaagaaaattgcttgaacctgggaggcggaggttgcatgagctgagatcgcgccactgcactcctcaaaaaataataataataataaataaaataattagatctaattccttaaatatctaatgtgtgttaaaacttttccgctcatctccaaataatgtccagaccttacacttgcttgctgtatcttttaagtctctttgaatctgtaagatctcttttcagctctgtttttttaatttgaagcttatgtgtagaagaaagctagctgtttacttttgtggaatttttcacagtctggagttagctgaggatatcctcgtgatgtttgcaccaaagttccattgtccctgttttcctgtaatctggtggtgagttccatagaagtggtcctcagagtgctctcatcttgagtgttttagattcattcatatcacttgggtattaagaaggttttaagtacagaaaagattatcacatgttattattttttaatgttctacaaatacaaagtagggccaaagtaaaccttcttgaagggaacattggttaatagtcacagcttttaactccttctgtccccagaagagcccagaacttcttaggcacccatccctgtcctggacccaagggacctggggctgtgcacaaaaggagcaggcctcctcctgggcaccctggagcttgcattggtgctgatttgtgtcttgctttgtatcatgcttgtgtcaagttctcccagtaactgctttctgcatttgttagggtagcccctcagctgtggttatggtagaaattaatggatattctccaaacccaggaagaactaggagaccatgcatagccggacttgggtgactcatgccctgggggaaaggctgaagcccaaacggaacaccctgttttaaaggacacagcctacaaatcaaatattaggactgccaacctgccctggaaaggcaaataggtggtgacgtggatttgtgatctctgcaaacagaggaggttcagagagaatctgtgaagggtctcctagtatgagacacgggcaaaccgtggcttgctttaaaaaaaatttttttttgaccaggctcggtgactgatgcctgtaaccctagcactttgggaggccgaggcaggtggttcacctgaggtcaggagttcgagaccagcctggtcagcatggcgaaaccccatctctactaaaaatacaaaaattagccagccatgatggcaggcgcctgttgtctcagctactcaggaggctgaggcaggagaatcgcttgaacccggggggcaaaggttgcagtcagccaagatcacaccacttcagtccagcctgggcagcagagcgaaattccatctcaaaaataaatacataaataaataataaaaatccatttttttgatcataaggaatttgaaatcacccttagccggactagttggaatcacggacacaggcaactctagagatgaaaaaaataggggctaaaacagggactccgctgccaaggcagggcctggaggggaacattggtctgagatgttttaggagatactctgaggctccgtctctcagcgcctgccgttctcacatcaccactcacttcctcttcatcttttttatcgtcatcttggtcttcccctttagaggatctccaggaacttgagtgagtttccagctccctcgtggtaattcccgacacgcgttcccaggatgaggagcctgggtccccggtgctgctcctcagcaatgctgccgtctttccgtcctctgccagccgttagccctgacgtgaggtttactttggttgccacgctttcagtcatttggcccctggatcctgtgactcactggatcttttgtgctccagtccccaactcagggtcaccctcaggaatcatttctccattacctggggtctgtcctcaggctgttttctcaggcatggcatggagtgtggattttgtctttgaggatctgttccacttgcctgggagtacaatctgacctcacacgctttcccctacaggctgtggggatgcttaccggtggtaagcagaataatcccccccaaaaagatgtctacttcccaaccccaagaacctctgaattcgtgaggctatacagaaatgggattatgcattttaggctgcccacctgctggcctggacctgggagatgatcccgggttccctgggcgggcctaatatcatcacaggggccttagaagcagaagggatggctggttttgaagatggagaaaggggccaggagcccacatacctgaagccctcaagaagctaaactgccagagagcagattcccctctgggggctccaggaggtgccacaatcctgccgacaccttgatgttagctcaatgaatcctgagtcaaacttctgccctccagagctgtcaggtaatgcatttgcattgtttttgtattgtgtttattttattttattttgttttttgaggtggagttttgctcttactgcccaggctggagtgcagtggcgcaatctcagctcactgcaacctccacctcctgggtttaagcgattctcctgtctcagcctcccaagtagctgggattacaggtgcccaccaccacacggggctgattttttgtatttttagtagagatggggattcaccatgttggccaggctggtctcgaactcctgacctcaggtgatccacccaccttggcctcccaaagtgctgggattacaggtgtgagccaccgcaactgaccagcatttgcattgttttaagccatggagttggtggagctctgaaatggcagcagttggacgggagccactgccccacggccagccctcagccttgcagaagggccccctgcatgacctccactctgttggaggccgccggttctgtccaccatgctggtagggattttgcccgccctataacagagtggtcttgtcagtctgtgtaggcatctcctaccatccagcgacccctctaatctgaagactcagctctttctttgtttcttctctctggttaggagagttttcctgtgttgttagggtgacggctgcctcagtggcatggcaaaaactcatggtcgaaaacttcacccaaccaagccgtgcaaaggaaatacaggtcttttatttcccatctgctccccctcgtgagaccccaccccttgagcagcaagacagtgcaagcttcagggcttcagatctcccagactctgctcacttaccgggtctctgttcctggctcagcttctcttccagagctccccacaaccccacctctgctccccaacccatgcttttggccaggccagcagctgggccttgggagaaaggctcatgaccctcccggtggccaggttgatggggtctggactccacacactgtccccacctccttgctggtcctgatgcagagtggagggcaggtcagcttgcaggatggggaccgctggctggtatgtgaagggtactggccgggcactgagatacggatggcacccaccactgagaccctgatcccagccacatacccacgtgctgtggcctcttccaccaaccccaagcctctgccagtcccctggctgctcctcatcgcatgcagtcctgctggagcatggtttaaggatcacagggatgtggattccccaccaccccagcacccaacgcaagtggaggcccacaggacccctcatgcaggctcttcccccgcctgtgtgctggaccttggggatggccacagtgggagcttccccctgctgtgccttcaggggtggccaccagccccgccatcctgggctctccccagtattcctgcatgttgccaccacacccctgtctagatttcaccccaagaggggcagagcagggcacaggtctgaccccttcaccctgcgtggctcaccaatcctgtccagaccccatcataggagcggcctttccttcctgttcccgtcctagaagcgttttccttccctggtatacgccctttcttcagaggctgccgggcctcccttgaggacaggagtgcccccttggctctgttctgccccaccagtcacagctctggcatgcgtgtcccagggccctctggaggtgggactgcagaggacagtaatgtgggtcccctgccccaaggacaaggacagcacttcccttccacccccatgcatccccgtctccagggctctgtctcccctgggagctcactttctcggcctttgccatcatctccccactgtctcccatcgcttagtcccttttctccacattctgggagggagagcaaacttgacttcgaaatcagcagttctcaaacctttgggcctcaggaccccttcacatttcctaaattactgagaaccccaaagagttttattcatatgggtcatatctattaatatttaccacatcagaaattaaaactgggagttaaaaatatttatttattcactcatttaaaaataacagtaaaccccctacatgttaatataaatacagtttttataaaaaatgagattttcccaaaatcagagtgtgagtaaggtgagtggtgttgttctgcttttgcaaatctctttaatgtctgtgtagcaggacaagccacagacaagaactcctcagacaccgaattgtagaaggaaagggctttattcagctgggagcatcggcagactcacgtctccaaaaaccaagttcctcgagtgagcaattcctgtcccttttaagggcttacaactctaagggggttcatgtgagagggtcatgatcgattgagcaagcagggggtacgtgactgggggctacatgcacctgcaccagtaattagaatggaacagaacaggacagggattttcacaatgcttttccgtgcaatgtctgtaatctatagataacataactgattaggtcaggggtcgatctttaactaccaggcccagggtgtggcgctgggctgtctgcctgtggatttcatttctgccttttagtttttacttcttttttctttggaggcagaaattgggcataagacaatatgaggggtggtctcctcccttatctggaacaatagaagatgggtgaattctccacttgcttctgcattcagtgggtcgtaacatgttttctaggctgtagtatttgaagaaaatctaggctcatacagatacataattgaaaaaaggagtacttgaatagcctttgtagacaataattaacatcatgtgttgttacaacatgaaaacccggcagttggagttggtagtttttttcctttttcttttttttttctttttttttttttttttttttgagacaaagtctctctctgccacccttggatggagtgcagtagcgtaatctcggcttactgcaacctccacctcctaggttcaagcgattcccctgcctcagcctcctaagtagctgtgactacaggtgcgtgccaccatgtctggctaatttttgcatttttagtagagacagggtttcaccacattggccgagctagtctcaaactcctgacctcaagtgatctgcctgcctcagcctcccaaagtgctggaattacaggcatgagccactgcgcccggccagttggtagtttcttaaaggttagttgtgatgtggaatctgaaaccatgttaatgaacttttccttttctgtttgttcaaatccattggtctctcttgcacttgaagtggattttctacccctgtgtgatttttgtaacaccatgcattaatcatttggaagacaccggctcactgagtgatgcagacttctcaaatgttgacacatttcatatgcacaccaaaagagaaccacttctgttactctcaccagcgatctcatcaaaagtctcccggtgttggaaaccctcatcaaaagtctcccagtgttgcaaactgtcaagctcacagcaggcgatatatgttttccagaattctactttgtgcttgaaagcttccgttttattactggcaataaatactgtcacttcttttccttgaagtgagagtcgcactttgttcatttttgagaaaatatctgccaagtacccaagtcgaaacagttcatctctctgttgttctctcaagtgaaaatgctatttcataagaaaagtttctagctcaggtggcgatcggaacaattgcccaatccttttaatagaaatatctgtcaccttcaacacgtggcacaagagcttcctgtcctcctccaagctcatcaggcagaatcctcaaaagacatggactgggggccacggttcaaaaagactcataacttttagggtttcatcaaggtgattctttaatgaaactgttttttcttctcatttctttttcttttttttgagacagaatctcactctgtcacccacgctggagtgcagtgacacaatctcggctcactgcaacctctgcttccctggttcaagcgactctcctgcctcagcctcctgagtagcagggattacaggtgtccaccactgtgcctggctaatttttgtatttttagtagagacggggtttcaccatgttggccaggctggtcttgaactccttacctcaggtgatccaccttcctcagcctcccaaagtgatgggattacaggtgtgagccactgcacccagctcatttctttttcaatgaaggatctaatgactgtcagagcagttgggcccactgccctgactcgtgctaaagcctcagcagtttatccaccattgtttttacaccttcagtgcaggcatcaaagagcaaagaaaaggcaaatgatgtctcagcattattacaaaaatagctttggccttgtgactcacccccctaaaggatcttaggaacctccagaagagaggtccctggaccacactttgaagaccactcttcgaaatcattggatctaatattccacggtagaaattgtgcccatttccccctccattgtgagctgtgatttctcgccatctctgtcttaaccagttcttctccacctccaccagcatagccggtggtgctcccatctcagcctggtttcctcctgtgtctcctctgtccctctcattgagactgcacgtacttgcttatgccccattcagcacaccaagctgacttgtttcgagtctgtttctgatggtaagtcacattcaggagggtcttttattcctgaagctaactttaaattggagccacgtgccgggctcttgcctgttgaggagtgacttctggtcaacccaattagcagagtgcatggagtgctctggccccattcactcctcaggatcggaagctccgggtcttgttgatacgtcctggagtggctggcagatgtcatttggtctccccaaatggagtcttctctgccctcccttcctggtctctggctatgaagaagggaagttatgttttaaagaatctaaagcacagtacagttctcctttcccctaatttcagcctctgaaatatatcagcctccagctgctgccccaggacacttctgggctcttatttaagaggactcctccagcctggaatgcagggcagtacacatgtccttgtctttcttcctgctgtgctggccctcagggtaccgttctgcctggatacagaagaagaggttctccctgggacagaggctaacaagccctgtccagcgaaggggtggcctccaggttttctggttggtgcagagctggcaagggtggaaatggagggagtgaggcccttcccatctggctccagggacttgtgctcctctgtttgggacaaagactttaccttgtcaatgcagctttatctaaactgtagtctgtggatggcggtatccccctagattcctacaactgcttgaccctttttctcttggtttttgaagctatgacaagagcctgatttcgtgtccatctcagtgaacatttttgtaaatagtggagagaggaaaatcgtgaagttcagccaattgcacttgaaaccggaggtggcctccccctgcctggtgggactcctccactctcttcacctttgctgcactctgggtgtccgcctccaaatcagtgtgcttcagagttctcagaagacaatggcacctagtgtccttcttgtttttgtcactaagaatggattaattttatctcatctgaaactgaaaatattacgtttggcagacattctctgaaatctagaacaaaagaaatgtgttcattatcatctaaggatacactttccaatcagttcaacttggcaggttcaccaggaagctgtgttatttaaactcggatggtctaggagaactgtagacttccgggtgctagatgattcctgctctggaaactcaccgagccatttcagctgcgctctagaggagcaaacctggggcgttagctcaactcttgcccccctgctgaaggagaccaaaacaatgcttgatcaggaaacaccatctggctttgcccccaggattctgtgactgccctggggagggcgcagtgacctgccaaccaaaattggtacaattgtaaacagccacagaaatgcttaaatgcaatatcatttctatgaaattaacgtgtttccattccattccagccaccaaaattgcccgtttgagctcagccctcaaaacaaagatgcctgtgtggctttgcccaacgttgggtcactgttttctgcataggagacagttactgtgtgtgtgtatgtgtctgtgtctgtgtgtgtgtgtatgtacgtgtacacacttaaagcctgttgcaaaaacaagatgcccaatatatttcttgtttctgatattttcccaagggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccaggtgagcccaggccttgaggtaaaatgaccttgatagtttctggatctggcgtgtcccttccatggggctagctgaagaagggtggacgcacacatgcacacactcgtgtgtgtgtgtgtgtgtgtgtgtgagatttatgcaggcctgtgtacagcactcaggcagtgccatgagcctgtgcttgtccctgcagagtcgtgaagatcggctcactggagtggtactatgagcatgtgaaagcccgcttcaagaggttcggaagtgccaaggtcatccggtccctccacgggcggctgcagggtggaggtaaggagtggagagtaagaacggctttttgttcccaggcattttaggaatattaaagcaggttcctttggagtgtgcatgtgtgtgtgtacgtgtgtgtgtgcatgtgtgtgtgcacatgtgtgtgcatgcacatgcctctctgtgaattcctgcttctggctgctttttttttttttttttaatttttgtagagacaggcatctcaccatgtttcccagactggcctcgaactcctgggctcaagcaatccacccacctcagcctcccgaagtgctggggttataagtgtgagccactgtgccctgtgaaattggctcctttttatgtgaggtgcaaacctctgcatcccactggcctggtctgagcacctcagaagtcctgggtgctgctgaagttgccaatatttgaaattatattgttttcaaatcttcaaagtaagttgagaactcaaagccaagtttctgaaacccagctgctgattgaatcaccagggtgcttgttaatactacatgttttccaagcccttcttccctgggacatctggtttggggcctaggctctctcttttcaacaaacatttcacatgaatctggtgattatcaagatttagagaaatctgttgtaattcagttgttttcatcttttgaatccaagtatttatttcatgatgaatttgaaatccaggcagtaggcttaaactaaacaatgtgttcgcctgtaagatcccccataaggcatttggaagagatcttttcagggagagggtgggaggatgccggggggtcttttgcatttgagtttgaagggagctaacccatcagtgtttttgagaaagctcaccttgtccctgttacctggagtccaaggcttctgccactaagcccggccaagcattcgggtgggacagccgccaccaagccaggtgtctggggtctcagtgtcctggatgactccatctgcaagaccaaggcgagtttctccagggccacgaggcagcgcctggctccggcagctgggcacgtccagggcagaggctgtgcttctggattggggcgtcctcaccatgccccagcccaggcgtctcccccaggccttccttctggagagacaccttattcgtgcctgtctcttaaagcctcaagtttgattgaagaagcagaagttggcatagacacctttgagcattcaagctctcgccgggcctgctgcaggcatttcaaggcatcttagcccatcgtttaatttaggacagaggccacggagaggcaccgctggagcagtacaccgcacaccacagggtggctgcactttttgggtggtggggtggggatgggggcaggtatgatcaatcatccaaaccagggcatttttaagagtaaaaggaggctctactgataacatgctgcaacaacagatgtgactaggaacggccggtgacatggggagggcctatcaccctattcttgggggctgcttcttcacagtgatcatgaagcctagcagcaaatcccacctccccacacgcacacggccagcctggagcccacagaagggtcctcctgcagccagtggagcttggtccagcctccagtccacccctaacaggcttaaggatagaaacgacacataacaccgggaaaagccatgctgtcaagcatctcagaatctcaaccccagaggcagtctttagggactggggtgggctcaggaagctgtattatttcaaaggacgcagtgtttccacagctcagcccagagctgctggagttcacacggcccaccagaacctgctgacttcaaaatcatcaccaccaaggggccaggaggtggcgctgtggggcaacagaaaacagaaaacagctgctccttgaacttggattcccagcagctcccccaagcgcccacaggggctgcattcctccctgctggacacctgtaactacaacattaaaacagggcgcaagcaaggaacacaaacactgggaaagctgtgcctttaaaaaaaaaaaaaaaaaggagggtaaaaaagcttaaggttaatgttttgaaacctgacccagccagggcctaatgcagaccttgtccagctagtaagtgggcctctgggggtcttcattgagtgaaccttcagagtgctggtgtttcaccaaggccttccatagaggacgcggcaggctctgcaggaagcagcttcgatggccgatggccaagaaaggaagggaaaacccctggactggtcgctgggcacccagtccccctacccccgtgccttcccttccagtgcctttccctctttccctcggtggtagctttgcctgacagtgcagacctcgcctgacgtcaacactaggttctttatgctcatgtggttttatttttgttttctcctatcaagagtggtcagaaaatctctgttccatgtcaggaacaaggaaaatcttttggaatttttttggtttttttcttttttttagcatgacttgatcagataggtaggataatgttgcccccttggcccaagtgcagagtgacaaaagggaccaacactaaaaggatccctgagatcctgggatacttcctcttcatgttcattgtgggggccggggacatcaccctgacaggtgggtccccaggccccagaaagctcatttccgcatccctgggtgcagggggagttcacggggtctctgcctgttggtttgggatgcgtctcctcaaggcactcactgtccagagagaacaaaaataaaaccaggtctgctctctggctctgtcatctgggcacgttcggagccaaaagccttgaccttctgaaagttcactgaaaaatcatctcgtaaaaggcagattcattggacaaaagatttagaaatgtgtttaccgtgtatacatgggagccttcagaatacagacccacagatgcagggaaattgtccatttttatgcttaggttcaagaaagggtggactgcgtgtggaaagaagattatataacaaggccggacctgctgctaataggctgagtggggaacctagcaaggtctgtctgcctggattcttcttggcctttcctcctccgagaatggggcgggatgctctctggagtgagggtcttatgacctaaagtcaaacaaggaaggtcagataatttctttttttatttttaatgtttttttttagagatgggttctcactatgttgcccaggctggttttgaactcctgggctcaagcagtcctcccacttgggcctctcaaagtgctgggattacaagcataaaccgtgcatgcccagccagataatttctttatggctagtttttacacagaaaagtagagggaaagagtgatatttgtatgttttatggctggctttgggagaaagggatactggtttctatgtcctgccttggggaagagggattctagtttctgtggctggccttggggaagaatgggcctgagagacaagagggcaggagaaggtcagagagaaactttgcttctgaggctgctgctgaggccctcatttggggcattgttttctgagccccagcagcattgccagccaggcaggcatccgctgagtgtgtaaaaatagacctgtcagagctcagacacgggcacctgcaggcccctttaaaacccttgacagcttttatctttaagagaaagatttaagtaaaaaatgtaccatgctgcctcccccatctttccttccactggggaaactgaggccctctgagcccaggcaggcagccggtccccttgactcaccccagcatcttcccagacattcctaaacaggcagcaaagcagtgaatggcagtggcagcttcaggcaggacaggcagtaacagcgtgtgcttgtcacctgatctcagctgtttgttataaagtccgtcgttcagatttccagttttgccaactggttgactatttctatctctgtattataaatggaaaactgtacaatgagacttaattttccaacccatgtaaaagatcactgctggctcaggacagagcctgagaacccagagcttcccaaggcccagtcgatggtagaattgtaagctggtgtggacatcacggaggagggtgtacggcactcgggggcggatgaaaggaggtgcacagtgaggtctccatctcgcaggaggctttggaagatgcgtcggtgattgattgagtacatccgccgaatgctcgccaggtgccgggtcctgggctgtcctgagggtagtgctgtggaagagccaggccctgctgtccccacttggggacagtcagcacagccagtccagtgaatagggacacttgtgcctctgggagtgaaaaccacaagggaggagtttcctgcagaggggccccaggcccgagagatgaggataggatccccacggggatcacaggtgggccagtcagggaaatgtctaaaacagaaaccacgcggtcgtttcacataaggaactggttgaaatgctgttaactgagaatgggaaaaggagatactgaggtatcagaggtcataactgcaggagtgcctgcatcccccacaactaccaggggtgcaagcaaagggcagaggctgggattaatagaaacaggcagctccaaggaggccacccaggggtgggacccagccctccaaggcaggggtgctgcccactggtgcccatgtctcaggggccgtgatgaagctggaccagctgtcagggtcaagggcttggtgctggaagccacaggaaggggaacattccttctccttccttttcccactctcactcactgcgagccgagccctcacagaggagcaggcaaggcagaggtgtggtgtgcagggccagctcccacatcacagagcagagagtgaaggtggctctgaggccaccctgggccctgcacccgcagtcctgcttccctttgcagttgacaatgcacactccaatgcaccaatgcctgcttgttcacacctgtgacccgtgaggcacagagagcaaggggcaggtcccagggcaagggtgtccaggggcagcaaggcctggctgggcccagaggatctgacctccacagtgccagctgtgccctcagcccctggagtagaaaggtggatggtccacggggcctgctggctctaaaccctggggtccctttcctaaatcacttgccacagccacagcaccggccaagccaaggtcagtaggagaaaggagggagagacggtggggctgtgctagggaggccaggcccaggaggtcagtgtgaggaaggagccctggggggcagagaaaggagagggggcatgagggctgggcctcacctcccttcctgtagtgatgaggtcaggcctgctgaccagcaaatgctatgagcctgcaggtgaaaccatgtgtttgggagaacatgacttagctctaggcctcattcacactccacagctccagggtcttcctactgcccaataagcacaatcctgcagacatggtcagacctgttggtaacattgattggtaacattggcaactgattggtaatgttgatgcagattaccggtttttatactgtaattcagaccagctctaagtgatgtttggataggtatacgaaaggccagcagagagccttcgctggatgtttctcagtgagtagatggattgtgggagagggagagatgaatggatggatggatggatggatggatggatggatggatggatggatggtaggatggatggatggatggatggatgataggatggatggatgggtggatggatggtaggatggatggtaggatggatggatggtaggatggatggatggatggatggatggataggtggataggtggatagataggtggatggatgggcagctaaggtggtaggtgagtggatggatggatggatggatggatggatggatggatggatggataggtaagtggatgggtggatggatggataggtaagtggatgggtggatagatggataggtgtttgagtggatggataaatagatgtctgagtggatgaatgcattggtgggtggatgggtaggcagctgggtagatgtatgaaggagtgagggatgagtggtgggtggatggatagacgaatggatggataggtaggcggaggggtggatgggtaggtgaatgagtggatagatgggtggatgcatggatgcatggatggatggatgaacggatggatggatggatggataagtaggtggatgggcggatagataggtaggtggataggtggatggatgggcagataaggtggtaggtgggtcaatggatggatgggtgggtgagtggataggtggatggatggatgcatggatggatggatggatagatagataagtggatgggtggatagatggatagatgtctgagtggatggataaatagatgtctgagtggatgaatgcattggtgagtggatgggcagctgggtggatgggtagatggatgaagtcgggagggatgagtggtgggtggatggatagatgaatggatggataggcaggtggaggggtggatgggtaggtgaatgagtgggtagatgggtggatggatggatggatggatggatggatggataagtaagtgggtggatggatggatggatggatggatggatggatggataagtaaatggatgggtgcattggtgggtggatgagtgggcagctggatggatgggtagatgaatgaaggagagaggcatgggtggtaggtggatggatggatgaataaatggataggtaggtggatgggcagatgggtaggcggataagtaggtagatgggtaggtggatgagtaggtagatggatagatgggccactgattgattgagtggatggatggataaatcgattgatgggtgggtgcatggatgaaggagggaggggtggatgggtgggtgagtggatgagccactgattgattgggtagatggatgtatagatggattgatgatgagtgggtggatgaaggagggatggagggatggatggatggatgggtgggtaggtgaatacatggatggatgagccactgattgagtgggtggatgggtggatgaatagatgggtggaggatagataggtgggtgtatgggtgggtggatggattgatgcatggatggatgggctgcccattgagtaggtggatgagtggataaatgggtgggtgggtaggtgaatagatgaatagattgataaatagggggatgggtggattggtagatgggtagatggagggatacattgctgtgtggataggtgggtgaatggatgaaggagggagggatgggcaggtagatggatagattagtggatggatgggtggatgggctgacaaatggcttgttcccagactgtttgtccttgggtggagtcatgcaggtatctattgcagctgggcctgaactgatatctgaagagagaagtggagacagcgaccagacagatgaggatggagaacctggctcagaggcccaggcccaggcccagccctttggcagcaaagtaagtcatctccagccaccccctcctcagccacctcgattccatcccgcagctgggacgtcaggttctgatttcctgaaaaccttgatggcctctccacaactccactagtttctactgcatgagcaccaagaatctgctgccctttcccaggcctcagtagtctctgagatcattgggcaccaggcaggagcagtgcttccaccatcagaaacctcaaaagcaatctgtgtgatgggcaaagcctactgagtgtgtggccagagtctgggggcacacgggtgtagtgagtgcaggggactgctgtaggacaggcaggggtcctggagggctctcgagggtcctgagagcagctgcctttgcaactttcagagaagtggacccctcaggctctcctctaagaccttttctccttctgggttttgttttgttttgtttgtttttttttgccaaccatgagccttgtgtttctgttttcacgtattgtttaacttattttgggtgggcgagacaaacgaggtaacacctgggttttggggtgggaagcaagaaggggaagcagctggaagaaggggctgggtaggtgagcaggggttcagacttagatgcttggagagaaatgggccagtgacattcaacatgaaccaactctttgcggctgctgtgaggggaacgtcatcatctttcgtttgagaacatttgattcatgctatttatgaagttcccagaatgctctgcagtgcctggagtattccctacatgatagagcagtttaaaggatcaaaagaattataatgaaataggggtttagaactaaatgcaggctcttacatctaaagaacaaggaactatcaggagcttgcccacctctgtctcactcagccatcgtgccccggctatccgaagccccagggacccgcccctctcccagccctggaacagcttgcctgccccctaggcggggtccctggggcaagtgcaggggttcagctcagtgttccttcagctcagccaagtttctggagatgcagatcctgtatcctgggtgggatgggcaccgtgagcaccaaccagtcccccaaccagctccccctctgggcttggtcaggtttgttcctagtggagggggtggatgtgctgggagaggagcctgccccgcccctctgggggctgagtgtggggttggggaggtgcagggtatttggtcctctccctcaagctagccctgacttgagtcttgccctgtcttgtgcctgctaagaaaaagcgcctcctctccgtccacgacttcgacttcgagggagactcagatgactccactcagcctcaaggtcactccctgcacctgtcctcagtccctgaggccagggacagcccacaggtcagtgggtcctcgtgtctttcccctgcccctcccaggaacctgagtggcaggtgctcaggccccaggtgagggacagcactctggaagcagtgtctgatggccacacagtcccacctggctcccaaggcatgacagggaaggggaccgatgtgggaagacaggatccagagacctcacactcccccaggattagcatgtctggagatatgagcaggcagcttggagaagcagggggcgatgcagggccctgagactggacagatgagttggggcccagggatcggtgcttgggacagaaataaggcagaacccccgagactcaggagggcgggacagagaagggcatctgaggtggagtcaggcagggcctgctgtgatgcctacatctccgtcttactgggaggggaacatacactttattgcccaaactaggacagtcctgtgatgctggcagctattaatgatcacacctagacacagggcatgcgcaggggccatccaggtgaacaggacatgtggccgccttactcattagctgtgtggcctttgtccctggaacctcttcaagggctgattagtggtagttgctggttgattattatttgttagtatttatgttgcaattgaaattactcaagataatagattagataattaggagtaggattagaagggatgggataaaaaaagagagaaagtagagtttaatcaggcctttctgagtagatacggtaatggaggctgaaatttgggtttgcataaaggtctttggtatagacttttctagttaaattaggtttggaagtgaagccagattttggcttgtgaatagccttgagttgggggttgtatggtgaattgtggctgaataaaatcctagtatgttggagaagttaaatatctgtaatgggtattttagtttaaggttattagttatgagattaagctccattgctagcaagaagcctaaggtgtttacacctagggctgcgagcttcaggtggagtggtatggttgtttgggggaatgaagcaggaataatactgttggtgatgaggaatccagcaaagatgctgccgattgttagatgcttaattgagttaattaggaaggggttatttttgttaatagtaaccagagtcgtgtagcgaggttgtcctattagagcgaagaaaacaatatgggtactatagacagctgttaaggaggtggcaataagagtaatagaaagggctcaggcattgctgtatgatgggcttgcggtatccatgatgaggtctttggagtaaaagcctgtgaggaaaggcatgcctgtaagtgcaaggctgctgataacaagggaggaggaggtgaggggtagagtcttgaatagccctcctatttttcaggtgtcttgttcatccatcattgatgttatggatgatggaccctgaacctataaataatatagctttaaaaaggcgtgggtgcagatgtgaaggaatgctaggtgtggctgattaatgccaattgtgactattataaggcccagctgacttgagttggagaatgcgatgttttttgatatcattttgtgttagagcatagattgctgtgagtatggtagtaacagccgccagacagaatgtaaaggtttggattgatagattcttttctattgaagggtagaagcagatgagcaggaaaactccagctacaactatagtgctggagtggagcagggctgggactggggttgggccttcaaacacctgctatgactatagtgctggagcggagcagggctgagactggggttgggccttcaaacacctgctacaactatagtgctggagtggagcagggctgagactgggcttggaccttcaaacacctgctacaactatagtgctggagcggagcagggctgagactggggttgggccttcaaacacctgctacaactatagtgctggagtggagctgggctgagactggggttggaccttcaaacacctgctacaactatagtgctggagcggagcagggctgagactggggttgggccttcaaacacctgctacaactatagtgctggagcggagcagggctgagactggggttgggccttcaaacacctgctacaactatagtgctggagcggagcagggctgagactggggttgggccttcaaacacctgctacaactatagtgctggagtggagctgggctgagactggggttggaccttcaaacacctgctacaactatagtgctggagcggagcagggctgagactggggttgggccttcaaacacctgttacaactatagtgctggagtggagcagggctgagactgggcttggaccttcaaacacctgctacaactatagtgctggagcggagcagggctgagactggggttgggccttcaaacacctgctacaactatagtgctggagtggagctgggctgagactggggttgggccttcaaacacctgctacaactatagtgctggagcggagcagggctgagactgggcttggaccttgaaacacctgctacaactatagtgctggagtggagtagaactgaaactggggttgggccttcaaacacctgctgcaactatagtgctggagcggagcagggctgagactggggttgggccttgtatggtggatgggagtcagggatggaggccgaattgagctgactttcctgctgctgctaagagaaagctaattaatggaaggggttgggggtggggtctggaataaatatgtgttgacattctcagtgttggaggacaggaggaaccatgctatagctaaaataaagccaatatcaccgatgcggttgtactggactgcttgagggctgctgtattagcatctgctcggctgtaccatcagccgattagtaagaaagacatgagtcctacaccttctcatccaataaagagctgaaagaggcggtaaccagaattaatattgtgatgaggaaaataagtatttgaaaagttgattaatgtttgggtctgagtttatatatcatattgagaattctacaatagatcggataatgaatagtgctgctgggataaatattgtggagaagtggtctagtgtgaagcttagtgagggtttgagagtctggattgtcagtgtgagataatggcttcttggtctgtgtatataaacatcgttgtagggatgactgtaatgatgaaggcacatgcgatagatgtttttatgtaatttgggtatgaaccttttttgcaggggttggctaaggtaacagtaattggtaagattaaggggattagggctgttatagcagcggaataattcatgtttgctatttttatttggagttgcaccaatgtttttagttcccaagaccaacggtaactctaatcctttaaaagctgagaaagccatgttgttagacacaggggcatgagttagcagctcttgcatactttctccatagataagaagttgcaggcttctattgttaggtccacaatctaatgttttggttaaactatagctacagcatgcaaaccccataatttagggtttaaggataacaggaagatgggcgcaagatgtataagtattaacgtattttctcgtgtaaagaaggtttaatactgttaatatacaagtgtccctcgttgtgttgtgattagcatatatagggagtaaagggctgtaattagtatattaagtcctataagcataacagtgatagttgatcaggagaacgaggccatagtcacaaagagttctcctactagattactgatagcgggtaaagcaagattagtaagatttgctagaagtcatcaagaggctatttactgggagcagtgtttgaaggcctcgggtaagtaatatggttcggcctagggttaaaatagttactaatacaaggcctgtgctgattattagtgtcaggtgggttgtttgaagggctcatggcaggagtagtagtagagtgatctctaagtcgaacaggaggaacgtgatggctactaggtagaattttatggaaaaggagaggcaggctgaggctattgggtcaaatcctcattgacaggggctggatttttctatataaatattaagttgcgggagccgaaatgcgattattagtagtaatagggctagtaaggtgtcggttactagggccagtgtcaagttgattatttccgccctacaggatcatttcaaggatgctgtattagggttttcttagagggacagaactaatagaatatatatatatatatataaaggggagtttattaagtattaacttacacgatcacgagtcccacgataggctgtcttcaagctgaggagcagggagagccagtcggagtcccaaactgaagaacttggagtccgatgttcgagggcaggaaacatccagcacagaagaaagatgtaggctgggaggctaggcctgtcttgtcgcttcacgtttttctgtctgctttatattcactggcggctgattagatggtgcccacttgattaaggctgggtgtgccttccccagcccactgactccaatgttaatctcctttggcaacaccctcacagacacagccaggaacaatattgcatccctcgatccaatcaagttgacactcattactaatcatcatagatgctgtacctggaaggcatgagactcacaggcaggcagtgaaggtaactatgggcacagagccaggcccaggcccaggcccaaggccggcttcatagtgaacttctgaactccattcccagcatcccctgggcacaggcagtgctgagccagagctggggcggggctcggtccacccaggccggtctgaagacccctccaggaggagggggaagcagggtgggtcctggaagccagcagccaattggtttctgggccacaggtcctgctctaactggaggctgtcctaagtgcgcatttcctctggcctccaccccccactcacagtcaaactggaagggcgctgtggcatattgcttcttgaagccctcagtacctcctttccttggggacaatgacataacacagacacccctctgctggagggatgtccggattacagccaaggagctgccaggaagccccaacccacttttctgatcttcaaagattaaggtgtacatagttagtaacagtgcacccttctcccaaaaatattaacttccctgcccacgtcctcagagctttggtctctgggtgagtctgagcccctgaggctgtgtcaggagagttttgatccctttgtgtcatgcctggcccagggtgtcgttgggggccccaacattgcacagacacatgcaataggcagtcagtaggcaacaaataggcaatatatgctttaggcacagtctttgaaattaaacagaactgagtggcaggggccagcgcagatgggtgcctagtgctgggtcagtcaagtgcctggaaagcctcagggcttggattgaaagacccacattccaggcagcggcccctcctagtaaaccctgcagaggaggctgacagccccatgtgcttagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcggtaggtgcccttggccagggtcttcctgatgggctcggcatgggggagcaggtcactgaggaacaaccccaccaccctgacctatccaacacacgggctgatttgaaaggccccttcctttggcgtgattgtccgggacgtgcagtcccagcaaacaccgtggacacctgccgtccccgggaccgggatgtgcgcttccctgtaactgtcagaacttccagcacaggaggtggccagcccacagctccctgcttccagcctggggtgggacatgcaggcctccctgaaatgactagaaccactggtcaaccggccaaccatcctggtctgggcaggatgggcatctgggcattgccactgctggcccacagtcagttcaagtctgttgatcaggagatctttaagcactgagaacctaaatctgcttggcttaactttgtcgtcagttttgctttgaaatgaaatccccaaagctctgtcttttctggtaccccaagggtgtatgtaccatgggtccgagagttcagatgtcccatcggaacaggagcaagtaagatcacagcagcagccagctttccccaagccacagcaagtggctgcgtgcgggaaagctgtctactctccagcttccctcttcgttgtattgaaggggccgtaatctcatgctgacggggaccttggaggctttgggaggaaggcagggctctactttcccccaaaaacaatgattaaatgaatctactttggccaagccacagggtgcagacctggagagcagttttatttcctctgtgatctcaagtcccctgagcacgtcgaccggaggcagtctgggggagaggccatcgtgctgggagagctgcctcagagtcaggcagttctgagtttggagcctcactctgccagtctgtttcactggttctcacacacgttctttttacacaccaacctctcaaacggggagtgtcttacagtgaatgtggtaagaaaggggtatgcttgagactcactggcagcactgtctctcaataatgcaacatccaatctgcaaagtctgagattcattgaggtatgctgtgctgttagaacaaatcgcttaacctctgtgcacctcagtttcctcattgtacaaaaggggttaacaacgtctaactcatcccattgtcatagggattaaatgagatggctgaacctgttgactacatagcaaattatcacaaacctaaaatgtggcttgaaacaacatgtttatgatcttatcatggaatctggtgttatttgcaatttgaaattgggaatcatattacatttactttgcaaacatgcaaagtatgtccactcataacccccacccacaatgccaggcaaggtcctcttttttcctgaagatctttgtgtgtggctgtggaatctgccccattcttattgtgactttggaacctcagccctgtaacatgaacatccttatgtcttcattttctttgagcctcatttttcttcattggactaaacacgtccatcagctttcaggttttcactgcaagtaattcaaacccactctcgctctgaagggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcaggtaacggtggctggaaagacttctgtcttgtcgtttctttgggtggagtctttttacctccacaccaagtcactttagagaaattacagcttttaatactttcaaactatgaaattgcacaagcctacttaatggagatacgtcatcacaatattttttgtggaagtgaattcacataacagaaaattaaccatcttagtatggccattccccaaaaattaaaaatcgagtttccataggatccaacaattccacttcttggtatacaccccaaaaaattgaagacagggactgaaaaagatatttgcaaccccgtatccatagcagcgttatttgtaataatcaaaaggtggaagtaacccaagcgtccattgacagatgaatggataaaaaaatgcaggatgtacgcaacatggaatattattcacccctaaaaaggaaagaaacgctgacacatgctagaccatggatgaacctggagaacactgtgctaagtgaaataaaccagtcactctggacacatgctatatggttccacttaacctgaggttcttagtcaaattaatagagacagaaactagaatagtagtcaccaggggctggggtcagggggatgggaattagtgttgaatgggcacagagtctctgctttgcatgatgaaaggagccctggagatggacggtggtgacagttatacaacaatgtgaatatacttaataccttaaaaatggataaaagggtaaatttttatatgtattttataattgaaaaaagtaatattttattgaatttaggagaaaataaataatctttagtctttcaaaaaatttatttttttttaatttttttttgagatggagtctccctctgtggcccaggctggagtgtaatggcgcaatctcggctcactgcaacctccacctcccgggttcaagtgattctccctcctcagcctcctgagtagctgggaatacaggcgtgcaccaccatgcctggctaatttttgtatttttagtagagacggggtttcaccttgttggccaggctagcctcaaactccaggcctcaggtgatccccccaccttggcctcccaaagtgctgacattacaagcgtgagccactgtgacgtacaattcagtgacagtacatttacagtgttgtgtaaccaccacctctctctaattccaaaacaacttcaccccccaaaaaaatcccatacccatgaagcagttacttcccagtctcccttgtccccggcctctgacaactaccagtcttccttctgtctcaatggatttgtctattctggacatttcatgtaaatggactcacagaaggacatctggccttttgtcacgagctcctttcaccgagcataatgcttctgaggtccatccatgctgtagcacatatgggtgcttcattcctttttatgaaaatatatattttatacttgatcaagtattatatattttacaagaggaggaaataatctgtcagctatgtgaaacgcttagcaggctgtattattattattttttttagaaagagtgttgctctgttacccaggctggagtttagtggagcaatctcggctcactgcaagctccgcctcctgggttcaagcgattctcctgcctccccttcctgagtagctgggatcacaggcgcccaccaccacgcccggctaatttttgtatttttagtagagatggggtttcaccatgctgaccagtctggtcttgaactcttgacctccagtaatctgcccacctcggcctcccaaagtgttgggattacaggtgtgagcctccatgcccagccccttagcaggctttatataggcattaagaaactctgctcataatacttaacacctgttaaattagtagaatcactcacattgtagacattaacttatgaaataattcatcacaagattcaagtgccctgagttccgcttgctgcatttaaatgatgattctgttgagtcagctgatttcaatttgagcaagttcatgttaccgggggaaaggcaatattgtttcttctgagaacatcatgaccactaggttctttaaggcaatgaaagacacaggctattaatgtctctgatagagccttgactccagcaacgtaatcacaggatgggggactgttctgtaactgatgactcttgaggcatgaaacccagagaaggggaagtggggctgctctgaatggagaccggaaccgcagtttcaccaaggctggtctcaggcacatcttctggagcctggatgaatgtagggccagctccttgggcatggtgatgcctggtacagagcccctcctccctcctcctgggagagctggggaagggaatgccctgtggagcttcccttcgggcctgtgggctctgggctgtcaggagggaggctaagtgaaagctgagccttgtcaggaaaggcctggaagcagcgaggacgcaggtggtgcacagctggggttctcaaggggcaggcgaggtgggcagggcacgcagaagctgctctgcagggtctagggcttctccagcgccctggcctttcggtgcacaggacgacctgagatggagcatcacccagctcttcagccacagggctgcagattcctctcccaaggccttggcctacactgtggcagtcactagaccagcactggctcacgagtgggcaacaggaagtatgcagtaggccctgggcttttccgagccctcattcagcaggaaatctgtcccgtggctgttctcacagggccaaaccttcgcgtgcatgataggtgaggggctcctccgacatcctgtcactttgcttctgcacccagagaaatgatctaccaaaaatgagcacctgaatttcaaaaagagacttccttagcatggcaatatggggaatcataggggtttgggttctaaaattgggctagtgtccacggggcagaagcatgcagtttctgaattcagcatctctctggactcagtgtcctcagctgactttttactgtagtgtcatctggaagcttcctcaaccctgggtggaagtttctcctgcaccaacttccttgagggcccacttagtctctgaaagaagcactcttgcccctgagcatagccgggcatgaaaggccctgacaaggcctgcgtgaagactgcttatggccgcgtcacccattggggcccacaattcctgaggcatggaactccttttgtgtaacagcaagcaaggccctgacacaaggaagtgtcctttcattcagatcagggagtgactggcttggcccctgcagtttctgtgtcccgagaggacttgaaacctgcaggtatgctgagctctggcggggactcagagcagacccagtgctgcagcagtcaagcctccaccacctgcattcgcaggtctagttctgcaacacggaacacacacaagtcgagcagagccacttcattactcacagtcaggcagcgaggtcccccaggctcagggaagctgcagggagggtggagtatcggctgcaagtatcctgtgtcatgcggcagctggggggtcccagaaagcattcctctctgagtcttataccctgggaaactgggatcactgggccaaaggatatccagttctagagcccaggttctagacagtccagacagttcttccttacatcaggaagtggctttcttgacacattctacagttattctgagaaaaggggaagagccaactcagccaagtccatccagggacctgtggatgcaggggacagtggaggactagggtggccaggatagagacctccccagtgtggccaggatagagacctcttgggtgaggccagcatagagacctctcagggtggccaggtagagacccatgggacatccttggctggctgagcatctcctagtctcctagcctgaagacaacaggatgaagaggagaatcaagttgtctattttcagtaaacctgtagtttagcaactttagtagcctttagtaaaatacatagcgtggtttccagccccactgaaaccaattatcctttatacctgcttggaattattctctagttcatgtttgtatatcctgcctgtggaattgtttctctttatttattcctattaacttgtatttactttgccaaccctaaataatgagattcagaaaatataaataagtattagtatatcaagtttatcagaacaaaagcttgacagtggccacccagaaacacagacttcaaacaaatggggcccaaagtggactagtgaagttttcacctatgtagaaattgtagcaggatcacaaccttgcaaaggaacagtgacctggggggcccttatctccaatcctgtttggtcttaattattcacagggaaaaaaaaagtagaagtttcagctgtgaaacatgtcctctcaagactcagaatttaaagttccaacagctttgtttgaattattcaatgtgacaacctcaactaatatttcacctagattgtttcccatgcatctttatatggaggaaattaagcagcagaaagaagctccaaatgcagcagcgatcctgtacttcagagaaaacccaggcagactcttagaggggcctttgtgaagtggctgtggtgggaccccaggaggaagcactctcaatctgcccatcaaccccaagactcccagccatgccctcagggcctgagctttctcaggaatcgtattttatcacagctcatctgaggggtcaggcagctgtgcattgcctgcctttgcatttgtattgacagtcacagctttcccgacgaggggtaaagacttcctgtagatattgttcaagcccagacaaggcccaagatggcacaagcatgtggtaggaaggaagtttctaaggggctgagatgggagacgggagaggaaacggccctggcacgcaccctccgccccctcactcccaagggccggccctggggccattcgtgtgtgctcgggctacagacactgacggtttcccataaaagtgtcaccagtgacatattttgttggtttgctttaatccctagctagtgtctgtattgcatttgtaaactctaaactttggtattgtcgcgagttgaaagctcaaggggttcctacctagtattctgtccgtacatatctaagtaatgtgataatcctgatgactggtgcccacacagggtcagatgcccacgtctgagtgatgctactcccaccagagcagttgttactgttggagaaatataatttttagaaaaacccgaaatcttttcattacccagaaaatctctccataagggtagcagaggaagaagacagatttattcttgaacaagcatcaaaccagaatatggcacgtgccccaggcaatccgctgagagattgcaaagacaggaaggcctctcagcccttctgcagcccggcaggcccggcccattccacacagttctcagcacaaaccatcaccagtccttaccaatgagaggagctgatggtgcctttgatcacagtgtacatcctcactctagcatcataaccgggagaccacttgtgttggctttaaccctaagaaaagcaaccttctcacacatctttaagatgggagctagttttgcaaactggagcaaggcgcccacccacgttagactcttcaccctctcctggggagtgggagctagagttatcttcaaggatgtttccatttcaaaaacacagttcccaggtggagttttgagactgcagagaggctttttagccattttaaagatttatatgtatttggaaaaagcagagaaagaagctctgaaagacaagggggcagtgggaagtctcttctctattttcttttcttttttttttttttttttttttgtcagagtcttgctcttgacacccaagctggagtgcaatggcatgatgtcagctcactgcaaactccacctcccagattcaagcgattctcctgcctcagcctcccgagtagctgggattacaggcatgagccaccacccctggctaatttttgtattttagtagagatggcgttcgccatgttggccaggctggtctcgaactcctgacctcaggtgatctgcctgagtccccaagcccactgcttccgggagacagaggatgtgtgctgagtgctgtctccccagggtattgatctctgcttctgcagatgctcaacgggaccagagggtgactcagttactagtggccgctcaaggcgtgggccgaggtctaactgaaatcctggtgttgacatttctcagccagtcatgttcttcgggcagatttgcccactcaaagcccttggtgctgtgatgattcaactaattaccgaccaaacaatacaaaagcatcttaacactccacagcaccatttccctcttttaaagccaggtgagccgtaaatgagataatggcaggaaagatgcatctgctgggtgaggaagaaaactagaaaattgatttatcatgtctcagtctgggagctaatagactttgggtgactcaagagtctggtgactcaagggatgaggaagttgtacttctggtccctttaggttgtcacctgaagtgccttgcctcctagcccactagtgaccccaggctcttgctagctaatgactgtgagtttgatcactgtggcgtaattaactgatgtcttcctgtgctgctcggtaccggcagtgacagtggctgtccacagtaatgacaccatcacaaccttccagattcagctccttgtcctgctggactcggctcctctcctccactttcaccctccccactctcccctctcttggttccgctccaagattttgcttggtgttccagaactcttggtgttagaaatgggtttcacaattaaccttcccaggccatgtcatgggtggtggccttagctctccttccgcttcttgggaatttggtgcttcagaggtggtgggtgccagtgtcttgctggttggagtgcactgggtcctctgcccactgtttctctccttctgctgcagatctttgagctgaataagcatatttcagctgtggaatgcctgctgacctacctggagaacacagttgtgcctcccttggccaaggtaacactgggggctgggcaaagagaaagggcccccacagctccttagttaaaggaggctgaagtgtgacatgggcttttgggagaagagtttcttgagattttgctgtttgtaaggttaagttctgtgtgtagttctcagagagccaggcagttcccaccacatagcctgagtgaagtcttctgtcccatccaggcctgccaccacctctcatgcccagagcttgaatgagagaatgcttggagggcacatacgtgtaacagccttcccaggggacataactggagatgggaggaaacttgcttggccctacagcctctgaagtctaggcaccaaagcagggtggaatctccttccgcaccatgtttgtgaatgtatcatcagcacagcttagtctgctatatgctgctatagcaaaataccacagactgggtaacttataatgagcagaaatgtatttggctcatggttctggagactgggaagtctaggaccaaggggtggcatctggtgagggccttcttgctgtgtcaccacatggcacatggtgacagagggcaggagagacagaaagcaagatggaactgaacttgcttttataacaaccaccctggaatgaataacaaattcattccttcaataatgatattaatccattcatgaaggcagagccctcacgacctaatcacctcttgaaggtcccacctctcaacactattgcactggggatcgagttcccaacacatgaactttaggggacacagtcaaaccacaacagcacaccgagacaacctgatggggagtaaataaaacaaaccatggcctgctgcaggagtgtgtgtgcatgtgtgtgtgtgtgcttttgtgtctgagagacaggcagacagacagccggggtgcagagggagtagggacccagtcctccattccagctgagtcacagccacacatctagcacctgggcacggagataaggagattcagcaaatatgattaagtattgagtttctttgagcacaaagtttgaggacagccttctgggccacacagactccataggaatggggtcagtgctccaaagtggagaatttaaagtttcacttatataggcagaaacagagaagtttctcagtgttacagcattttccatacaaggcctataattacattgtagcaattcactaggttacagcttactaattccgaggaagattgctttaacactccatgagtaggggtaatgatcttgagaggggtctcatctctggcaccactcggtctttcccaatcgtctacagagaaaagcagaaacagaagttgcatgccacttgactcaggccacatagccacattcctctagaggctcccaatcatttaaagttccaacagctttaagtttgaatgatttcactccgcaggacgctccttgtagcaccctaggtttgcagctgctcatttttcttggggccagggctccggagaaacagatctgggtgaagctcgggttgggggcatgagaccaagtgggaagcagagcacacaggccccaagttagaccccaagggctacccctgcacaggctctgaccccggccggagcggagagagactgaggcccagcccacatgccatgtgtccagcagggaccacagctgcctttatctataaggggatgagttactgtgctctgtgctttatgggttactagagccaggctgaccatgtgccataatttcatttaatcctgcagtacccctgcaaggtagacatttctttccctcacttatagatgaggaaactgaggcccaggctctcatgagtgagactcggcccatcactgaccggagagcaccagctgaaagcacagggaagttagggagagcattgcttcccacgggatgcctctggaagggcccctgcctgcactgagtcagagtggccccaacacaagctccagcgccccatcggaccccatgtcccatatccagccatccagcccccaggcccctgcggaacactgacccaggtctcactcgggcctcggctctgcctctcaggtggacactggagatctgtcactcacctccttcacccccttcctgcccaactccttccccaccctgctgacccctcagcaacactcgggacccgctgtcctgtagcctgcccggccctggctccagcccacccagaaacagattaaccttgtggagggaaagggcagccaccctcgctctggctcttgttggtacctcctggctttggccttttgctcatacaaatctcagcccagggactagtaaatcagaagtaacagactccacatgggacctgcactgcccatacactccccgcgaggggacactgctcgcggaatggccctctgggccatcaaggagctggacctgagaggcagcggggccctccaccttgaggggctggatctggggccaccagcatcctgtcaggggctctcagggcttttgcacctggaaatccctggcaaacaaggacgagttagtcaccctggctgtgtcccgccatgctggttcaggtccctgtcacacacgtatgttgtcatgtgttttccacacatacatgtgtatatgtgtgcatgtgttgtgtgtgtaggtttgtgtgtgtgtgtgtgaatttatttactggcttacaaagcgaagacaatccctgcctctcccaggcatctaccggcttccacccccataccccgtcgctctgctgcgtcctgcctgatgggcgctgggcttccatttctcacggggatcctgcagtttctcagccccatgcactctgggacgaagttcagctcatatcaggcccaatggcgtttacaggctgaacgtcattcccgatctttccaccgagggcctctgtgatttgggggctttgtcaggaaagtggagcctcacggaaaagcatactggctaaaacacgcggcttcttcatcgactcaatctaatcatccccttggtgttcgtctgtgagaccccaggcagccagccctgtcgatctgtctcaataggcttcgtccaaatagaaaattaaatgatcatgtgcaatatcctcggcttgatgggtgagggagggatcgatgcagcccaggggcgccgtgggctgtgagcaacttcctggtggaggcacctgctctccctccctcccagccctccagtgtcagtggaggtgatggctcccagaggaagggaccaaggacggcactaaagttccccaggtggcatctctgcgcggccctcgcctcacacttcaaagtcgacttcatggggccaggggagagccctcggaatgtgggatggatgagtgaacgagcaggtgcacgggcagacaagtgaatgggcgtcgtcttcctggccatcttgctaacttgtgtgacttcgtcacctgggaagagtcgggagacacagggagccactctgctcccagcaccggctcctgacgatggggaggtggccgtgaacaaagtcgacaaaaacgcgggccttgtggggtttgcattccatctgggagaggcaggaaacacgcaactgctggaacaccaagctttcccccaggagggcggggcctgcgtctgctgaagggaactcagcatagacagggtcacagggaaaaggccaatgatgtgttactgtgcacatgaacacgggggtcccccaaatgtgggactcgaagcagggacagacgactgaggtttacacccaaggcgacaggacggatgggtcttggggcttcctgaggggttacaggggtgacaaggtcacgggagggtgaggggaggaaagccttctggttatgcagataaaaatctctcgggtaaccaggagctgccctcgaagaatcggcagcagtccatgctggcggcgtcgctgtccgacgtgtcactgtcaggcatcagtgtccttttaaggccgctgagggggtctcagagaaagcctgtctgcctggtgttcagctcacccctatagctttcctccagggatgaaatccacccccaacacacacacaaaaagacaggttttcagagtgatcccgtctgcagcttctctgaataaacagctggaaataagtcccagaagtctattctggggtggtgtattttggtttccttcacaacccaacaagtggaacacaggtcaggaggtggaggaaggtacagaaaaataaatcaaggcagaaggtccctggggtgagggtgacatttcaaacaggacagtcagggcgcctcactgagcgtgggatttgcccaaagagctggcagaggtgccggggctgccgtgtggctgtctaaggtcaagtgttgcagcccctcctaaggtcccaaggagggagccgctgcaggagacagcccggccaagatgggcgaggcaggggcgggtgggcgcgcagaggctggagccggacgtagtggcagagtcagacagaacggagcctcccaggccatggtccaggctctgccttttactatgggggggcggggaggcttgagcagaagacagctggctgagggcacaggggttgctctggccatcctcctgagaacaggttgtggaggtgggggtgaggcagcagggccggctgggagaaggcggtggtcgaaccggagagcagcgaaggtggtgcaaggcagaccgatcccgggggcctcgcgtaggcagagccaacaggaatggatatctgggatgagagaaaaagaggggtcatgatgtctgcaaggttcttggcctaagcgagctttaaagggtgaagctgcctttaaaaatgtgagttttacagtgtgagtgacactttcaatctcatcgcctaccttagcaccatgttggctgtaagaggcaattgggataattttgtgtttttatcacataactctgccactttctcggagctggcacctaaaacccttcatgaaaggccagcgtccacaacagttaaagcctgcccttaaccctcctgcctcctgcccacagacaaggtggccagtggaactagaccctttaaggactttacagagattattgaactgagttcttataacttgcaggttggatactgctatcaccaccattttaaagctgagggaactgagatgcagaggggttgagtgacctgccgaaggtcacatggcctgatagggagccacaggtgaactcgcagtccagtggctgctgttatgtgatcaggagcagtgtgccccagaggagtgtcccacagcagctgctaaatgaatcgttggccagagcgtgggaagagcccagcccctgaagctggacccgaccaaggctgtctgtgtatttccctgagagagagtgggcagagatccatgactccacacccctctctcctcatccctagagtaaggacgtcagcctggaataaacaaatggcacccttaaacaaaagggatgagaagggagaaaaaaaatgtgggtcttagatagccaggggtggtggtcagctttccctgggaacccccagccctgcagaacctgctcctggagtctgggactgggccccagaggggcatgttggacaagctggcatggagaagggaggcagctgagctcagcaggaaccccaggtgtgctgggccctggcccatctcccagagccagccctggagctccatggctccagatggctagccgaatccaaatccactggcctgttctgtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtaagactatcccccagaggtctcagcaggaccctgcagaggtaggggcagggatggacagtcccagctggcagccaccctccccagggaggcagcacccacaggagcacaccaagggcccttgatggggtctgcagcgggtggccggctcctgaccaaccagctcccagggttcagagaggagagcaatatcgtggtgagtccccatctgggtgaaaccccacactccctcctgctgctggtcagcctccgtccttctctttcctaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtagcccagaaggcacaggggagcactgagttccacaaacacagatggtgaccacacccaggccttgaacatctgccagctctaacatccgccagctcacactgagccctccccattggcccagcatgcacggctctgaaggccaggcatgaacctgggggtttctgggggactcacctaattcgccaccccctgagccctccaccccttccctttttcctgttcaacttggtgagggacaggcagggtttccaccaagaaaaaggtgctgaacacacaatccctgacccaggatgggggcctagaagcaggcctggaatttaggacagccccagacctcagcactggactctgtccggagggccatctgtgagtctgagttgtggctgcagagcttgaatctgggtgaggaacccatcaatagtgcacaaaggtcaaagggcagagccaaagcattcaggcctcccagggacagctgaggtgacttaggcactgctctgtcctccctggagacctacagagaggagagggggtgcctctcggactgtgaggacagccagcccccacggccctcctccacttcccttctcatcagcaggtgcctgtcactccctaaggacaaagggcacgtcccctagagctgttcaaggggagcgagtcaggctctggactttcccttcatgtattccttcttgctttgcaaataagctttaaatgcctagaatgtagcccacattgtgtaggccacggaagatctggtgcaaataccttagacgaagccccagccttcctggagcttgtttttagtggaaggagataaacagcaaacaaacaagatcatttgggttcatgaaaagtgtgattaagacaatcagtgaaggtgagcccctagagtgctcggggcagggcgattgagataaggcagtcaggagggatactaggaaagtaagccagcctggcaaatccagggggcaggaggccgggtggagggagcagcccgtgccaaggccctggggtggcagtgggcttggtgcctgcagggattagccgtgaaacccccacaccaggtcagagtgatgaggggagagtgtgaggagggtggacggcaaaggcccctgggggccactgcaaggatctgagtagggggtgatggggcctgcttctaatttccagaagctgcccccagctgctgtgggaggaggggcctaagacgggaggggtggaatgggggccaggcaaggatgatgccagtgggagtggccgactgctaggtgaagagtagccactactgtccttgcatgtcacggcccctcctccagcccctcatgggagccggactccctgagactcaagaaaatgcacccgtcctgcgttcctcctgcctggggtgacccataaggaacaccccccccttctcaacaaccacagaagataaatgccaaggggaccaccaacatgggcatggggctgtgatgccaatcttaagggaaaacacaagtaaaattggctccaggactgagctgggggcagctgctctttctgtccatgactttgaggcgggatctcgagcgtctgtctgacgggccttctgtctgctgtcctctcgcaggtttcagacattgaatccaggattgcagccctgagggccgcagggctcacggtgaagccctcgggaaagccccggaggaagtcaaacctcccggtgagtggggggcagtggtgagtggagacagtgctgagtgggggggcagtggtgagtggcggacagtggtgagtgggggacagtggtgagtggagggacagtggtgagtggggacagtggtgagtggggggacagtggtgagtggagggacagtggtgagtggggacagtggtgagtgggggacagtggtgagtggcggacagtggtgagtgggggacagtggtgagtgggcacagtagtgagtggggggacagtggtgagtggggacagtggtgagtggggggacagtggtgagtgggcacggtagtgagtggggggacagtggtgagtgggggcacagtggtgagtggagacagtggtgagttgggggacagtagtgagtggggggacagtggtgagtgggcacggtagtgagtggggagacagtggtgagtggggacagtggtgagtgggggtacagtggtgagtgggcacagtagtgagtagggggacagtggtgaatgggggacagtggtgagtgggggacagtggtgagtgggggcacagtggtgagttgggggacagtggtgagtgggcacagtagtgagtagggggacagtggtgaatgggggacagtggtgaatgggggacagtggtgagtgggggacagtggtgagtgggggcacagtggtgagttgggggacagtggtgagtgggcacggtagtgagtggggggacagtggtgagtgggggaacagtggtgagtgggggacagtagtgagtgggggacagtggtgagtggggacagtggtgagttgggggacagtggtgagtgggggcacggtagtgactggggcgacagtggtgagtggggggacagtggtgagtgggggacagtggtgagtgggggacagtggtgagtgggcacggtagtgagtggggggacagtggtgagtgggaggacagtggtgagtgggggacagtagtgagtgggggacagtggtgagtggggacagtggtgagtgggggcacggtagtgactggggcgacagtggtgagtggggggacagtggtgagtgggggacagtggtgagtgggggacagtggtgagtgggcacggtagtgagtggggggacagtggtgagtgggaggacagtggtgagtggggacagtggtgagtggggggacagtggtgagtgggcacggtagtgagtggggggacagtggtgagtgggaggacagtggtgagtggggacagtggtgagtgggaggacagtggtgagtggggacagtggtgagtggggggacagtggtgagtgggggacagtggtgagtgggggacagtggtgagtgggcacggtagtgagtggggggacagtggtgagtgggaggacagtggtgagtggggacagtggtgagtggggggacagtggtgagtgggcacggtggtgagtggggggacagtggtgagtgggcacggtggtgagtggaggggacagtggtgagtggggacagtggtgagtggggggacagtggtgagtggggggacagtgtgtggggggacagtggtgagttggggggacagtggtgagtggggacagtggtgagtggggacagtaatgagtcgggggacagtggtgagtgggcacagtagtgagtggggggacagtggtgagtggggacagtggtgagtggggggacagtggtgaatggggacagtagtgagtgggggaccgtggtgagtgggggcacagtggtgagtggggacagtggtgagtcgggggacagtggtgaatgggcacggtagtgagtggggggacagtagtgagtggggacagtggtgagtgggggggacagtggtgagtggggggacagtggtgagtggggggggacagttgttgagttgggggacactttagtgttgggggggacattgtttattgggggcatagtggtgtgtggttgtcagtgtgtggtggtggtcagtggtgattgggcactgtagtgagtggggggacagtggtgagtgggaggacagtggtgagtggggacagtggtgagtggggggacagtggtgagtgggcacggtggtgagtggggggacagtggtgagtgggcacggtggtgagtggaggggacagtggtgagtggggacagtggtgagtggggggacagtggtgagtggggggacagtgtgtggggggacagtggtgagttggggggacagtggtgagtggggacagtggtgagtggggacagtaatgagtcgggggacagtggtgagtgggcacagtagtgagtggggggacagtggtgagtggggacagtggtgagtggggggacagtggtgaatggggacagtagtgagtgggggaccgtggtgagtgggggcacagtggtgagtggggacagtgggtggagggggcactattggtaggggggacaattattgggggggggcactaattgtgaggggggaccagtgttgagtgggggaatagttatgagtggggacagtggtgagtggggggacagtggtgagtggagggcacagtggtgagtggggacagtggtgagtggggacagtggtgagtggggcacagtggtgagtgaggggaacacagcaacccagttgagttggtgccccctgaggcctccccacagcacacacgccaccgtgggcctgacagcaggatcctgggccccccacctcccttcccgtgaacatccggcctgagtttcctcatagccagttagccagctgtgcctttgttggggttcatttttgtttattatttgttgtttctaccctaaaaaggctctttatgaggggactctgagcctctgctctgaggatctgaaacacacacaccctgacagtgtaaaatccaaaaggagccgcctgaatcatgttgcctcatgtggaaatccttagtccgccgccacgtgaagatggatgtgactagaacggagggcgcgggaggctcacatcagaggagctgctcacgtcaggccaacatcctcctctcctgatcccattcaggaatcttcagacaaaaccatcctgattaggacatttggcaaaagaatgaaagatgaccttaggagagtcccagatagggtcatgacggaaaatacaggatgcccagttagctctaaatttcagatcaacaactaataatctagtataagtataccccatgcaacatttaggacttacactaaaaaaattagctgtcgatcttgtgaacacaaaatatctgagacaggtctcagtcaatttggaaagtttattttgccaaagttaaggacacacccatgacacagcctcagaaagtcctaaaacttgtgcccgaggtggttaggggtacaatttgcttttatacatcttagggggacatgagacatcaatcagtaggtgtaagatgtaccttggttcagtccagtaaggtgggacaacccttaagtgggggcttcctggttgtagtagataagagacaaaaggttgcattcttttgagttcttgatcagccttccactgaacacacaatttagtctggctcagtgagtctgcatttttacagaagcgataggggaaaggaagcaatcagctatgcaggtgagcctcagggggatgactgtgaatagaatgggaggcagctttgccctaagcagttcccagcttgactttttcctttagcttggtgattgtggagtctcaagatttgttttcttttcacaatctgaaattcaaagttccctgggtatcctgtattttcatttgcacactttggcgccctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggtatgtgttactccattcaagccccagacacccgacaaaggtggaagactgcacccctttccagcagtgtggcaagtccacggggtggcagagatgcaatgtcctcacagctacccacacagcaatgcccacacagctgccacaacaccgtggcaactcttgtgagttggcttcctccgtggcacacacctgagctggatttgtgtagatgcatttgttgaaaatccaagaaagcccagtaggggagcgggaaagtgagacgggaaaggaaggaggcaagcatctgacatgaagcaaacccacacaggctgactgtggctcagtcctcctgggggctctggagaccacgcagatcacaccccacagttaattccgcgtaggagcaaggccacccacacccgtcagtcctgagtaagggccaggccctgggccacacacattcccaggcacttctgcccttccctgaacaggcacagcgggcccgtggcctggggacttcttccatctgggagacataggcgctggctgccagaggtgaaaacactcaggagccagtgtgctcgaaaatggcacagggactcggggggtgtgagcgggacccacagatgcagtgcacagagggcagagccagcctgggagggaggagctccccgtgtttaggtggagtggttaggagtaggagcagtgcacagagggcagagccagcctgggagggaggagctccccgtgttcaggtggagtggttaggagtaggagcagtgcacagagggcagagccagcctgggagggaggagctccccgtgttcaggtggagtggttaggagtaggagcagtgcacagagggcagagccagcctgggagggaggagctccccgtgttcaggtggagtggttaggagtaggagcagtgcacagagggcagagccagcctgggagggagttgctccccgtgttcaggtggagtggttaggagtaggagcagtgcacagagggcagagccagcctgggagggaggagctccccgtgtttaggtggagtggttaggagtaggagcagtgcacagagggcagagccagcctgggagggagttgctccccgtgttcaggtggagtggttaggggtaggagcagtgcacagagggcagagccagcctgggagggagttgctccccgtgttcaggtggagtggttaggggtaggatgagaggtaccatggccagcgccccaggaggaatgggctttagcttcaggccttacctgcagcccagcgcagcagggagcctcaaggaacatctagccactcctcttccaaccccggcagctcctcacagtgacacgcgatgttttcaaaagtccatctttccacaggatgtttacagcacccagcgggtaggcagtgctatttattaaccctgttgtactgatgaacaaaccagccggctcagggcagggggtgagcttgatcaagatcacagacaggaagtgacagcggggtctcagcccaggccatgcctgacacccacactcttctctggtgggggcgcttccacctttgtccctggaagcccagcctgacagcttctgcagtgcctctggcagccgcccacaaacccagccaggcaaaatcccagggtgccagacaccaggagaaatttccaggggaatttggccatttggctgtctcttcacttccctgaaaagccaaacagagaatggatttcttatcacactgtagcaaggcaatcaactggaaaagagacaggaggagaagtgtgaggaccaacagtcacagggacccaggaatcgtgttagccacaagtgatcttccagtatccctgtaaagagagctacaggcccattttacagaggaggagaccgaggttcagagagggtaagaagtgaattagccgggcgcagtggctcacacctgtaatcccagcactttgggaggccgaggtgggcggatcacaagatcaggagatcgagaccattctggctaacacggtgaaaccctgtctctactaaaaatacagaaaaacaaaattaaattagccgggcgtggtggcgggcgcctgtaggcccagctactcaggagactgaggcgagagaatggcataaacccgggaggcggagcttgcagtgagccgcgatcgcaccactgcactccagcctgggtgacagagcgagactccatctcaaacaaaaaaagaagtgaattaattgtccatgtcacacagtggtaagggggagtgctgggatttaaaccagacctgcagggcagaaacttgtactctttctgccataccacccaaatgtggcagcttccccaaagctgagcatctcttatttcaggcatttcatgcttaatttattgaaaatgtccattctcatattgctaaaagttcaaatattgctagagagcagaaaatagtggccatggttaattagaagctggaagaacaataagaaatccaaaattagttgacaattcctaaacgtcacaacttgatgaagcctggagacactctgtttcttctaggcaatggctgtgccctatcttctgagaagaaagttcagtaattccctgaaaagtcaaggtaagagccctctgctcccccacccccatgggcctgggaaatgagcttcggggaggaaaatgaccagtcgcagctctgtgtgtttcttcattatctgtgggacatatctcatgtcctgactcccaaaaaacattcccagtgccgctcgggccaccctcaggacccagcaagttggtgttctggacagctggaacttgctgctttaagcgtgcaaagggggccctggtggcagcggtggtggtggtagtggtttccatggttttctacataaattgtcctaacgtggtacacagttcctggccttctagaaagtacggctcatcatttagccttccttgaaggcttggtggtgacaaggacattagctttgtcctggacgaacgggatgtgaggcctccccagcacgtggccgggctcttggggtatctgtgtgctcatctcattcactcaccttgtgacccaaccactgctcaccagaggctggtagctcctccccccattcagagtcccgtccctctgctgtcgagctgtttcaggcccccagacattgttggactgatctcctgttgtccctgtcttctgagctttgccctcacacacaccattgttcaaactctgccacagctgcagtccttgcagacagtgtgtgtccctcctctgctcacaagcaatccttggctcccaactgcctgcagaatgaagtgggatttcttagcatagccctgcagactttggccatttgtcacacactggagccagcctgccccctactacacccgcccaaggatgcacttccttcccgtgcgtaggacaacgcacagcggacgctggtttcagagcgcaccaagcaggcacttgcctccacgcctgggtgtgccccctccctgcccatctctgtcctgtgaagtcctccagggccaagtatgaagcctctcccccggggctctccaccgcctccctgcaacacctggcacatcaatccctctttccagccagctcactccttgatcagtcagccaccccacctccatgccagctcgctctttgcatgccctgagctcccagcacacattctggtcaatcctgggatacagctggtgcccagggccctttggggctaatcccagattcagggtcaccagccaggagggcaactttgccagagatgacccactaaggagctgccagcaggggctcctggagagccatgtgctggctctgcggggagtttcctgcacatctcgtgggctgaaatccaggtggagattcttgttttgttttattttgttgagacagggtctcactctgtcgcccaggctggagtgcaatggcgtgatctcagctcactgcaccccccgcttcctgggttcaagtgattctcctgcctctgcctcctgagtagctgggattacaggtgcctgccaccatgctaggctaattttgtatctttagtagagacgggttttcaccacgttggccaggctggtctcgaactcctgacgtcagatgatccatccacctcggcctcccaaagtgctgggattacaggcgtgagccaccgtgcccggccaagagattcatgtttgtagcaggaggacaaggggcgattccttgtgtcctctgtatgactggttttgtgaagggtagactctgtcctatccagagacctcactcacctccagtccaaagccagaatagctcacccccggccccctgaagctcacaggaattttggggtctgaaaggcaaagctgaggcctgacccttcacatttctccccgccatcctcaccagcatctgccaagcgtggccacgggagcttttcactgtctgcagaggccagccccgcacactggcaggtccttgggcctccaatcccggggtctgtggggcctcatgcgacttcactgctcaggagtcgtgatccctcgagttaggtgattccctccacagaggttagtcctggagcggggacggagggccggcaggccaggccacatgaccctgcagagaggggaacagcacaacaggagcacgctgctgagccaactcccagaaaaggaaaaggacaaagtcctggcctgtagcatgtgccaggttctgtggcgtaaatgctcccaccctggctgatcgcaagctcccagctgatgtcaccgagcgtggggtcaggaagaggtgcccacagtcagctctcaggagccctgacaactggctccagtcaggcaggccacagaagacatgcaaaagtgaagaagggcgggtgcctgcaccagccacctggacaccaacactcaactaggatgtgaggccagatgcccccagctacacagccatggccccaggaggtgccctctgctgagggtcagcatctgagaccccttgggctgttgccgtgtctcacaaaggaaaggcaaggaagccaggcatggtggctcacacctataattccagcatttcaggaggccaaggcgggcggatcacttgaagtcaggagttcgagaccagcctggccaacatggtgaaaccccatctctactaaaaaatacaaaaattagccaggcatggtggtgtgaacctgtagtcccagctacttgggaggctgaggcagaagaatcacttgaacccgaggcagaggttgcagttaagccaagattgcgccacagcactccagcctgggtgacagagcaagactttgtctcaaaaaaaaaaaaaagaaagaacaaaaaagaaaagaaagtcaaggaaatgcgaagaccacacaccagtgcagtgtgatgggcctttctgctgcttcattagtgtgaggatttccagggccacagtgaggaagaatgttaatgccagtgccagagcaaaggagaaagaagttggcaaaactgttgatttgcatgacagctgaaatgtaaatactttttaaaaaatatgtgatgtggaagcttcttaaaaggggatatgtccatttttttctaccttttaaatttctgaggaggccaaggcacttgtttgggctaagtatgtgattgataaagcaccatccctcttcctgttttccccaaaggtaaagatgatgattcttttgatcggaaatcagtgtaccgaggctcgctgacacagagaaaccccaacgcgaggaaaggaatggccagccacaccttcgcggtaaagttttctctcattctctgaggagtttttaaagttcagtgacccgtcagatttatgtattaaaattaagtcttcagagcaaagaaaatggagataaacaaaacaaagattcagacctgagaatcaaagcaaaaagtaaagtaaaatctttgccaacgagggcttgaaaatctaaatactttgaaattagaataatatcttgtgttttagagctttaaattttcaaatatctgctgtccacacaccccattggaggaggacctgtgtcactaacccaaatttgtagctgagaaaacagaggcagagagaggttaagtaaaaaaccccaagagagttcacctaatattgtgaagaaagcaaacccagggtttcactaacttgtccatgtgtgtatgtgtgtggctgcgttcacccctgtgtgtgtgtgtactgtgtgcatgcctgtgtgtttgtgcacacccatgtgtatgtacctgcatacacacccaagtgtgtgtgttaccacaacgaaagcgcagatttattgaaaagaaagtgcactccacagagtgggagcaggctagagccagtggctcaggagcctggttacagcattttctggagtttaagtgccctccagagttttcccattggttacttggttatactctatgcagatgaaggagtggccccaaccaatgtgatcagtcgcaggaggcaaccaatcagaggctgaagggaagttacaaagttacacatgaagacttggccgatgaccagtctggttggttgcgggaggggaccaatccgaggtactttccattttcatctgagatgcagtggaaagggggtatagcaaagggagtagctgctgaaccttttgttcctcaggcatggagaggtggggttttcattttgattcagttctaggaagtcagcacgaattggccttaggttccctgcctccagaccctattctcttgcctcacatgcatgtgtgcacaaacgtgtaatctaaatttgtgtctacagatgtgcacatccatgtacacacctgtgtatttgtatgtgcatgcccatgtgtgtctgtgttacatgcctgtgtatgtgtgtgcttatatgtgcatgtgtgtttgtactttacagaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcacc

SEQ ID NO: 38319 - DNA, 6534 bp, Homo sapiens
ctcttccggacgtgacgcaagggcggggttgccggaagaagtggcgaagttacttttgagggtatttgagtagcggcggtgtgtcaggggctaaagaggaggacgaagaaaagcagagcaagggaacccaggtaggtgcacccgagagtggggagacgcaggaggagccccgaacccggggcttctcggcgctccccgcgtactccgctctgcccccttctctccttccatttcctcccctcggtaattcgcgcctcccgcggctgtttccagggcaacaggagtagttcactccgcgagaggccgtccacgagacccccgcgcgcagccatgagccccgccccccgctgttgcttggagaggggcgggacctggagagaggtgcgagggcggagcatgaatggaggaggcggggcggggcatgatgggaggtgatggggcgggacctgcagcgcggtgcgggggcggggcatgaagggaggaggcggggctgggggcggggcatgatgggaggagatgtggcggggcctggagcgaggttgtgggggtgcagtaggaagggaggaggcggggcgggggcggggcatgatgggaggggatggggacctggagcgaggttgtgggggtgaggcttggagggagggatgcatatggggcggggcaaggtgttgggaggcccatgatgggggctttaggggctgaacctggaaggttgagggcggagcatagtaggaggaggtggggtcagaatgagaaatagggatgcttggggcagaagtgaggtagagtcttaagaagaggaggtggggggaaactacatggcatggaggccgtgaaggcagagcatgattaaaggagaatgggccctacctagaaaaagcaggtggattggacctgagggggcggggcctacagcaggggcggggcttaagaccaagctgaaggctggcgtggaacagaagggggcaggtcttgttagaaggatggggagggtttgtaggctggcaggaaccagggttgtggctgagagtagggtctttggagagatggaaaaaaaagggaaagccctgtcaggacctgtaactgacctaacctaacccttcttagccccacaaggctctcaatcccctgtattctacaggctgctccgtgaccccaccatgtcctctcctaccacgagttccctggatacccccctgcctggtgagtgactctcttccccacccagcccttatcacacacgagcagaagctcactgtacctctcccggattccaccctcttccaggaaatggcccccctcagcctggcgccccttcttcttcacccactgtaaaggaggagggtccggagccgtggcccgggggtccggaccctgatgtcccaggcactgatgaggccagctcagcctgcagcacagactggggtgagacagggccctggagttgatgtgggggcttggggaggggtttaggaagggagaaagaaatagaaatgggaatgggaggccctgatctttgctttttgttcttgctttctccttaacatatacatctttctaaattgcaatttccctgaatgtgagcagcaactcctctctccctccatcctctggctctttgcctggggatctcctgtgggcccatctctctggttcctgtttctccttgtggctttctcatggcctctacctacccaccccagtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgtgagtgcagcgggagggggcggtgccggcctggccccccgcctagccctggggttctgctgaggcctgcatccccctacaggcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacggtactgccccctccacaaccttgagtgtgacggtcccaatggggtagagccagctgggccatcacccagggtgtgggagaatgaggctccagagggcaggggctttgggaagaggatcccccagggtgcaggcttggcctcaaggtggccacccagacttaggctcacaaagacctgggagtgaccctggtctcctgtgtcccagccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgaggtaatggtccatctgcccacaaggaaccccagagatagctccaggacagatgctgggagcagagttaaggaagaccagtgcttgccgttgtaggatgacattccacggcgaatagagtcttctatgagccaaggagagaaaggaaaaagggtctgaggctgagaaaattgaggatcaggctagaggcgctattgcagagaaaagttgccaaaaaggcttttcagaggagttagcatttgaatcaaagtagggataacatataagtattgagcacgtgctgtatgccaggctctattccaagtgttggcatatggggcaaagaacaaagcagatcaaaccccgtgccccaaaccttgtgctcacctggggaaagagtatcctaaggagatggggatgcagcatgtgcggaagcctgaagtggagaaagagctcgggctgtctcacgtgatggctgcacgctggtgtggctgagagaacaggggggaaggggacaagggataatcctggtgagattagacccccatttgggccaggaggggagggactagcagctgaagggtcacagggctcaagctccccctcccgctgccgcccttagatcatgctgctagagacagccaggcgctacaaccacgagacagagtgtatcaccttcttgaaggacttcacctacagcaaggacgacttccaccgtgcaggtagggcccaggggaggcttcggggaggcttggcgcccctgctggctggaagacctggggccaactcatccctgttggagtctctgtttctttatctccaaagttggggtgagggttgagccaaggtgagagtgaggtaagagtgcatgtgccacgtgtggtggtgcacgccaatagtcccagccactcgaggctgaggagggcagattgcttgaggctatagtgagccgtgattgtgcgacggcattccagcctggtgacagagaagaccgtgtctctattttttaaaaaaagcatgtattgagtgccgactctgtacattgggttgcagtggaagttgagatgggaggagccctgttaccacatcaggcatcttggtgggcattaggaaaagcattccccgcccccgccaaaacgtggtctcacccaagggaggcgggctggagctcggtccattgtgaagcgggcagccttctttactgtctaggggagcactgcttcctgccctctgagagcgctaacctgcgtgggtgggcttctggaagaaggcctgggcagtgagaggcactgcctaggaaaagggtgggaggagcattgctagtgctgcagagcatgcaccagggcctcgctccctcattgtcccacaatctctgggggacctctctgtatttcccgacatctgtccaaaccccaccctctccccttcctcttactccggccctttcaccacccgagacggtcccagtaacccttttagtatgagcttagcagggcagggctgcagggaagcgtttctggcagaggagattggcgattgcagaggccctgaggttggggagagctggtggtttggaggaactacagggaggcccaggcagctggagcacaaggagatggggtggagaggaggtcgggaatcccaccctaccccttcccagccgctcctctgccaccaccctggaacactgccagggtccccttgaggggccgcctgcctccacccctgcctgatggggctgctcacagcacaggcagaagggtcctgtcagcacttaaggctgcccacttccctcctccgctcagaaccctccgcggctcccgtctcactgggagaagagctagagtcctctctgtggcccacaaagccctttaggacctggcctcgctcactctctgccctcagctctcaccctctccccctgttccagccactctggcctcttactggcacccatccagcatgctgcagccaagggcctgtgtacttggagtttcctctgcccagaactagggggaccaactggtcctagtttgcccaggaccttcccagttttaacactgaaagtctcatggcctgggtagcccccgtcccaagtcatgggaacagcagacgttggtcaccctcacaatccctcatctccttcggattggtcactgctccagcgtcacccagagcgcagccttccctgcccgccttgtgtaaaatagaaccatggctcagcagggcccttcacacttctctgcactgcctggttccattgaactcacagccctctgacaggctgggcctcttcctaatgtgtttgtctatgaccggtcccctaggctctcaaatgtaagtgctggagcctggcacgtggcaggtactcagtgacatttgatgactgaatgaacaagtcagttttgggaatgagtttgggctttaccttgagcagtggaagccagcgctgggaccagcacgatgtgacctaggttttaaaagcttccctttgcctttgtgaaggggacaagaatagggactcgggaagctgcagccaccgcccaggtgggaagggagggtggtgataggatagtagaaaatactgaagaaacatgcaccctcattcattccttcactgggcagcatgtgtggcacacctactacatgccagcactcatgggcacggggcacaggtggacagaaatgacaagaacgctgtaattactgctgtgttcccagccccagagactgtgggcagcgccagggtccaggatgtggggcacggtttcgggctgagggagtcacgggctgcctcccgccccgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggtagggccccgcagagcctctgcgcagagccaactacgtcccgcggcccacgtggtccgttcaggctgggttctgccagccacactgccctcccctccgcagagtctttcctcaggccccaccctgctcgactgggagccaggtctagtccaagcacagaggcgggccccacgctggctcccacgcctggtcggggaggggccctcctttctgttggggtgggcctcccaaagcctggcagggcaggggctcagccagcgcccacctgcctcctccctcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacag

SEQ ID NO: 38320 - DNA, 2581 bp, Homo sapiens
actgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccgggtgcgcaggcgtggggcctccgggcacggggcgggcccttaacaggcaccgctgcggggactggagtcggcggagaaaaccggggtccccagcgctgggggtgggtgagggtcgctcattttcccgggacggtgacgggtactgggcgtcgccaggccccggccccgctagagccacccttggagcccgcccgcggccggccttgggggcttcggctcaagcgcgtcttcttcgtcgccagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggccttccagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccaggtactgtgctgcccagcacctgagagggagaaggtcgcttcccaaggcctggccaccacctccgtcttcccttccagtcctgacggatgagcagaagtcccgaatccaggccatgaagcccatgaccaaggaggagtgggatgcccggcagagcatcatccgcaaggtggtggaccctgagacggggcgcaccaggtggggagctttcggcctgacttacaccacaggatctgggagtgttggctgaagatgtgtgctctcgggaggagtggggccgggcggggttcctggtgcctgaaaaaggccaaatgtgggcaaaaatacggtcacttggagtaagtagttgcaggggctggaagggcctggaggaggctcttgaaagggctgttgttggccgggctgaggctggcaaggcagagcccagctccactgccttcatcagggagagtgggtgaggccccagggtctgtccactcaaggctgcggggtgggagccctgggacccctctgccggctgcttgtggttctgctcctctggcattaggggacctgcctattccttgctgaacggagaccctcccacccccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttc

SEQ ID NO: 38321 - DNA, 37965 bp, Homo sapiens
cctgttgctgatgctgccgtgcggtacttgtcatggagctggcactgcggcgctctcccgtcccgcggtggttgctgctgctgccgctgctgctgggcctgaacgcaggtaggttcaagcaagaggcgcaccagctgccatgcctcttttttctccaggcgtgagagtttgttactgggtttgtgcttttgaaaacatgtctcttttccccggttcttaccttgtgtaattatattgcttttgaatctcactcttttttttttttttccttaaaaaattcaaagtgctttttttgtccttttctggctctgggtggtctgagtgcttccgttctctcctacgcctagatagaagctgtgtgcagaaatgtatgatttggggaaactgctggtcaatgaggtttccccgattcaaaggccatgattggctgctaaatgaggatataaggtcgttttattttaagctgaaatctgcggtcaaaagtacccttacatcctaccacgaatgggacatttcattgagataaggccctttcttttcttgatcaaaacaaacaagataacatcttcccccacagcgatcttttttggcaaaaaacagatttgtgtttaataggatgacttgcaaattgattttcagcaaaacctctcctagtctgaagcaagcactgagaattggaactggccacaagcttgccttgtgaccttaggcaagttgttgaacagttttgttttccttttctaaaatggggatcatctggcccttaggcgagtgtctgggagattttgtaaaataagtagctctgccaattttaccagtagtcactgccaggcaagggagaagtgcctggggttaggtcaaaaggtacctgcgccttatctgtcattctcaagggagcgcagccttatctgttattgtcaaggacaatataatcgtgtgttacttgtatatagaaccttatagctaagtctgtaatgttttagtcatctgttttgctcctcaggacactttctggttttcttaatcttcattgttgttttgttttgagtcagggtctcactatgttgcccaggctggtctggaactgcctgactcaagtgatcttcctacttcagcatcccaagtagcccggactgcagacacaggccaccaccctggctctttcttatttacaagacgttgtctcattgtcttcctctctactcctgtctctttagctgttgggaccagtgttcttttactgaccaatggggcttgaaatttgagaagggaggaaatagaaggcagaaaactccagtcaccgaggggatcccccccatcatcttttaacaacagcccctctacttttttttttcccagagtggttttggaggaaaaaaaaaaagatgctataacttggaaattgttacgttagcaaaaagtgacaaagaaaatgtatttagcctactcttttctaaaacatattttgtggatgctagaaaagttaagtaaggaaaattggagttaggggattataggatacgtatattaaacacacatacacagatatatatcgttcagtttaaaaaaatcatctacatgagttaggaaaattgccctttttcatatttgttgtagctctttccttgctgtttgcctttttatttttgatttacagaaattttgttgtatagaaatataacaagtttctgttctcacctccatcattgtttcttttgtacagtctctggggtttgcttagattctttcctcatccagacattagaaatatatttaactatatttttgtatttttttaatgtttaaagtttaaaatttaattgcttgatcctcatggaacttatttcgtttatagtgttgagaggacctaaatttctctttttttctccaaaaaaggtaattgttgctccattactgtatattgaatattctcagccccactaatttgtgatgcctcttcactcatgttttttgtttgtttggttggttggttttttgtttttttgagataggatctccctctgtcacctaggctggagtgcactggtgtgatcacagctcactgcagcctcaacctactgggctcaagcgattctcctacctctgtctcctgagtagctgggaccacaggcatatgccacaatgcccagctaatttttgcattttttgtagagatggggtgttgctatgttgcttagactggttttgaactcctatgcacaagctatcagcctgtcttggccttccaaagtgttgggattacaggagtgagccaccaagcctggtgtcttactcatgtattaaatacgatataaaaaccagtatattgcattctgagatttttacttttttactcaaaatataaatctctcttgtttttacagaattataaaagtatttcctgtaatcccagcactttggtaggcctaggcgggcagatcacctgaggtcaggagtgcgagaccagcctgaccaacatggagaaaccccatctctactaaaaatacaaaattagccaggcgtggtggtgcatgcctgtaatcctagctacttggaaggctgaggcaggagaatcgcttgaacccggaaggcagaggttgcggtgagccgagattgcgccattgcattccagcctgggcaacaagagcgagacttcgtatcaaaaaaaaaaaaaaaaaaaaaaaagtgtttcatatttattgttaaaaatccaaacattacagaaaagtgtagaggaaaaagtgaaagcccctggcctcctatgccgctgttaagtttggtttcttttttcatagccgaggttttttccttattcctgcaatgtactggggtggctaaattaccaaactataaaacaaatcatctctagcctagcatggctgtctctaccaggcttggaatttacctgtacattaggcactcttctggagagtgaaattgaacttctgtttcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcaggtaaagtagcttcccagcctggcctgaggtcaaagccaagtctcctctgtgtggctctttgcttgctttttgggctgatgtctcagcagtgaagggcggatttggtccagcagtgtgacctgggggttcggcgtgcttctgaggtaggctgaggcaatggtatagccaaggaggctaaatcagagggcgagggggttctagccttttgccagagtctctttatatttccagacggtcacaagaaggctcactgaaaactcctgatgatacatttgaatacatagtgatagaaagtgttttgaggccgggcacagtggctcatgtctgtaatcccagaactttgggaggccgaggtgggtggatcatacgaggccaggagttcgagaccaggctggccgacatagtgaaacgctgtctctactaaaaatatttaatacaaaaattatccaggcatggtagcacatacctataatcccagctactcagatggttgaggcatgagaattgcttggacccgggaggcggaggtagcagtgagctgagatcgtgccactgcgctccagcctgggcgacagagcaagaccctatctcaaaagaaaaaagaaaagaaagtgttatggaaggttccaaagcaaagacctgaggtagcctgaccctcccttcctctccatacaatcctttcctgaaccctaacttcttacccccagaaaacctgatcttttgaagggactgctacaagccttctgcaccttcgtgtgactgttgcgccttccccctttccctgagtgtgtttgcattttaaccttgagctctgattgtaggatggaaggcagggagctggttgaaagatttgtagggacaggcagaggctcttttctggcatttctgaaatatctgtccagagatggcccacccccacccggaagaccacccaccagggaggaattaaggaacatggtcttgcctctggaaaatgtaggcatggcccagctggaaccctgggcccctcatcagtaaatagggaccctggtgctcacctccataggatgctactgggacgtcttccaacaatgctggtatttataagcagcctcccaccacctgggttttgcctcccaggatggtcgatgcagactttctggtgagatagagcgaaaatgagcagttttcagggaggggcctttctcttttggaattatcacttgtgccacctctgagggctagagctgaggctcagccccaggtgcggttatgataatgcagaaaaagaacccttgtatgtcagcctggggagccctgttcacctccggtggctggagacaaaggtgcggcacaattggcagggagagccaggccgtggacaagctcaggcctgccgtcaggggcctcgggttttcagtgcctacctgccacttagagccatggcaagatacttcctcctctgggccttggctgtctaatctgggagattttggtggttttcaaactttttgttcatcagcagaacttttcttttttttttttacccccaaatgaaagcttacaaaggggagacaaagcagacaaaagcacaagtgctgaggctgaggcttctcctttgaagtttatcaactgaagagaataaattgctcttcacttacccagagacccaagagagaagaagaaagattatgcttacagaagaaataactaatttagatgaaaaggagatctattttagcagcctactgaggacatggtgctgacttctctcgggggaatctttgagaatcgaagtcatgtcttctgagtgggttagcaaactatgttagggacactttcaagtcttcgaagcgtttcacttggtccactgacacactgactgtgtctcagagtttctggatagccctgggccatgctagcaccctatcccaaagttctagacaaaaaagaggttttacaataggatatattcacgtagaacagaggcttcctccatccagcatctcattgccttttgaggagaggggaatgaggagagaggagagggagaggtcatcttctgctgtctccctggcataccagaagcagaggagaactgagatttctcccacaaagacccaacccctaggatttccagcttttctccttttgctttgatcctacctcatcctaataagtccattaggaaaaaggaacccagctttcattggagggtagatccctggctttaatttattgcatattgcattataaatatttttcaatgttgccacatcatttttcgtagttcatgattctaagtggcagtgtagcattccatgcagtagatgtggtatggttgcctaacctgttcccctatttgggggacgtttgagttgcacccttacttctgttatttttaataggactgcggttaacatcttcatctggtttgtgaactttttactgcttaggaaatcttaagatacaaagggcatatgatcagggggatgtatagccttccaattttatcagagttaggttggtccaggttcaaaacattagtgttgtaaagtctttcccttttggggccctcttgccgttgctagttaccctttagccctgactctatcttgtcttttttttttttttctttagatttccctacacaaattgccctggcttttgttttgcccaaggtattccctttcatcttttttttctttttcttttttgagatgaggtctcgctctgtcacccaggctggagtgcagtggcgcagtctcggctcactgaaacctccactttttgggttcaagtgattctcgtgcctcagccccccgagtagctgggactacaggcgcacgcaccacacccggctaatttcctgttcttagtagacgcaaggtttcaccatgttggccagggaggacttgaactcctctcgaactcctgacttcaagtgatctgcctgccttggcctcccaaagtgctgggattacaggcgtgagccaccgcacccggtccccatttcgtcttttcatatctccctttcctacccatcctgctagtgcacagagaggccatatccttttattctaggtcctctgccctttccctcgcctcagctgacagggcccttctcatagactccccacctcaattggcccctggatttgtccagaaaaagcactgaccatcttttcccctgaccacctcccaaagagcctcctcttgtctcaattagaaagcccacccaacctgtcctatttgcctcttagtttcttttttctctgaagccctcagagcccatagaactgcccccaacaccgagctgtggttcagaatcctgcctttccctctcccatggatgctcacagtatcaaactctccctgccctgggactttagaaactgctgcattatatccacagaatctgcttgatcaaactgcttctaagtctgggtcccttatcaatccacagggactctgaagagtctcccatctcctggggagagggtgatggaggaagagtcagaaggcccagtgtctagtccggttagagctccttcaggtcagcaaggcctacggcaggccaaggctccagctcagaaaatcaggaggcagctgggtgtgatggctcacacctgtaatcccagcactttgggaggctgaggcgggaggattgcttgagcccaggagtttgagaccagcctgggcaacatggtgaaacctcacctctacaaaaaatacaaaaattagccgggctgggcatggtggtgtgcgcctatagttccaactacttgagggggctgaggcgggaggatcacttgaaccccagaggtagaagctgtggtgagccgagattgcaccactgcactccaacctgggtgacaaagttagactctgtctgaaaagaaaagaaaagaaaagaaaaaatcaggagtcaggaacattccattgtggacctcttagctcagctctgctcctttcagagaaaaacctcagcagttactaggggagctttgctaatgtggaagtccctggttcactagagaaattgtgtcttttgtgcaaattgacccagccatcactaactcataaaccatctatagcaaatgtggtcattcattgtaaagactaagatctgactaaaatttttgtttgtttcttctctcttccatagggcggtccaggcggttctagcactggatttggaaactttgaggaaattgggccccttgacagtgatctcaaaccacggaaaaccacctgggtacagtgaggacagtcctgagctaaaccttgccccgtggcctctcagaggccctgcccaactctgggaggggccacaaatgtagcaatccctcgctgtccttttccttttcctgtgactactgaggccatgggcacttgtccgcaggcttcctctctggcctagcttctctcccatttctcaggacagcttatcttgcaccagtctgcctcgccttctccaaaacaacccctctctccagctgccttcaaaaacctactacagcagacacctgggaccctgtgttatgcacgctggccatctccgcggcctcagacaccatggttgcaccctccagccacagcccccagtccttttctctctctcctatcctcctacttgtatcttgacttcccctttcaatgtctctcttgctgcccttctcacacctccccctcattcttatcgtctcttccttccctcacccctctgtggtcaactcccatatccttctccctttacagccttgccaaacccagccttgggtcactcccactgtccacctgcttagcccttacgcccaggctgcccatgggcagaactgcacacccaccctggggctgctgcacagcgtgggccccactcagggcttgtggctgttcctctctctgtgctcccactctcccggctgcacctattgctatgaatgttctccactttcctcagtgctcctcctccagcctccctctcgcattagaagctaagctttctgctctttttttttttttttggaaatggaatgtccctccgtcaccaaggctagagtgcagtggcacgatctcagctcactgcaacctctgcctcctggattcaagcgattctcctgcctcagcctcccgagtagctgggattataggcatgcgccagcacgcccggctaatttttgtatttttaggagagacggggttttaccatgctggtcaggctggtcttaaactcttgacctcgtgatccacctgcctcagcttcccaaagtgctgggattacaggtgtgagccactgtgcccggccactttctggtctttctttgtttttttttttctgtttttttgtttttgagacagagtctcgctctttcgcccaggccagagtgcagtggcgctatctcggctcgctgcaagctccgcctcccgggttcacaccattctcctgcctcagcctcctgagtagctgggactacaggcgcccgccactgcgcctggctaattttttgtatttttagtagaggtgggatttcaccatgttagccaggatggtctcgatctcctgacctcgtgatcctcccacctcagcctcccaaagtgctgggattacaggcgtgagccaccgtgcgcggcctctggtctttcttaagtgcttcctactcttgcctcagggtctttgtacatgctgtcctcttggcctgggcctttcctgtgcttggttccaacagaagtctcacttccaggagtggttgtagagtcatcccctacctccactccccacccccattgtccccaagcctcctagaactaaaagggccatatgagtgaggaccatggtcccagtcctgatgctgccactgcctgtccgatcttgtgaccttaggcacattctgggctctttctgggctttaatttcctcatcagcaagggacatggctggactgtgtcattattcaggatcttttatatgtaaattttataactttcaacctctttggaaaaggtattagaataaattctgctcttgcagtgtacagagaagccaggacaatgtggaaatttgatgcatttccaagaaaactgatgtgtgtccagactttgagtgtcctctggcttcttcgagttagtgcatagactgtctctgcatgcttctttctgcgctagtttattacatttagtacatttgtattgtatgaaaagcaacagcccagattatttgatccccgtgtgtgttaatctttccttcctgcctctccctttttttttttttgcggcggcgggggcggttggcctttctttgtttttgtttttttttctatgttcctgtcccttatttttaaaaatctcttttagcaacagggatatcatcaccacgctggtatcctcacatgtgtgggttttgctgagctagtagaaaatgatccaaagatgattggtgaccaaatgtctgattgcaacatttcgttttcctccgtggtacatagctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccaggtaagcaaagactcaggaacagctaagtaaagggctggcaatatcaactctacatccatcagcataaacctgaactgcctccagagtttaatgcctagctgatttcagagaaaactttttaattcccaagattgggttgtggacttttgtttctgtcatctctaaagttgatatttaacttgaaagaatgaccttggagtgagcattctaatcagacgcaataatcagatatggagtggtgggggaggaagacaaagcagatttgttttttctggtcattacgtgcaatagaaatttgaaattaatttgtgtgactcaaaaagcaatcaaggtagttaattctgtgtaattccttttcttgctagacagttccattctacattttctcagagtcctatggaggaaaaatggcagctggcattggtctagagctttataaggtaatggaaaataactttgttgttatggttttggacagaaaatcaattatgttacttttatgtactcacgtgctattaaatatactttgaatagggccatgtacatgcagagtacgattaaatctgtagtaataaccataaaaagtttttaaaagaagaatgaagattgccctgctagatctggaacaagatataaagcatgagtgagtaaaagaatgtggtactaacatagcaatagacaaataggttaattgcaacaggatacagaatccagaaacacacacacatatatatgtatgtgtatcatatatttgtattttatataaatatatatgatcatatataaatataagataacgtttcaaatcattggggcatggatataatgtcgataaatgttatggagacaaatacctatcactttggaaaatagaaaacttgtattcctgccttgtataaaatattaattctggatggattaaaatctaaacataaaaataaaaataatggagacaaatacctatcactttggaaaatagaaaacttgtattcttgccttgtataaaatattaattctggatggattaaaatctaaacataaaaataaaaattaggacagaatgcagtggcccacgcctataatcccagcactttgggaagcccaggcaggaggactgcttgtgaccaggagttccagaccagcctgggcaacatagcgacaccctgtttctacaaaaaaaaaaaaaataataagctgggcacagtggctcctggctgtaatcccagctacctgggaggatgaggtgggaggatcgcttgagctcaaggagttgaagctgcagtgagctgtgatcatggcactgcactccagcctgggtgacagaacaagactgtgtctcaggaaaaaaatgaaaacaaaaaccaaaaccaatgtcctagtagaaaaatgtggacaagcaatttgtagaagaaatataaacagcctttagacataagaaaaatcttcagcttttattagtaagccaagtccatgagatttgtaaatatttaaaagactgataacacccagttttggtaagaagtcagggaaataagtgctgtcgtgcacttttgatgggaatacaaattaatttaaatttaaaaggacaatttgacaatgtcaattttttaaagatatgtgtcatttcacccaataattttgtcctatgggaatacttatacatatgtatatgtcagagaatgtttattatgccattgtttataatgtttataaactgaaaacagctggttggctgtcagtagaggattgcttaaataaagtaggtatatctttccaagatgaaaccctttgcagccagcataaagaatggatccaggcgggcgcggtggctcatgcctgtaatcccagcactttgggaggccgaggccggcagatcgcttgaggttaggagttggagagcagcctagccaacatggtgaaaccccatctctactaaaaatacaaaaattagctgggcatggtagtgcacgcctgtaatcccagctactagggaggctgaggcaggagaactgcttgaacccagggagcagaggttgcagtgagctgagattgcgcctctagtctgggtgacagagcgagactctttctcaaaaaaaaaaagaatggatcttagcactttgggaggctgaggtaggaggattgcttgagatcaggagttagagaccagcctggacaacatagtgagacccctgtctctacaagaaagaaaaaagaaagaatacagagagctatatatactgagtgtggaaagttctcctttgggtatttagttgtggaacgatatgagataactttgtttgtaagtcaaaaacacttccatatgtggagatagatttgtatgctgtgacggcaaacaaaagggttagaaggatacatgacacacttaactgcagtcagttggtgagtgtgagggcacaaatgagacaaagtaaaagactttcacatttccttctatctcctatgtttgaatatcagtgagcttaaataagggttttttttaagatttattaatttaaaaaacttatagaaacagcatatgtacattatagaatattggaaactgtaacaagcataaattaaaaatgaaaacttcaccttcccacctgatggagatcactatagttagcatctgggtatatagctttctaaatatttttgtgcacatttatatagaattgtttagctgaatgagatcatattatacatactggtttcagcctgctttcttcaatcagtagttctcaactttctatttctgtaaattttcatctcaaatattcagactttttctttttgagacaggatcttgctgtgttgcccagactagaggctggagtacagtagcatgatcatggctcactccagcctctgcctcctgggctcaagtatcctcctgcctcagcctcccgagtaactgggactacagacgagcactaccgtgcctggctaatttttgtatttttttgtagagatggggttttgccatgctgcccaggctagcctcgacctcctggggtcaagtgatcctctgacctcagcatcctgggtatctgggactataaggcacataccaccatgtcccactgattttttaactttttgtagagatgggggtctcactacattgcctaggctggtcttgtattcctaggctcaagcgatcctcctgcctaagcttcccaaagtgttgggattactgcgtgagccactgcacctggcctgaggacgtttcttgtttcctctttcaggccattcagcgagggaccatcaagtgcaactttgcgggggttgccttgggtgattcctggatctcccctgttggtaagtgtggcattttcaggcattttttcactccccttttgcccatcctttcctgggactttgggctgtgttgtccagatcaaagagctaagcaggagaatgttctgggcccttagagaaagtgtttgctacatccaagaaatatagagacagagtgcctaccatggaccactaagggctgaactgagttttcttaatttaattatcacaacaaaaggatcaaattttacaattggaggcattctgaagactcagagaggtcaagaaatgtgctatctgccacgtaggatgagtggcctagtcaggattcaaatccaggtctgtgctgctcagtacaaaggcaaatctgttttgtcatcctgccccctctacttccctgatgctgacataagtgtttggggtaaaattcccgtctgttacgcatattgatggcaagacaaggttatcgtctggtcttgcaactcagaagtgtgcagttttgtaattgagcatccgtgttgcgagcataaataagagttgtttatgttgcagacacccagggtgtggccccagacatctgaaacaatcatcctggtggcgttcactctaacacagggtttctcagcactgttgacattgtgggtcatatagttctttttgtgggaggctgtcctgtgcattgtaggatattatcagcagcatccttggcctctactcaggagatgctagtagcaccgctccagtgtgacaaccagaaatgtctccctggggaacaaaaccatccctgattgagaaccattgttctaacctaacaaaacgtgatttccccaggcaaaaccaaactatcgagttagaaatcagaagagaggctgcctaggggcaaaggagggaaataagcaggaaaggtacatgagggaaatatatcttgattgcagggggtggttacacgggcatatgcattcatcaaaactcttctgaaggtacacttgtgatttgtgattatggctcagttttttaaaaataatcatttataaaaggtaatatttacccctaaaagatagggatttgcttgttacagagccatattcccaataaccattacgacttggaatagtatttcttgccctcatgtttgccatctgcagggtaggactgaagtagcataaaactgagtcagcatgaagaggagggctgctattcgtttatctgtctttccttcctggatggatctcgtaggacatcataaaactgcagaagcttagagaagcatgagagtttcttgtcagatactgctcttttgttcatgttgatggcaagacaaagtctccatcaggtcttgcaacccagaggtgtgctgtttcataactgagcatcctcactgggaacacagataagagttgtttatgactcaaaattatgatgctggccctctcacttcctcatggggtctcctcagtttcacagtagcactaagtactttacatgtgctaacttcatgtaatccttacaacaactccatgggatggatgctatcattatcctaattttgtaaatgatgaaactgagacttagagaggttaagcaactttcttagagtcacctagctaaatggtagaactgggattcaaatccaggcagcaggtactggaatccaagcaacctaaccaccttgctacattgtctctccaagatcagtacgtttcgcttcctggctttgcaagtgttattcattgtgtttggaatctacctttttctccttgccgtgacccactttaccttatgaatctgtttgtctggatcgtaatccatccttccagatccactttaagtattgcccctctatcccagaaacattggtttttgagggagaagtattgttaatttccatgaacaattgttaattgcttgctaggtagtagatactgttctaggtgctaggaaaagatacacagataagctcctgatcttcaagaaggtcttgatctgcactgtcactaagcccatgtgaccatgtcagtatggtaaccacttgccacatgtgactatataaatttaattataatttttaaatacaatttcattttttcaggggcactctctacacccaagtgctccatagacacatgtggctattagctagcattttggactgcacagatacagaacacttccattactgtagaaagttctattgaacaatgcaggcctacttcaaagattggtaaacaagggcccatgagtcaagtctgccctgccgcctgctctggtaaataagtttttgttgtttgtttgtttttgtttgtttgttttgagatggagttttgctcttgttgcccagactggagtgcagtggcacgatctcggctcactgcaacctccgcctcccaggtttaagcaattctcctgtctcagcctcctgaatagctgggattacaggtgcccaccactacgcctggctaatgtttttggtatttttagtagagatggggtttcaccatgttggccaggctggtctccaactcctgacctcaggtgatctgcccacctcggcctcccaaagtgctgggattacaggcgtgagccaccgcacccagccggtaaaagttaatttactgtctatggctgtttggaggctgtaagaacagagtggagtagttcaaccgagataggctggcctaccaggccaaaattatttactatctgtccctttacagaaagtttaccagtctctggcccagatcaaacaggaagtgggatgcattggagaactgcagccaatcctgtgttttaagaaactaagaaacaagtttgaaggttaagcccgggaggtgattaacagctaggccacggaagtcctggtgtgcttgcatttctcagagagtactctaaaagaataccagtccaggccaggtgtagtggctcacatctgtaatcctagcactttgggagaccaaagcgagcagattgcttgagcccaaaagttcgagaccagactgggcaacatggacttagttcctgcagaactaagactacttgaaacctactttgagacactttgccttaaggagccattgaatacttttaagctaaggagagacatactcaaatgtgctttataagttgaggtccttgattctttgttggcgtgtctttcaatagcacttgtcttacctagtgatacagtatttaatagttgtgagcttgtctaaaccaaggtcaactactattctctttgaggacaggcattatgttactcacatttatatcttaagcttttgctgcctctagacccttagtaaattctcaatatgtttgtgggatgggaataagccaattggcaatatagccatttgcactgttgcaaactcattagtcatcttccttatttagctccttggcagaagctaatatctccaaactggaggagcaaataagatgtagagcagaaatgtgagggtggggaaatattttaagctgtcaaaaggcctagaggtccacagataagagcctccacctgcatacctacagcctgcctgtggggatgctgtcatcggcaatgactcacttgctggaccagtatcaggccaaattaatgtgccattagtcttaagagtcaacagaaaggcccccacacccttatcccaccttccagacactgagacatcagcccgcctcctgcatgggtacaggtgaattgaggagccttccaatccaaagccaccgggtttcttgcttctgtctctttcttctttagagagaagacagtaggtttgtctttggaaagacagaggtatgacatacttgatttgtacatatgtgatttcctttagattcggtgctctcctggggaccttacctgtacagcatggtaagtagatacacatctgcaccctctgggcaaacagcccagcagatctcttctggctgtgaccccaggaaaagagatgctggatgagtttgcctatgtggttgacactgctttttagggactagtcatccacatagagttggagacccaaagcaagagctcgcctcagggacaaattgaaagaaaatcagcacacatcacttttttccagatataagaaacacatttttccaatgccctaaatttttattacaaaaattttcaaatatgcagaaatgttgaaagatcacggtgaatacctacttaggttcagttaacaatttgctgtgtttcatccaataaacatgtggcttgtaacaatacactttgatatgtgagctcccgttctccttccttcccctctttctcctacccctccctaactgcagcaataccagattgacgttcccaagtaaagtgggtctttttgctcttggtttgcattccagtctcttctcgaagacaaaggtctggcagaggtgtctaaggttgcagagcaagtactgaatgccgtaaataaggggctctacagagaggccacagagctgtgggggaaagcagaaatgatcattgaacaggtaaaaaggggaaacactcagaggcgagcctgcttggctttttctggtgggtacagggcccatggttggtgttgtcaaacttggagtctacactgaggctccccacatatctgcaaatgattgcatgctggataataaatctcttgggtctaagcagtgatgtagtggctccttacagagtcagaaagccacccaggcctgcaagacttgcttgtccttcactaaatgtatggattctattaaaaaaaaaaaaaaaaaagactgtcttgcagaggtgagtgtgtggagaaaacacattcccttattgggacccttgccaagcaacattctgactccagagagccagaaggaaagaatgcgtaggctaaggacttgggagtgtaggcccctctgcagctctgttctccctgtaaattaacacctaggcccttggttttttccctgcagggcctgatcactgctcatatgagatgctcaccactccagggagagtgggctgacacagctggtttctgagacttcagagctgcatttctttctttattttattttttactttttcttttttcctctatttatttatttatttatttatttttgagacactcgcccaggctggagtgcaatggcacagtcttggctcactgcaacctctgcctcctgggctcaagtgattcccctgcctcagcctcccgagtagctgagataattggcacgcaccaccgcacccagctaatttttgtatttttagtagagaaggggtttcaccgtgttgcccaggctggtcttgaactcctgaccttaggtgatccacccacctcagcctcccaaagtgctgggattataggcgtgagccaccgcgcctggcctctttttcctttctttcttttttatttttttttgagactaagtctggctctgtcacccacactgtagtgcagtggcccgatctcggctcactgcaacctctgcctcctgggttcaagtgattctcatgcctcagcctccagagtagttgggactacaggtgagcaccaccacgcccggctgatttttgtgttttcagtagagaggggtttcaccatgttgaccaggccggtctcgaactcctgggctcaagtgatccacccacctcagcctcccgaagtgctgggattacagacatgagccaccaggcccagccaaagctctatttctttctgatccaagcagatatacaaaattaaacctgtccttggataagataaagagccatgtgtccttctgtttggcagctttgatgataggaaaatgaaacaaacagccaaataaacttttatatttcagaacacagatggggtgaacttctataacatcttaactaaaagcactcccacgtctacaatggagtcgagtctagaattcacacagagccacctaggtgagtgaaccttgaagttattaaagtccctgcctcagcctccatgcaaaaagaaacctgtttattaaaaaaaaaaaaaactttattaacatataatttgcataccataaaattaactcactgtaagtggttttcagtatattcccagagttgtgcagtcatcactacaatccagttatggagcatttctgtcaccccaaggagatcccacgtgtctgcttgcagacagttctcattcccactcccagccacaggcaaccactcatctgccttctgtctctctagattttccttttctgaacattttatataaatacaatcgcacaatagttagtcttttgcactggcttctgtcacatagcatgatgtttttgaagtttagaaaccagcttccatacaccaaattacaacatcagttcaagactgaatttagtcatctttcagccaaccaagaagcatataaaggctgcaggataccctaggttccactttctagatgattctctttggccgttctggagaatcccaatggcccccaagtctatagaatgtataatcaatactattaggttggtgcaaaagtaactgtggtttttgacaggtttcaagaattattaactcacaactaatgaagcattatttcccttcccacccagttccctaccaaccccttattttgaaccaattttgacaaatctattttttccctttttttttttaagagataaggtttcactctgttgcccaggccagagtgccattgaatttgagaaattctgccattacttttaatggcaaaaaccgcagttacttgtgcaccaacctaataataaagcctctccactttcaatgtgtttctgacttccttcctcccgctgggggtgaatcaaggtgacgcttttccttttccagctgaatctgaaaccctccctcttgctgtgcagcatccccagcagcttggtaaagatgtcctcatggccaggcgtggtggctcacacctgtaatcccaccacttgggaggctgaggcgggtggatcatgaggacaagagatcgagaccatcctggccaacatggtgaaaccctgtctctactaaaaatacaaaaatgagctgggcatggtggcgggtgcctgtagttccagctactcgggaggctgaggcaggaaaatcgcttgaacccaggaggcggaggtttcagtgagccgagatcgtgccactgcactccagcctggagacagagagagattctgtctcaaaaaaaaaaaaaaaagatgtcctcttggccttacttccagccctttgactcactatctaccagtttggttttagtttgtctttgtcagcgccacgtgagacacctacaacgagatgccttaagccagctcatgaatggccccatcagaaagaagctcaaaattattcctgaggatcaatcctggggaggtacttatatgacctaattaagtgccgtttgtacagttatggggagaaaagaggtgcaaattcagagacctgaatttgtagggtgggttttgttgttggtgatgataggttataggtaaacaatattactatccacgttttgtaggtgagcaaatagatacagagacagtaaatgacttgtcagggctggatgcagtggctcacgcctataatcccaccactgtgggagactgagttgagaggattgcttgaggccacaattaagcaacatagtaaagccccatctctttaaaaaaatagaaaaattagctgggcatggtggcatgtggcatatagttctaactacttgggaggctgaggtgggaggattgcttgaacccaggagtttgagggtacagtgagctatgattatgccactgctctccagcctgggcagcagagagaaaccctgtttcttaaaaaggggaaaaaaaagacatcaaaattgattcaaaataaggagttggtagggagctgagtggggagggaaataatgtgtaattggttgtgagttaataattgttgaagcctggtatgggtacatcggagcattgtatgcttctcctttctatccatttgaaattttccataataaaaaattaagataaaaaagctacatcgaaggccacagttggttgcagatgagatttcgcgccaaaggtccttgcaggatgtcagagacacccaggtgctcgggcagattttgaccagctctctcttgctgacctccccaggcatcctgatgctggatatggccaggcattactgcgttctggtctcaaggccatggtgaggaaataatgaaatccttagagaccagggccaggtagaaatcttggttaagttcctactttagtcctatagggaggccttgagcaagcagagatctcaggtttctgaagggaaaatactccaaacctaagagggttttgtttcatgtgtgttcaagataccccaaggatatggggtcagtggtcctgcggctgctgctgggagcctacgatttgctgctgctgggagctttctcaggggacatgggccctcctctcccaacctgcagtcaccagaggtctcattccatccctggttttttcattactcctgagtgctgggagaattttagaaatgaagaaaaattagctcaaatgaaaagagctgggtgtggccgggtgtggtggctcacgcctgtaatcccagcattttgggatgccaaggtgggcggatcacctgaggtcgggagttcgagaccagcctgaccaacatggagaaaccctgtctctactaaaaatacaaaattagctgggtgaggtggcacatgcctgtaatcccagctacttgggaggctgaggtgggggaatcgcttgaacccgagaggcagagattgcggtgagccaagattgtgccattgcactccagcctgggcaataagagtgaaactctgtctaaaaaaaaaaaaaaaaaaaagagctgggcgtggtggtgtgcatctgtagtctcagctacttgggaggctgaggtgggaggatcgcttaagcctgggaggtagaggctgcagtgagctgagattgtgcccccgctctccagcctgggtgacagggtgagactctgtctcaaataagtaaataaataaataaaaattaaatttttttaaaagaagacttcttatctcccaaggtaatgaagaagaaaatgggatgttgcttgtcagatgcctccttggcagtgactagcaaataatggtggctgccactcttattgctgtcattcagtgttaggataatgctgatgggcaggagctagcaagagtactagctcctctcttgcctggggcttgttattcatttggctttcctgagggccagctctgaattggtttaggtttgatctggtttattataaggtaggcctacctgttcagaacttgaaacttggccctggtgttactcaaaaaaacaggaaaactgacattggcccaaagcacaatttattccctgagtgtaccagcctaatgagtatttcctgggcctctccctccctgtttccttggacagtagcctattccaggtgtcaattcctcattaaaaatggtgcctgctgtcatcacaagctctcaagagaatggaccacatgtgctatttatgtgtgccttacacctgaccagtcggcacaaatttctgggctggttcatccctgtttgtgaagcatctgtgcattcagtcgttgttcggtgctggagcccaagatgctctgggctgaaaggtacctcctgttttggcagattccaagctactccctctttctccttccccatgtgcaggccaggctaccaacgtctttgtgaacatggaggaggacttcatgaagccagtcattagcattgtggacgagttgctggaggcagggatcaacgtgacggtgtataatggacagctggatctcatcgtagataccatgggtaggaattgactctgagaggcacctagaggcagttttatgggttcaactggaagggaactggccttggacatgtcagtcttgcggtgggtgatgttgaaatgccaggtggaaggccatttcccattacatccgtctaccccgaccttgattattcaaagggtggggagctgcacgtggctgtgacccctcagaagcctgagcctacctgggtttgggggcccttaggtatgattaaagaaaagaacaccacctgtctctaccacaaaacttagacattttcctggttattgggcaaatgcgctgtttaattaagggagagcctcatttttgtgcgacatcacagtcgatgttgaccactgcagagtgaattaaaactaaaccctaatgactgtaaccctgaagacccaggggaaatggtctttgtggaatcctgactcctgccctatcacctaccacctgtttaatttgctcacttccaaattaaatagggcctggtggaggctcagagacaggttctctgaactggcagggtaattgaggcacaaggtctgacggatgtgacacgcctcgtgaaccagaaggattgaatatttttgtgatgggtaaacaagagacaccaaggacaatttggaaagctgctgcatttctcgatgaacatcccaggtgatccttatcactatctcgttcacgacatctctcagtcctcctcacaggcctgtctgcctccagaggtccccagttcccttcctaaagagcagatggcggtgagagatgcagaggcaaaatcagtcaggctttgcagctgttaggtttctcccagcagcctaggtttcactgggagtcagaaatgcagatgctcaggccctaccctgatcttctgaatcagaatttgcattttaacaagatcctgagtgagtttcatgcatattgcagtttgggaagcaccaacttttaggacctagacttttttcctattctatccagctgttaatgccaggcctttctctttgtccttctcaccaggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggtaagaaagagcttttgttccagacttaaaaatcatcctgagagggaagccacaggcggttattatgcctctgtccactgcccaggtgggtcttgtaggaagtacgagggcccgagggccaggtacagtggctcatgcctgtaatctcagcactttgggagaccaaggcaggtggattgctggagcccaggagtttgagaccagcctgggccacatggagaaaccttgtctctacaaaaaatatgaaaattaggccaggcacagaggctcatgcctgcaatcccagcactttgggaggctgagacgggtggatcgcttgagctcaagagttcaagaccagccttcgcaacgtggcgaaaccctgtctctacaaaaatttaccaggtgtggtagcacatgtctgtaatcccagctacttgggaggctgaagcacgagaatcacttgaacccgggaggtggaggctgcagtgagccgagatagcaccactgcactccagcctgggcaacagagtgagactctgtctcaaaaaagaacaaaaatcaaccgggcacggtggcgcatgcctgtggtctcagctgctcaggaggctgagtgaggtgggcagattgattgagcctgaaagttagaagctatagtgagccaagatcatgccactgcactccagcctgggtgacagagcgagaccctgtctcaaaaaaaaaaaaaaaaagaaaaattaaaaaagaaatacttagggcttgggagtgttttgagtttcctaacaaaattccgctattagcactagagactgcgagcacaagggtgagtggtgcccagtccctgtcctcaaggagcttgtggtctagagacagacaggcaaggagactgtcaacagctggcttggcccagggaagggtgccctgcccaggcatgcagatctggaagattgtgccccacgtgatgcgtaggagtgatttaaggaaagaggaggaggtggggagcatggagagcagtgaatacaaggtccacaggagcctcagacagcgaggacttggaatggacactggagggaggtggctgcagagggggaattttcataccactctaaggagttcagacagtagggcaccaagcaggggttttaagcaaaggagtgaaattaacagatttgtccaagaaataccattctagcagtagagggcatggggcaagcctggggccaaagaccaatcaatgaggctgtcaggtaaatccagaaaggaggaaagtagatggatttggtgaagtgtaaagaagggaaaattggcaggacttggtaatcatttggggtagaaaagaactgaagggtggcttgcaggtttctgctccagcattgtggtttgcgatggagggaatttgcacaagctgagtttgaattgcctatagaacagaaggcagaagaagagcctacaaatgagactgagaaaggagcagccagataagtgagaagggagaccagggatgcgtggcatccccaaagcagggaggggcccgcagtgctaagtgagaactcaggggaagggctgaaacgtgagtgatgatgtgcttacaccgatgtccttggcacctgcgttggtgagatattttggtgaggtggcaagctcagaagccagattggaaagactggagaaaatgaatgagtagtgaggagaagagacagtagcttcctttaagaagccagagaaagcagcccactctcaaaagacacttaatctaggctgggtatggtggctgacacctgtaatcccagcattttgggaggcgaaggcaggtggatcacctgaggtcaggagtatgagaccagcttggctaacatggagaaaccctatctttactaaaaatacaaaaattagctgggcatgatggtgggcacctgtaatcccagctactcaggaggctgaggcaggagaatcgcttgaacctgggaggcagaggttgcagtgagccaagatagtgccattgcatccagctggcgagatagcgccactgcactccagcctgggcaacagagtgagactctgtctcaaaaaagaacaaaaatcaactgggcgcggtggcgcctgcctgtggtctcagctgctctggaggctgagtgaggtgggaggattgattgagcctgaaagcttgggtgacagagtgagactctgtctcaaaaagtaaatcaataaataaacaaatagacttaatctaaagggagaacaaacaaggcagcagggcacagagggagagggcattatttatggctctcaggatctgagtaccttcaatattgactaaaagaaagaaaattagaacgtcttagagcaagcactgttacaggttgagtaccccttatctgagatgtttggaaccagaaatgtttcagatttttaattttttttttattttggaatatttgcatatccataatgagatatcttggggatgggacccaagtctaggcaatggaattcatttatgtttcatatacaccttatacacatagaccgaaggtactttcgtacaatattttaaataattttgtgcatgaagcaaagtttgtgtgcactgagttattagagagcaaagggtggctatttcagccacccatggctcttcaaccaatctgtggttgttaggcatcatatcatttctgactccaaatttatatgctgccgataagcaatctttttcttgcatgtagtcacacataagtacttcacagtaagaaatacaacataccattaatacagtggaaaagttgtgtgttcagagtaactgagcagcacagtagcatgaccagaatacctgtgtcagctgctagacaacagcaacagcaagcaacagcagctttcggtctctacctacaatgctgtgttttgattaaaaggttactgtactgtaacccccttggggatgcagaaataaactgtgtgttgtgcgcctgcattttgaatgcagccgcccatggggcaggtgtgaaatgttccacttgtggcctcatggtggcactcaaaaaggctggaattgtggagcattttggattttccaatgagggatgctcagcctgccctagagagaagtccctgacgaggctggtaggaaggcatggaacaagccaaccacgcgctctgtatactagagttcaggcccatttcctgttggtttgtcacatatagaacaacagatcagttggggacaggcttaaaatagcccttggagactgttgttaagtcgtccccaaaccacttcccctttcattgattaaatgacattttaggataacccaccttgcctgtgcctcctggggactcttggcagaagagtcaaggatgggtgtgccatagagaatcatggagccagggaattacataacggggagaccatatactccaaccccttctgtgtagggagaaactgaggcctctgcccttcccccttttgatgctgtgtgggaaggaaattttaaaggacttattctaaaaatctgagggaaaacaaaagaaagttgaataactgcgaaaatcggatgccacccaaagggccctgtttgtttttattatttgcggctctctgctgtgagctcccttctcagccatttctctattctcaatccgggatcccttctagacagatgcctttaaaatgtttagaatcttccttcttccttgaacaggctaggtctagtatcattagcatgacccttaccaagaaatcaacagatcagctccaaatggagtagaaggttcttgtcttaaatgctgacttctccaggtccctgccacccagcccagtcagggcccagaagagctttcatccagtgcaggagtcattttcaggaaggaccctctctcagggatgtgcccaggtgtctgcacaggttgctgtcacagagctggctcccttttgggagcaaggtttcaggatgttgcctctgaccccagccccaggaatagcaccaggagcactaactcagatgttgtttttttctaggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaatggctgtggagcattctactttatggttgtactctagtttatttacaaaattcccagttgtttccgacaagtataataatttctagtttgttgctattatacatagtgctctgttgattcaccctgatagttagatttttttgtacctccttattttcttagaataaattcataaaagtgtaattatttagtcagaggattgccacatttccttaaaatcaaaataattagctcaggacttttaactttttattcatagctcaagatctacataaggaggtttgatgccgtggctcacacctataaacccagcactttgggaggtcgaggcaggaggaatgcttgagcccaggagttcaacaacagcctgggcaacatagggagaccccatttctacaaaaaaaataaaaacattagccgagcatggtggcacacacctgtagtcccagctactcaggaggctgaggcaggaggatcacttgagccagggaggttgatgttgcagtgagccatgatcaagccactcactccagcctgggtgacagagaccccatctcaaaaagaaaaaaaaatctgcataggggatctaacagcttctaggactgtctgaaagaaatatcacctcttgtagttgcagggctgagattttatttatttatttattgagactctgtgacccaggctagagtgcagtggcacaatcatgcctcaaatgatcctcctgccccagcctcccaagtagctagtaccacaggcaagcaccatcacatccagctaatttttaaaattttttcgtagagttggagtctcactatgtggcccaggctggtctcgaactcccaggctctagcaatccacctgccttgggctcccaaagtgctgggattacaggcatgagtcaccaagcctggccaaaggctgagatttaaaaaaacagccaggcacggtggctccagcctgtaatcccagcacttcgggaggccaaggcgggcagatcacgaggtcaggagatcgagaccatcctggctaacacggtgaaaccccatctctacacacacacacacacaaaattagccaggcgtggtggcgggcacctgtagtcccagctagttgggaggctgaggcaggagaatggcgtgaacccgggaggcagtgcttgcagtgagccgagatcgcgccactgcactccagcctgggcaacagagcaagactctgtcccaaaaataaataaataaattaattaattaaaaaaaataacaaacccaaagcttattcctgcagactgtgaggaaacagttaacagcaggttatgtctacgtgactaaccccttcagaccctgagactaaaaacaggctcctgggacagagactacacatgtccctatggttcactgttggcaagaactccagtgtgcccatggaaagcaagaaccttagaagcctgtgctggatacccctggacatcacccatgtgtatcgtttttacctgccgcttttgatatgcatcttttgttacaaaaatgttagctattagtataacctgctactgagccttgtgagtcttggtgaaccatccaacaaagcagtgaatcataaagcaagttgaattcccaacctcacagagtctcttctgttaaaagttagtgcattgattgagaagaaatgtaattctgaacattgagatgagtcacctgcacagatgaagctaggggacctcaaacctttttggccattagaagccgcccttccattgctgtccgggcaggttaatcatgtcttgtcctaagatcttgtagtaaattcctagacttgcccagggctcttattcctgctgtataacattctctctcaacccacacccctaccttcctagggaatccctgtgatcagttgacaaaggaagacaactctcaggcttgatttacagacggggctccacagtatgcatgcatcacctgaatgtggaccgctatggcaccacggccacactccaggacagccctgaaagatggtgtgaagagaaatcctcccagtggacagaacttggaacagtgcactcagctcttcactttccctggaaggggaaatgaacagaagaataagtgcaccaattcatgatttagctgggtatttagggacttggaagaaacttgattagaaggctgggcacagtggttcatgcctataataccagcactttgagaggctgaggtgggagaatcccttgagtccaggagttcaagaccagcttgagcaagatgataacaccctgtatctacagaaaataaaaacattaactcagcatgttggtgcacctctgtggtttcagctgtgtaggaggctgaggtaggagaatcacttgagcctggcaggttggttgaggctacagcgagccatatttgtactccagcctgagtgacagggtgagaccttgtctcaaaaagaaaaaaaacttgattagaaaattgatgacaagaagctctgaggaagaggtatgagattagatctctgaatggccgagtatgaagatcattgttttccatctgaatactcaactagggcaagggaagattttaataatcaggtgggtagatgacccattctgtggctattagcctccttcagccattcctgtagactcatgaacaaagtggccatggcggcggggatggaggctatgcatgggcttggcaacatgtgcttccacttactaagggtgacctggtcacagccactgctgagtgccccatctgccagcagaagaaacaacactgagcccctaatgtggcatcactgctgaagagatcagccggctacctggtgttaggctgattacattggaccacttttattatgaggcaggcagcactgtgttttcaatggaattaacccttgctctggacatagatgtgccttcctttcccacaatgcttctgccaaaactagcatctgtggacctacggagtgtctcatccatgactatggtattcacagcaaatgaaaggcagcagtgaatttacacaagtggaattgactgctctcaccatgttccccatcctcttgaagcaactgccctgacagatggttgaatgactgaaaattcagttacagggccagctaggaggggatagattgcagggctggggtgctgccctccagtatgtggtacatgctctaaatcaaccgccttgtttctcccatacccaggattcatgagtccagttatcaagggataaaaatgaaagcgactcctctcactgttaaccctagtgatccagtggtagaatttttgcttcccatccctgcaactttaggttttgctggtctagaggtcttagttacaacgggagaaatgttttctctaggagacacagcagataatccgtggaactggagcttgaagccaccatctggcctctttgggcactgcatcaacaggcaaagtgctgtctgcagtgattgatctgactatcaagaggaaatggggttgctcctacacaatggacgtaagaaggaagaatgcaggagatcctttggggcaccccctagtactgccatatcctgtgattaaggtcaatggagagctacaacaacccaattaagaccgctaatggcccagacccttcacaaaagatttaagtcattccatcaggcaaaaagccacgaccaactgaagtgcttgccgagggcaaaagatacgcagaataaatcatagatgagggcagtcataagtactatgaccttgtgacccactgtagaaacgaggactgtaataattatgagtatttctttcttcttttgatgtgaatctattttaataaatattaacaaaaaaacttttttttttgagacagggttatgctctgtcaaccaggctgaagtgcagtggcacaatcacagctcactgcagccttcaccccccacctccctgggctcaagtgatcctcccacctcagcgcccccagtagctgggactgcaggcatgcaccaccatacccagctaatttctgtattttttgtagagatgaagttttaccatgttgcccaggctagtctgaaactcctgggctcaagtgatctgcccgcctctgcctcccaaaatgctctgcctcccaaaatgctgggattacaggcataagccacagctgcatctggtgaaccaaatatttttgtttttatctctcattcctttatcgtctctgatgtgctaatagtatttaaccttttttgtttttcttttttaagacagggtcttgctctgtcaccgaggctgcagtgcagtggtgcaatcacggctcactgcagcctcaatctcctgggctcaaacgatcctcccaggtagctgtgactgcaggtgcataccattgtgcctggctttttttttttttttttttttttgagacagggtgttgctatgttacccaggctggtcttcaactcctggcttaaagcaatcctcgcagcttggcctcccaaaatgcttgtacctaactttacatataaatatttatattacaagatgtcaaggaaggaatgtgaaacagctagtaaaagaatgagcatcatccaaagacaaaaagtggactctgattctcttctggggaaaaagatgtgtatttctgggtataggaaggacagttgtgtcatggtaagcagagtatgactttgttattgactttatttggagattaagtgtggtttaaggcaatgttatgggtgccaagttgacaaggggtggactgtagtgtttttgtaatgtttcaacttgcctaggctaactttttcagaattacctttcttgtatgtttctgattagggtggcccacaagagaaattcttcggaaaatgtggagggtgaagtgaagcagcaacagtttttcattcatgcatgttatcgtttttctgctggctcagctcagctgagctcagctgctcccccttcccccggatcctcctagagcatgtctgcttcccgggccaggtgagtgtgcttagcactaagagggacccaagaactgacatgcgtttcagtcccatggactccatctcttgcttgtgggattcacattgttcttgtccttctccactttacattccttgttccttcctgactgcttgccctgtgtacttcaatctccagcatcagatttggagacaaaagccttatgaagacttcttaaccagctccacactgcataagtcaaatccctgttacaccttcccccatacgcacggctgtgcacatgcaaacacgcacacaccgttctgcttctgaaattgaatccttttttatttttgagatagagtcactcaggctttagggcagtggtgcgatcacagccgcctcgaacttctgggctcaagccatcctcctgcctcggcctcccaagtagctgggactatcggtgcgtgctaccactcccagctaattcttttatttatttatatatttatatatttatttatttacttattttgagacagagtctcgctctgtcaccaggctggagtgcagtggcatgatctcggttcactgctacctctgcctcctggattcaagtgattctcctgcctcagccccccgagtagctgggattacagacgcgtgctatgatgcccagctaatttttgtatttttagtacagatgagttttcgccatgttggccaggctggtctccaactcctggccttgtgtgacccgcccgtcttagcctcccaaagtgttgggattataggcatgagccactgcacccggccaccagctaattcttttttaagttttatttttgtagagacagggtctggctatgttggcctggctagtctcaaactcctgccctcaagcaatccttccacctcagcctcccaaagtactgggattacaggcagggaccactgtgctcagctgctgattgaatcctgattgatacaaaactttattattttaatggcttcaaaattctccacaattggaatctgcatatctgatgtctttccgttgcctatacttgtgagcaacaattgatcagatactctcaaatcacatcgttcttagtgttgccacctaatgttgctgagaaatttgaaaccaattcacttctttttcatctttgtaaataatgagtttattttattttattttttattatttatttatttatttattttgagacagggtctcactctggttgcccaggctggagtgcagtggcgtgatattggctcactgcctcccccatctcctgggctcaggtgattctcccacctcagcctctaaagcagctgagactgcagaggcctgctgccaagcccggcaacttttgtttgtatttttagtagagactaggttttaccatgttaccccaggctgatctcgaactcctggactcaagctattcgccctccttgggctcccaaagtgcggggattacagatgtgagccaccacacctagccaaccagtttaataaatggttgctgtaaatttttttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtcttgatctcctgacctcgtgatccgcccgcctcggcctcccaaagtgctgggattacaggcgtgagccaccgcgcccggccaaatatttttgttaaattatgtaaaccgggaacgtctgatggttacattgatgtttagcttttaatgaattttgcctgatgtgtcgtgagcttttagatccccaggctctgatcttcagttcagcaatgctttccagtatttatttgaatattgttttaagatattttcccactttgttgtcctttagctttcattctagatactttttctccagactcccgtcaacatcattacttcattttcggtaatgtcactctagactttgagtttcttttttttccttttcctttttttttttttttgagacggaatctccgtctgtcaccaaggctggagtgcagtggcatgattccagctcactgcaacctccgcctcctgggttcaagcaattctcttgcctcagcctcctgagtagctgggactacaggcgcccaccaccacgcccggctgatttttgtatttttagtaaagatggggtttcaccatgttggccaggatggtcttgatctcttgacctcgtgatctgcctgcctcggcctcccagagtgctgggattacaggcatgagtcactgcgcccggctagactttgagtttctaaaggattcttaacttctataattatctttctccttaatttattttccctagttatgccagctgctgtttcaccttatcttttcatctcattttacatttcttatttcacaggctcccggtttgctttaatttccttgagagcgagaaaagtatttgtagtttcccagtgcaaagcttccaagggatgttcctcatttatcttttgtgctttgtgttaatttcctccattttagttgcaggtgttttttccctatgtttatgtgtttgcttttttatgtgtctgtatctttgaatgagggcagttatataatcatctaattgattatctggttatttttcagattgtccacttaattcttattcaggaagcctagatgtggcggagctatatggtcctcacagttcttcagttgcctaagggcggtgaatgcccagctcttggataataattattgggaacttatttcctgtgtcccttaggacttagggagtgtttccttcctaatgacatgagtgctcagaatttgttgtgttcccagcttcaggatgaacccaaaactttggtaagatgcaaagtccatgataaatccagggactccttatttgatgaatatattagttatctattactgtataaaaaattacgcagaaggccaggcatgctggctcatgcctgtaattctagcactttgggaagccaaggtggaagggttgcttgaagccaggagttcaaaacaagcctggttaatatagcgaggccctgtccctattaatttttaaaaaattaaaataaataaaatacccagaaacttggtggcttaaaacaacatttattatctgacggtttctgtatgtgaggagtccacctgtggcttagctgggtcctctactttaggacctctacaagactgcaatcaagggttggccagggcagcagtcatctcaaggcccaactagggtagaatgtggttccaagttcagccatgaggttattggcacgattcgcttcctcataggctgttgggctgaaggactcccttaattacttgtcatgtggacccttccatgggcagctcacaatatggcagctggcttcatcagatagacacagagaaagaaagagtgagagagccagagagagagagcatgggcaaatgtgcaagacaaaggtcacgatctttttttttttttttgagacggagtcttgctctgtcccctaggctggagtgcagtggtgcgatctcggctcactgcaagctccacctcctgggttcacgccattctcctgccttagcctccccagtagctgggactacaggcacccgccaccacacctggctaattttttgtatttttagtagagacggggtttcaccatgttagccaggatggtctcaatctcctgacctcgtgatctgcccgcctcggcttcccaaagtgttgggattacaggcatgagccaccgtgcctggcctaggtcatgatcttttataatgaaatctcagaagtgacatcttattacttttgcctcttctttagaagcaagtctttagggaggacttagaaacaagaaaaggggaagaaatcttttctctcccagctcctcaaccctcaacactgaatgttccatgtgcctggctttctggaaacctcctgccccttctacctagctgctttctgatttctcttcagctctcagaataaatatgaatctctcaagaagccctctctgatcccccaagctaaggtagaaccctgttttgctcactctctaagcactctacctgtactttgtaatcctcagtcttcttaagacagagtagaaacagggctcggtttcagctcacctgctctagagcattctttcatgcatccccactgatcccaaaacccacaccactacctcactcctcttttacttaaagaattccagcatggttc

SEQ ID NO: 38322 - DNA, 62934 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccaggtacctcccgccgctccggtgcccctcgcccgcaggggtgaggccgaggaggcccctccagccccggagtggaggccgcgcccccggccgggcagccgcgggagtgcgcccggccccctcgcggcgcctcccaccgggttctctcgggctgaggagggggcgggccgggccctgagtcctgagccggggcagagctgtggaacaggggagagagccccgcggccggagtcttgatgtcgtgacccccctgcaagctcagctgcaactgagtctgcgagatctaaactttgattccatgtagtagctgagtgcctcaggaaaaccaccttattgtgccttagttttgtcgtctgtaaaataggaataataattgtgcctgcttcatagggttgttaggagaagtcaatgagaaatacctgtaaagttgtcagcagacaatgtccggtacagataatgagtcagtcttattactgctactcctaatgatgtgatgagacttgtgccagccagaatgagaggcagagggcctggatctcttttccggcggtaccaggcctccttttggcaccgttttcccattagtgaagagaaaaatacagtacctgccccatttgtcgcacaagggaacttcattagcacactcgagatgagagtcaagtcctttgagctctgcagatgaaaactggtgtgtaaatatagcaaatgagtgcaggatgacattagttcataattcagcacatctttccccaggggtcttttgttctcctttgtttaacatttctccagcttcgtacctacactcctggttcagcatcccgggtttatttaaataagtgcctttatttcctagtgtctcaactcttgaaaacttagaataagattaacctattttcgtttcacactttcccctctcttttggggttccttccctttttcttctaagtgaataatacttcccaggatgatccttgtatggatttacctacatcgacagttcagaataagtccgaagggctgtatgcataggtgtcttttgttcattttttgtgatcctcctagtgtagataagtaaggaactggaagcaagctgtgtgtgtgttttttgtttgtttgttttgttttttggtaagtttgcatcctctggacgactttttcaaggcctcccttttttatatggctgtagactcctggcattttaatcagactaaagcccttggtagaaggcattttgtccatgttcatatctgttgtgtggaatctgaagatagcaatgtgagattttaaatgatcactttgaacaaggatctctgtttgccttgcacttatggaaactgaggtgcacagaaatatcctgcttttctaacctacatggtgatgcctaagccaggttacagtgattatactaactgattcttgatgttgtcctcacaaacagatcatattcttaatttccagctctaacataaaggaatatacactgtttgtgagtggcttaaaggatttgcccagctgtgaggaagtagacaggactgtagagcaagtcaggagacctgggttctaattctggctctcacgctcacttaggatgtgatgtgggtgagtctcttcatctccaccctgtagctggctcagtttcctaatctacagaacatctacagaatgagagacagggagggagcaggtgatcttcaaggtgctttagagttaacattgtcatatctacatggtgtataactttgaacttgtatgtggcagaggaggtttagagatattatcattcttatttaatatgttccttttaatataggaagtttatttgtcattgcttttgagacttggccatcacccttaagagggctcttgatggtgctgttgtgcagaatggaagctgactttaagaaggtctttaatgatcatcagagcatatttatatactactctcttgtatgtgacctgtgcctaatgtagctttactcccaaggtgactcctagacttggaactggaaggaatctaatccatccccttcattttatgtgcaaagcataaaaacaatagcaaatgcctgtttcatggattttatgtgccagggactcttctaaatgctttacatatattaactcactcaatcctcccaatagtcttgaagtacattctctatttaaataactaaggagcagagaagtaatttgcttagaattatacaccataaagtgacagagccaggactggaacccaggcaacttgcctgtactagggatatggttcaagttagcccagctatctagcaccgggcttttctgtcatcagtgacctaaaatgtttcactaaaaggaaaagatcctaataaaccatctattgtgtgtttcttctagttttatgaagagtaattttgagagttgcttcagtaatgtgattgcacaggatgaattaaatgaacaccaaagcttttgtaattgaactgagtgacccaggaagagctgaatagcagttaactgaccttagacacatctattcatggactcctttttagtttgcagtgctgcacgatgcattgtaaaactagtctgtgtgcatacacatgcgttatttctgcttacctctcatatgtgggaagctgaacattttagggattaagaaatctgcctccattgttgtttagaagcctctgctccttgcctggcactactggctgttgggaatgtgaagataaataagagtgactacccttgactggttcacagtttgttccagagacagataatgaggcaacagttccagtacagtgtgaatcctgctgcgataggaacacaaatgcagctttgagctcctgcagcttgtacttcttcaggggcttattctcttgtcctgtaagtagtacacttttgaggtaaggtgaagacaacagcactgttgcttgctcggtttgtgttttgtttgtttcttttgcgattggcataacggaacaaagaaataaaagatgtagttctgaggttatgcagttgagtggcccggctgggagcagccctctccaaccaaatcaggcctttctttcctcaaacaagataatctcaaaacataacctggtggttttatatgtcttcactgtggagatgttttgtgctgttcctctttttgtttataacctatttttcctttcaatagacttggttctttttttttttttttttttttttgagacagggtctcgctttgttgcccagactggggtgcagtggcatgaacacggctcactgcagcctcagcctcctgggctcaagcgatcctcccacctcagccttctgagtagctaggactacaggcatgcatcaccacgcatggctaattttttaatttttgtagagacagagtcttgctgtgttgcccagggtggtcttgaactcctgggctcaaccaatcttcctgtcttggcctcccaaagtcttggttcttttcactaggacattctcttcctccaccaaattatggagataagaactttgtttataaccttaaaattttctcagtagtcagtggtgttaacattgggccactacacaattacacacactattcttgagaatgtctaggagtgttttattaggtaatacccagtttctttaaggtaaaggagtgatagggagctgaggctgtgtgcatagggtgcttggatttgtttctctggccgagcatacccttaaaagtgtcgggcagtagaaaatggatggaattccactcctgaatctgctactgttacttttggcaagttactcaatctctctgaggttgtgtttggaggtatgtaaaataaaaataaaaatagctatttagttgagttgttaggaagaacaagtaacatatgtaaagtgtctccatgctggcatgccatagtaaccccataaatgattgctgttgttatctttgtaagtgagatataccagtgtctttctgaccgtgtctttctgaccgtgggattttgagctactggtgtgcctttgctttattcttggtctcattccttctttatgtctcagaatatctctgttgttccaaaccaaagtttgagcagacacagtatagtaaatgaggatagccagtgtccaaggtagctggttatattttttccagaggtgatcactgccaagttaaattaaaaagggaagaccagagtttccctgtcagttctaatgggcatcacagttgcatttccacgatataaggaaaaaggacacttgtgatgtagttctctggcaggtattgtgggcgggaacatggtagtagcatccagctccagtctgcccctgtcctgcctccagtcagggctgtacgctgtggaccaaagatcatgctcgctgatgagagccaccctgctggtgacctcagtgctgccgacccatttacatcccagccctgccacattcctacagtgggaggttgaacacatttcttaaccttgatgagcctcagtttcatcatcagtaaaatgaagttaatggaaccatggaatctaccttggagagttgctagaagaattaaatgaagtcacatatgtttagtgcccagcacagcgtccagcacataggtggtacagagtaagtggtaattttagttttctttctaccctctttgtggaggacattcatgcaaaccctctctttccctttttacctcttttcttccagtctgtttttatcccttagagtattaaatgcaataaacaggatttggctaaatggacatagtagtatttttgaaaaaactagccacaatccagttatatcacttctcattctcctgaatcagtgtgtttaacctactggttgacatccattagtagattatgaaatccagtgggtcacaaccacaatttttgtttataaatggaatagactaaaataggaaaaagccacaatgtgtatgcatattatcgataaatattgtttgggaaaacctttgttcaggtcctgatgtatttcatactgtgattatgaatttttgaaagttcagagagctcttctaacacaaattatacactgtacaaattctgtgttgtttttctttcactgagagcttttttaaacatgatgttacaatttccttattcattattgcacagtggctcttctatggataagcattggtactgaagacagtacattagtcctggtgtttttagcccggaagactgggcaaagcgggataagcatgcattgctgtgaagcgcatcagagttttggagcagagtctgggtagagcatgtgtggtgggaggtaatgatcccaatgcataggttcttattctagttttttgagggtgctttggggtcagttactgttcctttacctgaaataagttagaaaaagaaaaggaggaattgcaatttatttgcagggaaataatgagccttagtgagttgtatttggtaaagtgctttgatatcacctcaaaggcattcctgaaattattcttcattctatgcctaatgggttatattttgaagttgtgatccaattattgctaacatagtactttaaattcccactgtgctgggcacattaacgaaaatcccttgagtagatctgcctctgtgcaccttaattcttgttcgtacaccatccagtatgtaaatatttctctagtgctttttgtgttctgagcaccgtggatgaaaatgataggaaatgcctttcagcttatgactttgctcagctgctctctgagcactgaggagtttgtcttcctaaaaacggtaaactagcattcttattaagttgctatttgagttttatgtccagagctgctgctggtgggcccaggggttgtgaaatttcttggccgtgagtttgaaaatggttgaataaaatataattaaaaacaagcaggccaggtgcggtggctcacacctgtaatcctagcattttgggaggccatggtgggtggatcacctgaggtcaagagtttgagaccagcctagccaacatggtgaaaccctgtctctactaaaaatacaaaaaattagccaggtgtggtggtgggtgcctgtaatcccagctactcaggaggctgaggcaagagaatcccttgagcccgggaagcagaggttgcagtgagccgagatcgcaccattgcactccagcctgggcaacaagagcgaaactccatctcaaaaaaagaaagaaagaaagaaaaagaaacaaggaaatcgtagtaccataagaggaaagaatgacacactcctacactcctgcaagacatccaagattacaaaaaaccagactgctggttcctgctgggatgatcacactacagctgtgctagatgaccacaccccaggtacacagataggcctgacctgtgtttatcttatggacttgagaggagaggctgcccttttaaacactttttttattggatagactttactggtgcttaggtaggggctaaagtcagaacagataatagcccttcagtcataatcttttaaaaactggcttttctggctccaattctgaaattgccctgacactgtagtctaaaggattagaaagcgagctctaaaccagagctccaggaatcaaatggtactggtactatcaataaaagaagccagggaaccaacaggtacctttctttcctcgcattctggtttctgcatgtgcgggtgtgtggatcttcctcctcctctgtaacttttccacttagaaatgaaattgaccttttttcttcttttcttccagactcgctctttactgagcgtgtttgaagaagatgctggcaccctcacagactataccaaccagctgctccaggcaatgcagcgcgtctatggagcccaggtatgctgccacccctcacctggataccgcagagtgggcattctctcccctcatcctgaacttccctcagaggttgagaaattggaatccgaaaaacatcatttaagattttgaaacaaaatcagaactgttttctcactacttttcacctcaaaaacctaaggacagtctgttctcattgcttaagagtgatttgtctttaattagaaccattagagatgggccacataactgctcctaatttttttttttaaattcaacccagtgggaaacatttgagtctcctcttcctacttgtgaataagtgggtccagtattttgacacatactctttgtctttttcataaatgggcagagtcttagatgtcagtgtgggagggcagagatgttttttcaactgcttcctctgaaaagacttgagtcacagttctgaaactatcgggtggcttctttgtttgtggaacaaatatctctggcttgcaaaagcatgcaaaagaaattgctgagtagcaaaagtgaatctttttaatgtcaagaagtgcccatgtatgttgctttctaagagaagatttatgagttacttaaaaataaaatgctttatgttacaaagcattgaacacatcacaatattatggtaactgatcattttcattgttgattccttgctgacttaaatcttatgtgttgatatttttctcattaataatctcttaaggaatatagattgggcatcccaaatttgaaaatccaaaatccgaaatgctccaaaatctgtaactttttgagtgctgacacgacacataaacgaaatgctcattggagcattttggagttttggatttgggaagctcgactgatacagcaaatacttcaaaatctgaaaaaatcctaaatccttctggtcccaagcatttcagatgcagggtacttaacctataccacattcagtagtatatagctcttactaatatatatagtcatttcttattacataggttcaccactctattactgctcattgttttattagtcatttcccatcatatgggaataagactcagtccttgccgttggggagctgacagttgggttgggaggcagacaaagcaatcaccagagagccttagaggggccaggagaggagagccacctaacctagtggggttgtgctgggcacgcaaaaggagggtgattgtaagagttgagatttattgaatacttaatagcatccaggaacttccaggggcttttatgttgattattttatttaaattcccctaacaactctgaggtgggtattgttattgttattatgcctatggtattggttgggagacttaaggattctgatggtgagaaacttgtccaggtgcacccatttaattcatggcagagcaaatcagctggagccaagctgagactcttcactcctaagcataggggaggtggcagtagaagtggaaagaagcagctgtacttgagaggtatttaggaggtggattggtgattgattgggtatgaaggggtcaggtggtaaaggatgaatcaagaatgatgttcaggtattcatctggaacggcagggtggatacatgggagaacacaggaagaggcgcagggtgcgtatgagtgtgtgtgcgtgcctgtgagtgcatatctgtcatggggatgcccaactgtaattctctctggaaacactgattttgaggagttcatgggacatcaaagtggataaagagatcttgttgaaagttcagatccagagtacagggctggagatatagataggcaaactatgcagtaaggtataagtgtaacttattaattagaactagctttgggctggcctgtaatcccagcacttgggagaccaagacgggaggattgcttgaggccaggagtttgagaccagcctagtcaatatagtgaggacctgtatctacacaaaatttttgtaaatattaaaaaaaggactagagtcttttttttttatttttaattttcagagacagggtcttactctgtcacccaggatggagtacagtggcatgattatacctcactgtagcctctaactccacggctcaagtaatcctcctgcctcagcctcctaagtagctaggactacaggtgcacaccaccacacccagctaattttttttctttttgatttttggtagagataaggtcctactatgttgcccaggctggtctgaaactcctggcctcaagtgatctgtcttagccttctgagtagctagaactagttttaatgaccaaaagaattatgtgttcacctgtgattttatgtgttttgttaagacattcagaatttagagaaatgagaacttcgtcaatttttgtttttgtatttttccctaaatattctagatttaagaaaacaggaatgttcttactgggcttatacctgaaattgcttgctattcagcaatttgtatttcgtcactaagtgatttgtctcttatttaaggcttaaaaacccaagacgtgagagactgtgtctctgtcactctgaggagtctctgttctgcctttcggtgtctgtcagaatcatctacttggggttatccaaacgctgtctcatgcatttttttctgttgaggcagaaaacgacattttgccaaaattaagtgggtctttccttcctagaggctgtaacccagcttttaatgcgcagcatatgatcatcacgtgggttctcctgctggccagaaacccttcctcctgcctcagcgtttcctgcagcacaggctggtgagaatgtctggttagtgctgccagattcaaagacagagtcaagcagtgatcagctgtgttcagattggctgggccaaggacacttggtttttcaggtttctttgaaagcttaggtgtttcgttttgtttttaattgaagaaagaaatcttttctgattcctgttttgatctgtttgttttcatatatatattttaagatagtatatttctcagtgttttcattcaagttttttcccctaaagttatgttttcttggtttcattgcacgttattccataaatattttatacctaggcatgttgaatttgattgatagttttataatttcctttgtaaaaacagactctccgcaagatacagtttttcattatcatattttcaaaagcaggcttacgctgctgataaatgataagtgttcataaaagatattttaatcagactacacggtatatttctggatgctgatattgcgaatgcccttcagagaccttagttttagaaagaggaagaacaagaaaaactagaggaaaacttctatgagcagttttgctgattgtggctagtttggggaaattttaaattttgtttgtcttaacctctagaatgaaactataggctctaagctgttttcagcatcttacagtagtccctggagtcacgtctggcaatagtccattgtgggtcctttgaatgaaagtagtagtgtacctttccagtgcattaacagagaagagcctggttacttagaacagtctatttttcaaactattggctaaataagttaaaaacttcagttatgtctaaatagatgcatatgcatatatattcagttaattctcaaattttgcattcaacacatttaatatttattttcattctgcatctcggccataatattcttctttcctaaagaggtttaaaattttctaatcttttaaaatggatttgttaggggcttacagtgaaatttatttaggtcatcttgcttctcctctcagctgttgtactgagaaagtggggccaggggtaataatgttcctggcaggcaggacaggaaggctatccccagcggtattcacgaaacctggcaacccttgtaacctggcattctcttccaccagatgacaaacctctgtagttgctaccttcagtttgtatgagattttttggttttgtttttgcttttttttttttaagtaaatttgggatggaatttttttgaaatgagaaccgtgattaagactctcactttccttcagcaaagcaggtttaatttaacagttacatgtctgcagtcgttcttaaccaaagctttcagaatacagaactactgatcctgaaagttgatcttaaaactcctgatcctagaagcccgaattggaggtggaagtagtattttctcaaattggggtaaagacagtgggagggaataggagtaaagtatgcataatttggtatataaagaaaaaagtacttttctttagaatgatgatatagatagcaagctaaacaagtgaatgtaccgagtgggaaaccagatgacagtagtgagcatccaggagtgtgagtttgtcatgggggagggagaagcacctaggaggcagatcagggtcacagctgcatgttttaagagtgaaaatagtggcctttcttaggcacataaaagtgccacgcactaggctggccactcagctttcacaacagaggggaggtatttgtatagtatgtgcttacagatgaggaagctaagactcagagaagttaagtagcttgcctaaggtcacacagctgatgagtggcagaattttaaacccagatctttgactgcaaagcctgcgttcgctcttaaccactatgcttgctctcctgacacgctagccaccattaatggcagcagaggccaaagaagtgtaagcttttagaggctcctcttgtcatcatggaagaaccacccttgtttatcagcccacagctttgtaatacgctagaggcaggacccagttcctttttgtatcccagaataactttcttggtttcattagtttttatccataaatgttctaatcagtgtgttttagcagccctgaaaaccagtcacattgaggcttatctgacagggactgagaggaggtgcatatgtagcttaaggtcggagggagcagagggcgtgaatggctcttggtaatgacttcttagacctgggttctgcacttggtctgcagctttccctcatgctggcattggtagctttcagatagcaatctaaaagctgttgattgcttttagattattctgggtgaggctcactcactcaggtacaggagttaagtgtgtgaccttggacttcacagatctgagttccagtcttggctcagccgcttgctgtgtaaccttgggcaggtcgagccatcatcagttgattgcctgagtttccttatcagctaaacaaaggccataagaatacccacctcagagggttcttgtgagttaatcatgttaatacctgtaaaatgctaagatcagtctctgctcacagagtgctctcagtgtgaacagaaccgtcttctgttttatgataataatagttgcaatagcactgtacactggcactgctatttgggttaaatagaagtttagtcctctcatcctttcttgaaggaacagcagtatgtgccatctttggctcctcgccaaacatctgatatttgttcctcaagccacctcagtctggtcttggcctccactttgcatgggaggctgcttagtgcctggctcacagcctctctccactctgcccatgggcaacatctgattctgttaataacacccccctcgaaactgtcttccattggctcctctgacaggctgtctcctggccccctcctgggctctgccccttgttcttggtggttccctgaagtcttggggtcctgcagaattcctttggaatccttctctggcgagtctgtgttcactccctgggcaagatcactttagcaactacctggccatttctgaatccttttctggcccttgccactttccagactctgggtctttattcgaaacaacgtttgcctgttgttactgtgcagagttagctttagctcttccctgggcgattgcagttcctgtcgtcaggaagacgtcttccccttttcattcttcctccacaccgcagctggattacttaaaaccttcccgtcacctcctcatcttcagacgcctccgtggctctctgtaaccacaaggaaaaggcataaagtcctcagcaaggcatgctaaatccttcatgagctgcatctcagcctgctcctcttgtcttgttgctggctgtcccagaacatgccagaccttttgcacaccctccactcttgctctgccactcctgctgcctgtttctttattaacctgttgccctggcagatgtctttcctggcctctgagactgaccgcaagcctgacaaagtttctctgacaccttttcttccttcctcctctcccttcctggccgaagtgccattgcccttcgccagtgtgcccaaatgccttgtacacttgttggtcagagcacttaagacataatgacggggtttccttgtcccttcatggactctcagctcccagagctcagagttagatgttgccagtgccctacaccatgtctggccccattcagtgtttggtaggtagcagtctggccccataggtgttgaatgaaggactgaatttgggacagctccacctaaaagcaaggacatctcaacggcacactttgttgtcatttccaaattcatatcccctcctcagttccttggctgaaggcaccgttctccatctggccttccacatgggcagcacagttctttctgactcccccgccttcctcactcaccacaccctgctgtttctgcctcaggaatacctccatgccccgctctgcactgtctgcctcaggctcagacacttgtttatctcagcttctccaagtggcctcctgatcagtccccctcatctattctctctcccacttcagtgttttcttcccaccaccaccactcctggttttcttccacccgtgcctgagcttctcatactcctgcctgagttccttggtgcttccccactgccgctggaataaagtccaggtccagcaggcatccccccgtggcctgcctcgcatgagacgctccagccgcgttcttgccacacccctcactactccctgtgtgcatcctgtctcgaggggctcctgaactagtgcgacccgtgaccgccagctttgtgataaacactgggtactgaatgtgactaggcaacatctccagccaaatagttggtatagatcgatgtggatttcctccaccccactctctagcctctccattcatattcaccgtggatgctgctgcgcacagaggcccttgggggtttcaggtgacagttgcatttagttagcgttctgtgctacagaaagataaacattcctttgccaaatgcccagttttcctttcaggcttgctagccacttgattttctgccttggcaacagccccgggaggttctgttgagcatgggagatgctgtcagcaaaccctcctcagggtgtcctttcagggcttctcacaaagcggtgcatagtgtagatggcagccagagcggcccagagtgcccaaaacaatgctgctcatggaactccattgagaattcccactttagcccacgtcttttgctcttctaccactagaaaagtgtgggacttaggttcatatctatgggccctacaggtcctgcccacctgagtattgagtaggtgcaattttggactttagattggaatagcataatagtcagaacatgagcttttgatttcgagtcctgcattaagttgttgcctgccagtcactagtcatgtggctttagaaagttatttatcctttctgaagcttagtctccacgtttacaaaatggaaataataatagtatctacttcatgggtgcactgtgaggattaaatgtgataatatatgaaaaacatttaacagcaacatcaagcacttagggcagactcagggttagcagctatctttattgatgttattgctaatatttactcctcactcgggctccagttttgcaagtcctgttgtagagatatttttgcaggcctacctcacagggcacagggcgtggattaattagctgatgttggtaaagcatttcttacaacctttgtgtacagtagcttaagtatgagtaagattaaagttgatctcttttgaaagacttttcacacaatgtgctctgttcagggcaggtgacaggctgtgttgtaagcatgttggtttccgatgaactcatactggctgcacagaatcatagttggtcttgcaccctgaaatattacacataggaaaacacgcagcattttcaaatggtattcctaggagagacccagagagtctggttgttcgaagtcgttttggaaggcagctgttgtgtgttgcacgctgtgccccttcttccctgagcggaggtggagctgtgtggctgtgtgagtggcacatgagtgctctccccttgagctttgggtacagcctgatgctggcagttccctggcaggtctttccattacattcggagcatttgccagtaagctctgaggaagaacttgagtggcccatggtccctgcttgtttggaaggcctggagggtggttatatgtgttgaccagtctctgaaggaggcatatatggggaagtaacatattagagttgactaaaataaagaaaagaatgaattagaagagtagaagctcctgggatctgaaatggtgtagcttaagagagcctcctgcagagggtgtggcaaaagaatgggtctttgagacatctgatgacaaagcaggatcagtaatccatggctcttgggccagcatcttatttttgtaaataaagttatatcagaatgaagccacatttacttgtttatatgttatttctggcttcttttgtgctacaaagcagagttgaatagttgtggcaaagaccatatatggcccacaagcctaaaatatttactctctggctccttacagaaaaagtttgcccaccctagtgtaaagcagaggccttctcctctcctgccttgtggtagaacttgggatctcagtagcatttaggagtgtggattttagaatcggacagctccaggttcacatcccagccctgccactcatcagccgtgtatccttgcacaggtggcttaatctctcagtgcttcagtttcttcatctataaaatagagttattaattagaacctgcttttacagggtcattggaattagatgaggtcgtgcacagaatgcatttagcatagggtctggcatgaatgaagccctctgtaaatgttagctgctgttacaatgattctgtgggtctgcaaatcatgttccacatggtgctgccctcaggaacatgccaagatagcttgaatgaatccatctgctgctaactcagaaagaaggagcacgagattttcagtcatagctgagtatcagcccagtgagtgagataagacctttgtttccatgcactctgatcttcaaaacaacactgctaaagatggttgacaggtagtagtctctggccaattgctttgtattttatttcatttgtgatgtttccttgtacagttaggaaggattttaaaacccttacaccatgatttcaggtattgttttaaacttggaatttagatgaatcttctaatcttgttcattcattcattcatcaaacatttgttgagggcttgctgtgtgctaagaattgttggacgttcctatctgaatgaaggacattgtgcttgtggctttgtccacttgctgacttcctgactatgtggctagaagtcacatttctggttagttttgaaaggggttgaataccagtaggatgtcagagccaggcacttttgttgtatttgtctgactttcttctgaggaaaaagagccacgtttcctggtctattaatgcctattccttagggcagagcaggaagtcagggaacaggttggccagttgtctgcgaagagggtcaaaaaaaggtaggacttggctctactgtattctgccaaataggactgggaaaaataaaataagctcctgcagagctcaggacttagccttaaaggaacaacaaccccaggagaaatagccagtggaggccaaggccaaggaggtaggccagtgtcctcccatcatctgtgccatgtcagacccagtggctctgctccttaggaataaaccctgaatcttaagctttaactgagctttagaaatgtaaggcaagttttctaggctgcccacatcagtggtaggaggatagtggtagaaaaccgctgtgtagccagagattagaggaataaacaagaggagaggaaaatgagcagtacgggctggtgaaaatggcacaaaacaggcctcccagggcatcgcagctcttgaagagcagtgtttcctctggttttctgggatacttgggtttagctgtgcttctgttaccatccatcattgccagcgagtgttctaagcctggtggaatctgaccttgtcatatgctgcttcagtccccactgtgcttccagtatgtgtgagcctgggccccgggggcctgcacaccttcccactgcctcattcccagcctgatatcacctccaagcgcacagctcttgccccagccacgctccacttcagagctgttcagacaggcagtgcatttcttccacgtgttggcgcctcctggaaagctcgtccccatggctgactcctagtttgtcttcagaacatctgttccctggagactgtctgtcagagcctcccaacacagccagtatttttcttttgcagttctcatcacacttgtaactatttttttgatgcgtgcttccctgaaaagccccatgaggacagggactgtgcccttgttgaatgtctggcacattataattgctcactacatttctttatggactgactgaccagaaggagcagtcatttgtaaagggttaaaaaataaaatagcaagctttaaccttttgatttgttttggtattgttttccaaatgtctgaacaaaacattttattatttgacaggcacacacatatgctttcttcttcttttttcttttagctccatatggtggaaagggatttttttttcttttataatttttttttagagacaaggtctcactctgtcacccaggctagaatgcagtggcacaatgatggcttactgcagcctcaacctcctgggcttaaggggtcctcccatcttagcctcctgaatagctgggactacaggtgcatgccatcctgcctggataattaaaaatgtttttattttgcagagatggagttttgctgtgttgcctagtctggtctcaaactcctggtctcaagtgatcttcctgcctcaatctcccaaagtactaggattataggtgtgcaccactggacccagccaatattactttttaagggattctcagagatggcatttttcagtgactatgtatacattggactaatcttacttgctttttctcttctctccacagaatgagatgtgcctggccacacaacagctttctaagcaactgctggcatatgaaaaacaggtaacttggtatttatgtggcctgtgatgctgctgtgttcaggactttcttaagtggaattatccagaggcatccttagagacctaaattatttgtttcattttcttcatagtttttttgtcctgtcttttcccttccactgatgtattgaaatcagtgattatcccaaagtctttatgaggtattctaattagcctctagaagtaattaactgccattgagggttccaagtctccaaggaactacaagtgaatcaacattagcaattccaggaaataaacactcaaataaagtcaaaaaatatgtttgacagaaaggaatggccagggagggtcagatgagtgcaccctgggggcaggacaaaggggatagctgtgactccctcttcaggtagacacttctgataggacgtgctcttggagaagaaaggacgtcggtgtggagggtcgtgttctgcaggtgatgcttcgtgctgaattccccagtattcacttaacacctgcttcttttattctttggtcttagaactttgctcttggcaaaggtgatgaagaagtaatttcaacactccactatttttccaaagtggtggatgaggtaagatagcaacatagaaaatttgtatttgattctttctcgaactttcttttgttgttattttggcccactttccatttttaaatttctacttaaatatctgagaaggtatctcaacttcttgatcttacaaagctcctttcctaggagaggttatacactaactattaatgtttgtttctggtttgaggggaatggcttcgatatatatgaagaatagaccaaaagaaagatttctgagaattcggtttctaaaggagagtatattagtttctcagattgccatagtaaattaccatgaatatgtagcttcaaacaacagaactttattccctcccagtgtgctgtaggccagaaggctgaagtcaaggtgctggcagggccacactgcttccgttggctccggggagaatcctcgtgcatcttttggtggctccaggtgttccttggctgtggcagcatcactccagtctggctttacatcccctctaccccccatgtttttcctcttctgtgtcttctctttttatacaggcacttggcattggatttagtgacaatccaggatgatctcatttcaggatccttcattacatctgcaaagactctttttttcaaatattcacatgttctgggtggtcatatcttttaggggagggtcacagttcaacccactacaaagggtttatttttatatttttttctcattttttaattttgtagggatggcctcttgctttgttgcccaggctggcctcaaactgtggcctcaaaggatcctcctgtctaagcctcccaaagtgctggggttacagacatgggccaccatgcctagcttactacaaagggtttaatacaactgttcttatagctatattttacagtacatttggaatatttgtaaaaaacgaaaccaggtattataggaaaagtgcataaattctaattgtaaaaaacataagagctcagatgctactagtgctggacagaactctgcaaaattaggtagatataaatagttccatctttttttgttgtttataagacggagtctcgctctgtttcccaggctggagtgcagtggcgcaatctcggctcactgcaagctccacctcccgggttcacaccattctcctggctcagcctcccgagtagctgggactacgcccggctaattttttgtatttttagtagggtttcaccctactaaaaatcttggccaggatggtctcggtcttctgaccttgtgatccgcccacctcggcatcccaaagtgctgagattacaggcatgagccaccgcgcctggccaaatagttccatcttttaaggagtttgaatactcaaaaaatcatgataaagaataaacataaaggagtgtgcagatgccatttaactgaccagttattgatctgcagtagatactgtcttcagtttacaaaatgagaaactaacattcatataaaactgtactgattgcattttcgtttattcaacaaaccagttcaacaagccattatttattcaacaaacatttattgatgacctcctatttagcagacgctgttctaggcacgggggatgtaaaagtgaacacgtcatatgatttttattgggctttgtcctctaccctactaaacagtaggaaaaagacaaactcattctctttctatactttcagcactcagcacactttggtcaccaaaatgtgtgggttttccccacatcaagcaattctgtgacactaactggctgtcctacaatttaactcaattctgacatatctacctggagatagcctcagatcccacaagttaagggcatgatcccgccagactaccccctcccccacacttcagatgccaattgcaagtctaggcctctggtacttctgacaaacgagctataaactaggggttcctgcaacatccccctgggatttgattattttctagaatggcccacaaatcagggaaacacttaaatttacctttattataaaggatattacagaggacacagatgaacagccagattaagtgatacatagggcaaggtacaggggaggcggcgtggaacttccgtgccctctctggggacgtcacccctctgggctctgccaggtgttttaatgacctggaagctctccaaaccctgcagttcaggtatttttattggcagcttcatcacatagatgtgatcaacctccagctctctcccgttcctggaagatgggggcggggctaaaagctccaagctcataatcgtggtttggtgtttctggtgaccagcccctatcctggaggccaccaggagttgcctcatcagaacaaaagacactcccatcatccaggaaattccaaaggattaggatctctgtgtcagaaactggggtcaaagaccaagtattataacaaaatatgctcctagcacttctattgatgaggaaattacaagggttttcagagctctatgccaagaactgggggcaaagaccaaatacatattttttattatatcatgatatcacatgcactgcgtggctctctctcagatgtgttgaaatggataaaagatacatagaagatgtgattatagaggagcaaaagtgatttttggaaggttggggaagagttttccttaatgaacagtagaaagataacccagggcgagaagcaatagactacactcctgagtcacatgtttgcttgagaagagagttgctaaggaaacgcggttagttgtcgaaaccccagaagcaagatttccagtttaaaatatttacttacaaccacgttgtcatgggcaggaatgatgattgttttagtagggagtgaatagttcccaaaggatggaagtatggtttttatttttttattttttgagacagagttttgctcttattgcccaggctggagtgcaatggcacgatcttggctcaccgcaacctctgcctcccgggtttaagcaactctcctgcctcagcctttccaagcagctgggattacaggcatgcaccaccacgcccggccaattttgtatttttagtagagacggggtttctccatgttggtcaggctggtcttgaactcctgacgtcagtgatctgcccgcctcagcctcccaaagtgctgagattacaggtgtgagccaccacgcccagccagaagtgtggttgttacaggtagtatcatggcaccctggaagagttagctctgcaaggagttttcaaacaaaccttttgatgtaaagacccagaaagtgatagcagttagcccaggtggggcctaaatctgggaagaggggagtagctgttctctctacctgggcctaaaccaggttgaaaaaattttaaggcaagttatttgactcagaaattacaggaaagttcaacaaaaagtagaaatttatgtggcttacacctgatagaatgcgttggaatgagatcttccatgttataagtcacacagagatttccacgcatggtgatttccctaaaagcagagtttctggaccacttcttttgagtgcacctgagacaggatgtcattgtcattagagtccactgattgaagaccgagcatatatgccaggcactctgctctgagtgtgtcctgttcatgtcactgtcttgtcctcacatgccttagccatgcaaggaagatgctgttgtccccattttctatatggtgatgctaaagttgtgagaggtgatgcattccccttccattctcctgagtgaaggtgctctggttagcagtgattatcctgtacaactcacagctcaaaagccccatgttaaaagctgatgacataacccccttaattcttggggagaaaatgagtagctgggaaatgtaccatttctgtagtgcataaccattggaaagacacttaatctttctgagttttggtttctccatcttatatggcatcagcaaggcccacttaattgggctattatattgattgaattaaataatgtctctcaaagcgtcaagcacagagcctgttaactgttaatgaaaaacagtacctttcttatagaagttattctggaaaagtagtcatcacattctgttctgaaggcatttactggcatggctgtcttcctgtgttaccctcaaatacagctgccatgctttgacttggttgagcgatagggaaagtgttagcagtttgccccggtgcttccttgcctggcaaatggttgaccttaggcaagtctttaagcttgtaagagtggcctctgaagccacagcctcgaaggaccagatctgttgggagatgcgtgtgcagaaggttgatgaatatgcgtgactgccagcactgctaaaagaaactttgccacatgttgaatccaaaagtgattgctgggtgatttccccttagtcacccagcaggaatcccaaaatatctggaagtctgtggtctagtgggaagatcccttccactgtattcattgccaacgtctagattcccaaacgtgagcataaaggacaaattctgtatcccaggctatgtagtggaaagtaaacgaatcttagatctcaccagccccagattaaaagcccagctatgctgtttatttgccctctggatttggagagctatttgcatgtctgtaaagtggtgatgataaataatacctaactcacagaatgggtgagaactacttagtattgagcgtataaagctggcatgcaaaaagtactcaaaaatgcactgatagggataatttttatttctcctagataatttacaaagatagaatttactcagtccttgaggtagaaggggagaaagagtcaagggctgttaaaatcatctggtgaggagcatcacatccaaatgcagttatcttattctcaggtccttttctagactaaaggtctgaaatctggcagagttgttttggtaggaagtattctttttttttttttttttttttgagatggagtctcgctctgtcacccaggctgaactgcagtggtgcgatctcggctcactgcaagctccacctcccgggttcacaccattctcctgcctcagcctcccacatagctgggactacaggtgcccgccaccatgctggctaattttttgtatttttagtagagacaggatttcactgtgctagcaaggatggtctcgatctcctgacctcatgatccgcctgcctcagcctcccaaagtgctgggattacaggcgtgagctaccacgcctagccgttagggagtattctttctccagagtcacttccaggcccatagctggccgtggttttcaggcgagtaggtttccagcaggcccatctttcaggcgtggcttcagcctccctggagagtgagagagtcgagcagcctggcgaggtcctgagccatgacagcactgacagctggctgtgttctctgcaggcacatccaggcattaggattctccagtggggtggggcccagagtgggaacacagaagaagcagagtctgcccagtgaacagggtaactgtgggcccagacactctgttagcaagcttcattggtgccctggtcagttagaaccttgcatttcatttttcatgcttctaggccaatatcatttactgctttatgaagggtacttacttgctgaggaagtctgcctgagctctgtgaccacacggaagtgttcagtgtgattccttggtgaaatgagactatgtcaataataataatgtatttaatttacttgaataccattctctttctttcagcttaatcttctccatacagagctggctaaacagttggcagacacaatggttctacctatcatacaattccgagaaaaggatctcacaggtaaagtaactgagttcaatgccagttaccttcaaaatattgtgtaatgcatttcataataattcttactgcatttctttcaatgtgtggatcgctgagaaatgcctttctttttgagcagttcaattcagtgaacttttactgacttcccactgtgttcccggctcacctaaaggagatcacaggccagtgagaagacaggtgtggaaacagatcgttgtaatgtcatttgctgagggtagcaggacagagacgcacaggagtagaaacagcacacagaaaggcgtgctagggacggcttcctgaagaaggtgatctctgagctgggttttgaaaaatgacattaaggctgtgttccagattaggggacatttgtaaagtcatgctgttcttgggggaaccgtgaatgctttggaatggaaagcggggtttggagaaaggggaagacgggataggaaccatgcattctctgtgctagactctggggatgcagctgtgaacgatggatggggactgctcttatggaactaccagttagtgagtaagggaatctgtgagtcagtcagaaaacttagttgtccttttggactaattttggttcttcaactaaaataaagcgttaggacaattttatatttcttagaaatcaaagtagtcacaaaatgcacataaaaaagcgtgaataatcttgaaaaaacttcgctgatgttagaaaagggactccacattttctagtcctattgtctcttcattggaagtatttattacttagagtttaagaattacattttctagaacactgatataaacaagttgctggccccaaaaaagcctaaacctgaatgctaaaagatctggtcagtatattacttactctttaaaaatatatcactttaagctttttttgcggcgggggttggggcggagaaggttgcagtaaatctaaagacaagtcttaaaggtaaagattggccgggcacagtggctcacgcctgtaatcccagcactttgggaggctgaggcgggcggatcactaggtcaggagatcgagaccatcctggctaacacggcgaaacctcgtctctactaaaactataaaaaattagccgggcatggtggcgcatgcctgtagtcccagctactcgggaggctgaggcaggagaatcgcttgaacccgggaggtggaggttgcagtgagccgagatcgcgccactgcatttcagcccaggcgacagagcgagactccgtctcaaaaaaaaaaaagggtgaagattttcctcccttgctttgagatcccctgtgttggtgtcacctgaggctaaggaacaaggatagaactggcataaactctacctaaggtcagtttggcagcactaaaacttaataaataaaaaataacaagtaatgcctccatttgcttgcataaagggaaaccttgattaaacaaagcaggaattttagtgctttttagtgttgctcatctgtcattgcataggaagctaaaacatgcttgcctcagtcatctgctgatgattgtgtcctcactgaatgccttagtgggtgcatttttttgaagggttttctctaaataaaatcattagaagtgaacgggatgtcattttaaaaacaaactccaagtctgtttgaaagaaaataatcatctcctaagacctatgttgtcagatttatgtctttcaggtttgcttatgggaggcagaactagaattgagagtgcccagcagcattaatgacagtggcctccattaatccagagtgaccccaaatgtggatgagtagtatttgcccaggatggtgattttttttaagtggaataaaactgctcgttagtagtaagaaggaatcttcttagtatctttgaaaaaggttaaacatccttttctgatgccatcaggacctcactttgaagtatttggccccaggtcatacctgagtcaacatcagaccaaattagaatctgatctcccctctgcctagacagtggtgttttatcttacatttctcggcctttattcactcaccaacacaagtacataatctgaatgaagagaacgcaagagatattaaggaaactacttaaaattgataagtaaagaaacctaaaacttgactccaacaggaaataaaagatgggagagaaagaaagaaaaatgcaagcaggaaagggcagaaagtagcctgataccaaaagagtatgaataacgcgaagagcatttaaaagctggaggcagtttggaggcaaattgaaaactagtataaccaacatagatgtgaatggctttgctttgtttgataaaatgaaaatggattgttgtagaattgtagaaagtgtcactttcttttaggtatcaatcgttgggtttttaagtttctaaccttggacggtcactgctctcaatgatctttttggatttttggtcttgggcttggttcagccatctctgtgcatgatgggtgtggcactcactcggagtaatagttattggtgttggcttgtcgcaactacagtatgctagatcgtgtcacgtttttcattagtacaagcaccgcgtattcctttgtccagggatgactccagtaagtcagatattaaaatggcaacacaggaagcttttaggttctgggtgtagaaagatgtattaagacactctatctgggggctgaggcatcagaacttaagtttatactccaggtctccatgaaaagtacctgtccaccacactgtccagcccacctccccggcgtgccctctccctcacagaccctcagcgctatgtggagaggcagggctgctcaggccatcagggtcactgggtgtggggcatggttgaagccgtatgttccagtgagcccaggtcccagcctctgggccagcctgtgagagccagggactgagggtgcaggggcttcccttgcacgcatattctcttattttcaggggaaagtgcagagctctgggttggcatgttttatttttcattgctctaagacggtcccttttctccttttcagaagtaagcactttaaaggatctatttggactcgctagcaatggtaggcaccttctccattcctggtgtgtgggtgtgtgggcttactgtggcggggaggagacccccaatgaatgttcttccctttcgaccctgaccctcctgggtgttcagatgtctgtttatttttagagcatgacctctcaatggcaaaatacagcaggctgcctaagaaaaaggagaatgagaaggtaagaatactttacatgttgtttttcacttcatttacataaaggcctttcatgccttcctcttgtgaatttatggcatgaaagggtgcgtggttatttttttttttaactatacatggacttttaaaattgttcattccaaatctcataagtagacctccacttctctattctatcttttcaaactggtttattaaacaccagcttagagccactgtaagattatgatcacacaggggttttaacttcagcttgctgcctcgtctgactcatttatcacccaggtcacttgaactccttgccccaagtgttgactctgattctttaacccatgctttctaggaccttcgctactctagataatattgactattttcatgcatataactttttacttctgttacatgatttccttgggctaaattatttccttggcatacagtcttatgagtgaactagaatgtctgcagccttcttcagtacatgctgccatattgttatcctgaaggactgtaggactttgcactgctcccaggagggtacaggcttcacctcaccgcggcctcacaagcactgagatgctgtttcttgcatatttttaatttggattttttagaaagttgaagtgcagccttatctgtgttttgttatatttgtcacaaaaatggttataatgcataaacacacattttgaagcacacgcttttacagaattgtcacgtacagtagacaacttgaagttttcctttcaccttttaaccaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacaggtaggggagtccctccctgagggctgaaacctaagctagctgtggcgttctgctgagagggcacgcaggagacactgaagcatcgtcgtagaaagaaacataaatgcacaatctccctggctactttgtgggattcagcacttggacagcttccagttgagctgggtcatcttcagctggacatgcattggcctcaagttaggccatatgttcaggaaatgaggcctgggtcccaagcctctcttggggaagagcctgtgtggccctttttttctaatccgaatgaaagccagctgggtgcagttctcctagaagcagctaccactggggttgggatagcttgcctgtcacccaggattcccggcactccttgctgcctgtagtaaggcccccgctctgctggctcctcaggtgcacctctcctagatgatcccagcaccttaacatctgggcatggggaaacgttgccagtgctttatgaggtctcctttacttattgggtttctatcctcctatttaatggttggctgaatatttgtcttaagagaggctctactttgaggatggggagttgactgtagtggcaccagtgcggcggagacgagtgaccgtgagtgtgaggctgatggcaccaccccctcactttccaccccatcctgcgtttgccccactcacgttgtctccaaagccatcctttggcccgtgagaaaggcacccaggaatcttctctcagttgacaatctaggaacagaaggggatgcgaggaagcaaaatgttattaagaaaaagtcaccaacttaaaaatacctgatatatgaacatctaatacttctataatacatttttaaggcacatatattaaaaaacaaaaacttcacgtcagtgtcattcaacaaaaaggggaatgagagaggagctttaacccatttcctgtttagagaaaaaaagtgcagctcactgccagaacagtactctcagggcaaatgggaaatgggttcggaagatatccaagctcagttgtcttccttgttaatctagttgttaggctgttgaatggtgagttcactgaagtcagcctgtgcctttggaagtgatacttaaatagagcgataaagtctttctgtgtcttctgagtgaagtagcaccacccagctgtgggcggcatcagtcctcagcagatcttgggagctgtccaggtgcttatgatgggcacttgtgcacacaggtgtgcagtaactcatactgttgccctcccctctcctgcaggcagtatcacagctggcagatggccttgccatattagagaatgccggggctctctttgttctctttagttaacccctcctggattgacgccatccctctggggccgtagccttgctcagtcagaggcctagggtcgggaagggtctcagatctagcatcttggaaggatgatcagctctggtcctgatcggtcagtgctgtagaacttgcttgataagagggtgtcctgcaaggcctacaggacaagcttgacaccagctggtttcattctcattcatggccaaggactacctcactgctcccagcctggactctcttaagtgagtgctctggccacagagggagaagaggagctgtgggtaccgtagcacacatgtagccccagttctgggggaacagcagagcacaccgtcattattcagtggcaggagcatcattgttgagagctgagaatggcatctttcatttttcgtatccagatttcaagacacaagaccaagtaggccctttccctatgcattatttttaaatgcagatggaaacaatagctccttcaatagccagacaagtttgttgcctggcaccgtggagtgatcttctggatgattcagaagcattagctgtcctcctgcctcatccgaccttggcaatcagggtttattgagccccagcctctgtgagctgatttttccatgaacatagcacttcctgctgctcactaaggcagttgtggtggagactcatcaggcttctcggcaccacccacctttgtggaggtgtggggactccattcctgccttctccagcccttgaagtcatgttcggtcctcatgcctgcaaactgaggctctgtaatcagtgcgcaggtttttgagaacggaacagtgacctccagtgttacattgacgggacaggctgtgatgcggctgtagagccagtgtcttacctgccttccgttcatccattcgcccacttttcttagggattatgtgagcccctgccctaaggagattacagaatagcagaggagctaagacatggcctaggagtgtaaattccaaaggagttcagggaggggaaggagagggaggccaccatgacattgtgccattagaaatgcagagtgctgatttaacaaattaatgatattaaatgattaatactcattttgatatttaacacttcagaagttccaaatggcatttccagtggtgatctctgtatgatttaaagatcatggggccagaacagtcccctgcatgtatcacctgtgttaggatgaccacaatcatccgtttttaacctgtgataactaagcacattagaatacatgctttcccagggtatctggggaatagatgcaaagccgtcagaactatgctgagaatacctgctagcctcttcagggtcagaggtcgattttggtgcccgccatgccaggaaagggaggcttccaggtcagacagacgagccgggttaatgtgtgagagaatacccttgctcacacggaacgttttctctcttttttcatcatctaggcttgcaactgttactgttacctcccaaccagcagacatagaaaatggagcagttcatacctaatgggcagatttgtaaaagtcatggctgtagaagaatgcaaactggagctgctcagggtgggatggtgcagatgccactaatacacagaaatgttcttcttcccctctcccatacccctgccctccagggtttgtcaggggacccagactttctgggaagtgaatattagacaggagttacaggaagtaaggaatcccttccattggcacccaaaagccagcaactgtggtttcagtttcaaagtgcatagtgctcaggtgtagactcagtagagatgctgccagtgccgcgtgcgaggcgggccagccagctgtgatggctgccctcacgctgcctgtctcaccttcagtgagttcactgatcacttccctggatgattttcagaatattataattatatctttcagattaacttttttaagaagggagcagagatgttttccaaacgtatggacagctttttatcctccgttgcagacatggttcaaaggtaatgctgcactccggccgggtcttgtgtgccccttgcctttcatgctgatctgacatctctgggaggtcacggggagggttctaactgtggagggtcgcacagagcctctgtccaccccagaaatgctcgctaacagtgcccttgccttagctgccaatattcataaatatctggggcacattggcagagttttctccagatctcttgttgtgaatattggagtttcacatgtcacaagcctgggaacccagcttagctttgctgtggttttagaagagctcttgactttctttgagagtacgtggcagtagcagatggaagtgctgtcacttttcaggaaactctgaccagtgcattaatttataataggtaaaggagggatagagcctttttggaattaattttaaaaactgtatttgcttattttaagaaatacaacatcactgtcttcagtagttgagtaactgccacactaactggaggctgtgggcgccctgccacccgcccctccccagcttccatgacagagctctgaggggggccccggcccctgcagcctcaggcttggtccatccggagcacagcatgggcttcccaagcgcttgcgacgagttctggagtacagaaataggtccgtgtgtgtgtgtgtgtgtgtgtgtgtgtgtgtgtgtgtgtgtgtgtgtgtgtgtagttgacaaatagacaaaatggaaataatgaataggaattttatttcatgtggatacacgaagagaaagttgctcattttcttgaagatgttgcatttcaccacacctcatgaaggctaaacaagggaattgatctaggtagaagtctatctgaaatgctccaaaaataatcagtcccaagaaaaaccagtgctgagcattgagacagatgcaaagcaagttgagagcatatacccctacctgaaagtcactgagctgtttagctctgaataattggcagcagtgagtgatgtagcttttatttataattatgctagaaaccaacttgtgaaatctgattgcagtttcttgccttttaatttatttggttcttagcccctgggaatgttaggaggaggtagaagatgagaggctattaaatggtcactttgtaaaagtatcctctgtccctcatctttcactgtctcttcctcatcctgctttaactctcagaattcctcgcacttctgtgtttctggaagaaccatctatgcctcaatttttttcacacacctgattattttctgaatgggtagcaggacatttgtgcccatgcgtgtgagttgccatggtttcctctttctgcagatcctagagcctctgtcttcccttcttgtcagcatttccattaaccattattaggccaacccaagtatagcaccagccatcctgagagaaccacaacccgggcattaacgtcagggtctgcgcccgggctacatggccttctctgtgcaggctggggctggttctgtgagttaccccctctgtctgacaagctgtatttagttatggggtgacaggcagctgatggggtttccaaactgaaccttgcagcacttgattcagatagctaaagtactgttttgaatgctatttttcctgtaattttaaatttcatgttggtgagtaaatatgaccacttttctccaaaccaagggatggttttgctgcagcattgccatgcatgagcagccagcccacccagggaggcctcagagcaggatctggtggtggccctgaagctgtgcagcccttccccgggggatgatgccacaggtgctctgtgctttccaggtgggggtggattcagaacccagtggtgggaatccagacagcgtggcatggtttccagccaccctgcagagctttctttattccctaaccctatagtgatacagttctacctttctgcggctcatatctatatatcaacagatatatataattttatatatatgtgtgtgtgtatatatatacatgcttttttttgttgttttatctgtgaagagaaccagttgaaagcagttaattttgaccctgttcctttggttcctgggaaccttggatgagctcccagtgtttgagcctgagtctgtgtggggtgggggaggggaaggcagggcagctactaaaaatctcctggagttgtacgcaagaagccacgttggtgcccgtgtctttctggggacaggatccttctcttgtatcacatcttcaaagaggtttctcacccataaaagctgaccctgagctcttgacaggctcttggtccctccttccccttctctcctcccccgttctatgtgctgagcttggtcttccacgttccattctctcagccggggcagtgacaagcaggcgaagctaatgaggtttgtcctctagcttacctgtcttaaggccaccaatggtagagtccctcatcatcccagtcaaatgtcagaaaagccaaaatcgagctgcattaaagaagaggggctgaccaggagcagtggctcacacctgtaatcccagtactttgggaggccaagatgggtgggtcacttgaggccaggagttcaagaccagcctggccaacatggtgaaaccccttctctactaaaaatacaaaaatgagctgggtgtggtggtgcatgcctgtaatcccagctgtttgggaggctgaggcatgggaatcgcttgaacccaggaggcggaggttgtagtgagcgaagatcatgccactgcactccagcctgggtggcggagcaagactctctcaaaatgaatagattagatagataggatagatagatagatagatagatagatagatagatagatacatacatacatacatacatacatacatacatacgtagagagtgggggaatatggaatgtccaagcccaacgttccttacctccagaagagagagaatcctgaggtgctcatgtggagaaacactggccccctgtttgcttctgattttaaccttgtggttgccgtgtctcctgtaacacagtgcagaggaacacctcctctaaattgtgatttctcagatggatgggccccgttgggcagattgtgtttaggactttgtaaccaagactgtcactagtgggtggggtggcctggtgcggtctagctcagtaggggaaaagggcagccaccatttccacacctcagcacacacctccatgaaagccaggggctaatgtcccagagccaggccatccgcccacttacccctgtgtgggcagcccttggcctgctagcctatgaagcctcagggcagaactatggctgttaaaaaaggaaaagcattgcctttggctttgttgttgcaccttagtaccacttcctggtcattttcctgtcaccaccactcctgcctaaaccaagagcaggggaggcatgactaccatttcattccttcctttatggaacttgcttaggctgcctgtgtgagcagccctggaggatgggcttctcaaagcttttctccaaaaatttccatcaacggtgctgagcatggatacctctgtcagcagcaaaactgtttagctgggttcagccgggcgcggtggctcacgcctgtaatcccagcactttgggaggccgaggcaggcggatcacaaggtcaggagatcgagaccgtcctggcgaacacggtgaaaccccgtctctactaaaaatacaaaaaaaaaaaaaaaaacaaaattagccgggcatggtggcgagcgccggtagtcccagctactcgagaggctgaggcaggagaatggcatgaacctgaggggcggagcttgcagtgagaggagatcgcgccactgtactccagcctgggcgacagagcgagattccatctcaaaaaaaaaataaaaacaacaaaaaaaaagactgtgtagctgggttcaagcatagttcaatggcattccttaggttctgttttaaaacagcagtcatataaacacatttactactgcaaaattgagtccctgtgattcatagttttcagggcctaagggtagagggttgtggccctgtaggaggctggcagctccatctgtaaggccggaagctttgcgggggtggagtgatggctgccagtggcttcttagtagtgctgggttggccagcagtgagtaactgacccaacaccttctgtcttaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaagtgagaacgccaccgtctgcctctttttctgaaatccgttttccctaagaggtggctgaaaagcaatcttacgtgcctcattaaagtcagagggaggtgggtgggtgagactgggaagaactcccatcacagcagccctcccacttgcaacacaggaaacctctggggcccaggcgccaaactgcactaagagatggggctggaaacgagtcctctaagagcctggtgctgtggactctggtcactgtggccatgtgcaaacagaccactcttaactgttgccgtcctggaccactgacagtttttatcccctcatgccacttcccccacaccagctggcagatgagagccatgtgctggagacctacctgcaaggccagaggcaaggtcaggaggcttttagagtcagttcgattcatactgattgagtcacacatttaccactcaggtctttaagtgtccgttttgaatggaagggatgatcaggtttaagtatttctgtgagcagagaggatattgtcatggtgtggtgtgaaaagcactgactttggaatcagacatcccagctgggctgagccttgatctcttcatctgtaaaatggagctgataactgcacctgctttacgaagttagattgaatgtggtcatccctcccaggcagtgagcactcagatgtcagccgttgccatttggggaaattattggggcaggaaacccagtgcctttggacatagttgctactcagtaaatactgagccaagtaaatgtgtttgataacccccagtggagggtccatggagaggaactgccagctgttaccaggctggagtacctctaaggtctgtgaacttgcagcgatcacaagctaaatgtcccctgtagttctgcagatgtagaaaacctaccgggttctgtcgttatttgccaggaactagattttccttttgtaagctgcccacaaaacaagaatgaccttcaattacagcaaaatccagtctgttgagagcctcctaggactatggggtgggtgctgtgggctaaggcaaccctgactagattcagagcagctcagctccaggtgtcagagaaatgattctccaggtgttcagtccttaatggtgtcggactcattctagttgcatctcctggtttagtagtcagcatgtggctgtggtgcggggagtcggccctgggactggtgtctcccttggaagcagagcccatgatctcccagatcattccagctaaattgtacccttctgctgctctttccacttgaatgggcagttttgctttaacgatataaagaaacacattatttctaaaatgccaccagtacccataacgaggtagcaagacttggaggtggccgctggtgctttctggtactaatgggctttttaaaacacaactcacagcaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgtatgtttcacgcgttttatttgggaggagaatgagtatagtggttccacccgttccaagggcctcctagttcattcctatgtgccagccctctgtgggagaggccccaatctgggtattgttgacctttcaggaggatgattttctgctctctttaaacaagcccgcatgacccataagggatccagcctgccttatcccatatggagataagtgagggtttgtctgtggctttggagaagagatgacctacgtgtgtgagacagcaacagaagtcgtgcttgttagcatagattctcagagagagaaggctgtggctactcctagcctgttgtaaagaagcatttgtgtttggattgcagcaggggagagtaactattttggtaaggacgaccttcctgagaaggccatttttccagcagaagcaggagttgtgagaagtgtactccactgcagcagcatcgtcggctgccaggctgttcccacatgtcctgtgtacctgaggggccccaaagaggtggtactttaccaatccgcaggctgtggccattcacagtagatcccatcccagtgggatcccctctcagagtggtggtttttaaactgctccaaggagttcagggtcccatggaggggcttcagggtcccatggaggggcttcagggttcacctgcctggggagaggagtggccctgcccgtcatcagagccgctcttctcacactgcattctattaagatttgacctgaacagcaggggtaggggtggggacggcattgggatgatgtctctcctcccagcttggcagagcagctttagacctcatccttcctgctttggtgatgggaaatgacctgggaatggagattcctggatgctcatcatggtcctttgcagttacctcctctgggcctcactttcctcagatataaaatagggataagatctatgttactccatctgccacagatgagaggaacaagggaactggcagatgtggggtctctttaaaaagttaaagcctcggctgggtacagtggctcacgcctataatcccagcactttgggaggccgaggcaggtggatcccctgaggttgggagtttgagatcagcatgaccaacatggagaaaccccgtctctactggaaatacaaaattggccgggcacgttagtggtggcgcatgcctgtaatcccagctactcaggaggctgaggcaggagaatcgcttgaacctgggaggcggaggttgtggtgagccgagatcacaccattgcactccagcctggtgcaacaagagcaaaactccatcaaaaaaaaaaaaaaaaaaaaaaaaaaaagagttaacgcctccacaaaggtagggcagtattactgttaccttattcccgggcctccatacgcagcagacttttcagttctgggaaaggagtgaatgggctgccaagtccttctttgggcatggtttgaggagtggctgggcttggagtcctggtcatcttggatcattagaggaggtcaacaggtggatctcactgtacaaacacagatttgggctagaagatccgagtcccgccttctcatttcatagatgaacatgctgaggcccagggaaacggccatgtttgtccaagatcacatagtgaatcagggcagagccagacctacaagcccattttcttttttctttttcttttttttttttttgtttgagatagggccttgccctatcacccaggctggagtgcagtggcacagtcaccactcactgcagcctcagcctcctgggctcgatcgatcctcccacttcagcctctctagtagctaggactacaggcacacgccaccacgcccagctaatttttgtattttttgtagagagggggtttcaccatgttgcccaggctggtctcgaactcctgggctcaagccatcctcctgcctcaccttcccaaaatgctgggactgcaggcatgagccactgcacctggccctggaaccccattttctttccctctcatcatgctgccttcatggcacttttcctcccacaccccagctaagttcagtttatgtagagaaattcccagtcactgagatcagggaagcacttaattacttagacacttttgtttcaggggaataatcctccaggctgagagcagaaaggaaaatgaagaggtaaaaattttgtttgtcatatttctttcctaacgtggtgggtgactttgggattcagtgttcttttttaatgtcctctacagtggatatgtgcaataaacaacatctccagacagatctacctgaccgacaaccctgaggtaattatcagccaccggcatctcagcccttttctcaacctggaaggtaagcgtccacctcctgggactgagtgtgtcttcctgtggatttttaggcagtcgcgatcaagttgaatcagaccgctctgcaagcagtgactcccattacaagttttggaaaaaaacaagaaagctcatgccccaggtaactaaaggacaaagaaaaactagcttttgtggagccaaattattgattaggaatacgaaatgagttgttgcttaatccacacaaaccaaggcatgtttttcagcctgtttaacagaagcagtaacgatggctgggaaaggttaaatacctgcctgtgttcacaccacattgtgagtggtagagccaggattcaagcctgtctgatgtcagcatccctgtcctttccactggaccatgctgctgcagtccaagcaaacaggacgtgcatggagggtcctcctagtcaggagttctccccacattttctatcagtgtcaacaaagtaagggaacgaaagcaaaaatgtttttaaaaaataaggaaaaaaaaatcgccttttatgtatcccatgttaatgtccacgccttatctgaacatacagtgatagttttatatgtacatttattttgtatttgcacatactttttttttttttaactatttctacatttttcagaattgttccttttagtaactacaccctattccatcatttatttttttacttacttattttttaattttttcgagacggagtctcactctgtcacctgggctggagtgcagtggagtaatcccggctcactgcaaccgccacttcccagattcaagtgattctcctgcctcagcctcccgagtagctgggattacaggcgcccaccaccacacctggctaatttttgtatttttaatagagatggggtttcactatgttagccaggctggtcttgaactcctgacctcaagtgatccacccgcctcagcttcccaaagtgctgggattacaggcatgagccactgcgcctggcccattctaccatttattaaccattgaatatttaggttatctccctggcgtttactgttatcatttagagcaaacattttcatgcatacagctttcctcattttgaatagtgctttaggatttattccaggaatcctaccttttgtcttaatgggagtttccatctggttaaatagtagaggattgtattttcatactaatgaaagcctggcattaaagggtaaattaaaattacgactatatttggtgttcatcttttagtggcatggtagaaagaaccccattacattttttacaaatatctaatgaccccagaaggaagtcattagaaaactcagtggttaagtaacttcccagaatctgtgcagtgtggagccagcgttcacatgccgggcacggggtatctgagaaggaatgggagaaggtaaggccagaaaataggtttgagtctaactggaaagacctgggtgccctgcttaggagttacaggcaatggagcaaaatggaaggttttgagaaaatgggcgatggtcagaaccagggttagggaagactattctgtacctgagtaggataaattttaggatacaggttgtgggaagaaggggagagtgcaagacccagtaggatgttgatgtagtagtagctgtgaagcagaacatgagaacgtaaacaaatgtttttaaaaaagaggagaaagaggcaacaagtccgagaaacatttcagcaccgtaacttaaggatttaacagttgatacaagtagcatgctttatgaaatggaactctaaggaagacactatatgaaaggaagtggaactaaagatccagtcagcgagggttaatcccgtagccttctcctgggtaaatgtatgtcttctctttgtaaagttacaaaaatgtttgatgtgcacaatggagggaataccagacctgcagttgagagacatgggttctaacgatatctctgccttgtgttatacacagctagatgtccctgagtaagtcagtaaatgctctgggcctttgtcttctcagccttgtgacatacagggaactagctaacctcctaggacccttctagctctgatatgccatctctcaagggtgttgatggatagtttaggggggtttggaattagaaggtgtgatacgtttcctaaaaagacaatttgcagcctatatttaattattcagtaactgacttttccccctattctagaataagcaagtcacattcttagaccaaaaggaccccacagaagggacacagaagactccctggggggaaaaaaaatgactctagccagccagctgaattagcccagtgattggatgggtgacagatgtggctgccagatggccccagagctgtggggagagggatactatctcttttagggtcagcccactgagaataaagcaatgttttgatgacagtggggggggaaagaatcagagaaattgtgttcttgggaacaaactgctatttacttctaagcaagtaccatgtgtggacttccctcattctgcagttactatatatctgctgttcattcatttatctagctactcaacaaatatttgagtatctactatttgcccaggcctggcctaggtaagaaaacgcagggattactggggagaacaggcaaaaggtaagcacaggctgagttaaaatgagggaagcaccccaatgttaaggagatgaggtgctgtcatggagggtgaagaggagacctgtgcagggcctggctgtgaagataatattcaagctgcaaagtgaaagacaagacgcagccactcttgcaaagagccagaagtagtgtattcttggtagcagttgtggaggtaacaggacagagaagatcttagtatatctgaggaactgaaaaaaggcagtgtaacgggacagtggagatcatgggacaggatgagggcgggtggggagggaggcaggggtcgatcaagaaggaagcatgtggggagctgtggaagggctctgagaggtgcgtgtttgtgatggagacagagatacccactctccattttccaaagttagttagctctggctgctctggagagcacagaacagagcaagtctgtagccagtgaggaggcgtcccaacagcccaagagaagatgatggtggtttagaccaggatcacggcagagatgaaaagtagatggatgtggacttattctggaggtaaaacctgtgggacttttgatggataagcgtagacggaaaaggacagatcaaaggatgacttcagttggagctgaacacctgggcagatggtgttttttaaaaaaaagaagagttcatgttttggacatgttaagcatgagaggcctgtgaaacatcccaaatgagttgtcaagcagtcaacggatgatacaggtctggagtgcaaagaaaacgtctggtctgggtgtatgaatcggggactcatagcactgaacagcagtggatgaggtcctctatgggagaaaggagagggaggggaaagcagagcctgcatcagaatcctaaagaactccagcatttagggtagaaaaggagcctgccaaagacattgagaaggaacatcaagaaaggtagaaggaaactctgtaaaatgtggcaccagccgaaaccgagaggagagttcaaggagagatcagctgtgttagatgctttaagtcaattatgatgactgcgaagtgtccattagagctgatgacatggagatcctgtacaggtgaaacttaacatcatgtcactcctatgttcagagtctttggtggctccctatactgttgtgtcaagttcagaccccacctgacggtataagggccctctacaacctggcctcaccctatcttgattgttatctatctcccccctttgactctctggggagccaaaatcttagactcactttctccccttgaagcttctactcatagctttcttcagtgcttaccacttattatatcacagccctctcttaaagacaggatcaaacagatgtgactgtcccatttagggttattgaagcagtatgacatcctggagatgcactctcctggcagtgaggagacccctgtttataatctggctcgcccaccaggtaactgagtgccttcaaaactgctcaatttctccagaggcctcagtttccttttctgttaacaatggaggtcagaccaagtggtctccaagggcttgccttgcagtgaccatctacaagcctatgtactgtttcatccacattccagtcattatgatcatttgtcaaatgcctgttgtaaagtagtttgatacactacattcagttattgacatgtttgagaaataggaaaatattgacatatcaaatgaacagaaagatcactgagagctttttaaggtccaggcaatgaaagaaatcaaaatacattgatattctttgcccttcaaaggagtttatagtctggctgaggagaaaagatttttaaaacgttgaaaagttaaattacagtattctgagactggaggagaagaacatgttggttcctgattagtctgtccacagagagcacagtatttgatgggccacaatgtcagcaatgagtgtgggcacaatgcgaagctcaggaggcacacagggccgcaagactgtgcctgtgacttactgagaagaatcacaggagttcagaggagggaggcggggtgccggctggcctagtggataaggaagaatttgagctgggttgggagagttgggtgagcagcagaattgggataaagatggaaataaggaaaagcatgtggtatgtgtggtacagctctcgtagagggtgcattaaaggagtggaaagggaggcttttggggaaattagagccagatggtgattaaatgccaagccaggacctttggttcattcagctaacattttttagtgcctactatgttccaagaatacatatgacttagctatagcataggccctccaaaacctgcctcacagagaaggatacagacagaaaactagtaacacagtgcaggatgctgtgcagcagagagaactgcaggaaatggggcagactgaaggtttttagccaaggatatgaaggaagtttgaagaaggtttatttgtagaatggattaagggattgaggtcaatctttccccttgtattttcattcataaaagtcacctcagccttcaacaagtattcacttgattataaaagcgtaaggttaagggaattgatttttttccccttcagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggtatgggctgagagaggttatctctgggagaactgaaagtaaatttgaggtatcttgtgtccccctccaccaccaaagactgttgccattctgatttccagttcaagtgttaagtgcccttctagctgcagctgtcgtgtttgttcaactctggctattcccctaggcgtaccaacccttttggtgaaactgaggatgaatcatttccagaagcagaaggtaagtgactagtttggtgtccttattctttcctctgcacaaaatgacaacggccattgaaataagatgtgaaatcatgttttagagagctatgattaggagtatgaattaagatttgttgttctgaaagtttagtaagatatctgcagtggaggcaagtcttggataaaaactgaggggtagctgaaagaccacctacagctatttcaccattagccatagcgtttttgtagcatagcatagaaatgttgtgaaatctgaatctgttatcacattcaaatgcagtcttggtgaactggaaatacgctgtgtcattttagaaaaccaaaagcacaaataacttgttcttgaatttgaagatgacacaaatgatatttaagtctttcaaattcaaatttttggttttttacattcttataatgtacttaagaacgtatctgatggccggcacgctggctcacgcctgtaatcccagcacttttggaggccgaggcaggtgaatcacgtgagcttaggagttcaagaccagcatgggcaacacagtgagaaccctgtctctacaaaaatatatatatatatacaaaaattagccaggtgtagtgacaggtgcctgtaatcctagctactcaggaggctgagacatgagaatcacttgaacctgggaggcggaggttgcagtgagctgaaatcatgccattgcactccagcctgggctacagagtgagaccctgtctcaaaaaagaaaaaaaagaaaaaaccttctttggtcttctagttatggttgctgggagtcagttttgtcaagttatgcgccactgtcagcagccaggactgacttcctttaggctatgaaacatcatcactgcctttccgtaatacacatgaagtatgaattgcatgagacccaacatgagatcttatatcctgcaaataaaatttcttttctaagaggactttatcagtgggccaaagtaatgaattttctattgtctagtgaactcactcttttcagagaaaaggtacaatgtagtcacctagagtttcagcattagaaggatgttcatctggtaccaccatcatttcattttatagatgaagaaaagcctttctagtctaatgaagtagttccaaacaaactgacaagatgtagacaaatggaagacgcagagctttggcaatattgggcttataaaagtggtattgagaaattttggtagaaagtcctccacagaaagcaggcaaaactagcacatctgaccctggtatgcagatcaacagcagcaggaagtaaatgagatcctgagtggaaaatgctgtcttccagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggtacgttcagttttattttcagactttcttatggcttcagctaattccccttttaaggctaatgcacccatctgaaatgttagtactggaatgaagagactactcttgcttttgcccccactactttttacataagatagatagcctagaaagtgctcccttagagacaagaactggtatcttcaaaaatccagtggtgagtgaatactgttgttcacaaagatgccatcacactagacttattctctatattatagctcagagcttgaaaatggaagttttttggttttgctttttttttttcatttctgagagtactatttataaaaaataatggaaaaaaacttaaaaatctgcctaaataacttggccatcacagagagagcaggccatattaactacatgatttagtgtttcaggtaatacgatctgggtttcagatatgaccaaaatcctggttatgaacatgggtgtatgatactgtagccacaggtagcatctgcagcaaaactagcctgaactgagatgtgttttcagtgttaaatacataccaaatttctaagatttaggatgtaaaacatctcactaattttttaggttaatcacatgtctggtaatattttagatatactggattaagtaaaattaattttatctgttacttttcacttaatgtggccgctggaaaaacttcgatgacatataaggcttccattacatttctaagggacagcactgctttagagccagaatgtctcagtttattcctggcttcggcatttcttagttatgtgaccttaagcaaatttttgagcctctgtacctcagttttttcagctgtaaaatgaaagtaactattcacaccctccactgttgtcatgaggaataaatgtcatgaggaataaatgtgctaatatatgtaagacatttacaactcactggcacatgaaaagtgctcaatgaacgttagcttcaaaaaaggtaactaggactatagcaaaaattaggatatagcttcttccattcattaagcccatccttttcatttattatgaaccttatctgagaattaagttcttattaataaaacctgttctttcactatgtcctggaccttttacagaaatgggctcatggttcttataatcctattggtcctggaataatttccaccaaaaagatcaaaggaaaatatatgtaaaagtactgtgaaaaaccacagcacatcaaagtgaaaagaaaaactacagaatgggaaaaaagtattcacaaattctatctaatatggatgtagtacacaaaatatacaaagaactcttataaaactcaacagaaagacaacccaattaaaaaatggaccaaggacttgaaatagacatttttccaaagatcatatacaaatggccaatgaggacatgaaaagatgctatgtgttactagggaaatgcaaaacaaatccacaatgagatatgtcactccatattaagatggcgtgcgcacgcatgcacactgtctcacagatgtttatatatatatgatatatatgatatatatatgatatgatatatgatatgatatatgatatatatatgatatatcatatatatgatatatatgatatcgatatcatatatatgatatatatgatatatatatgatatatatatttaatggaaaataagcgtttagcaaggatgtgaagaaactggaacccattgctggtgggaatataaaatggttcagctgctgtgaaaaaatagtttggcgggctcctgggtagttacccaaaagaattaaatacaggtgttcaaacaaaaacttatacgcaaatgttcatagcagtccttttcgtgatatccaaatggtggaaataatacaaatgcccaacatcaaatgaatggatcaacaaaatgtggtagagttgagcattccaaatctggaaatctcaaatgctccaaaatctgaaactttttgagtgccaacttgatgctcaaaagagatgctcattggagcattttggattttgggatgctcatcctggtaaatataatgcaagtattctaaaatctgaaaaaaaagctgaaatccaaaacaatttcagatacaggatactcaacctgtatatatatatgatggaatactatttggccttaaaaaggaacaaaggactgataagtgctacaacatggatgaatgatgaaatcattgtgctaagtgaaagaagccaggtacaaaaggcaacatactgtagggttctgtttatatgaaatatccagagtaggcaaatccatagagacagaagacagactagagattgccagagggtgggaggaggaatgagtaactgcttaatggggatggagtttcctctgggatgataaaaatgtcctgggactagatagtggtaatggctgcacaaagttatgaagacacttaacatcactaatgataaatctgacgttatgcatacgtcaccacagtaaacatacccctgcagtggaataggttctgagaccatttagaggtcacacagaaaattagaagatttaaaaagaaaaattgattcccagacaaggtgcctgaataggaacagctccagtctgcagctcccagtgagaccaacacagaaggcaggtgatttctgcatttccaactgcggtacccagcttatctcactgggactggttagacagtgggtacagcctatggagggcaagcagaagtagcgtgcggcattgcattacccaggaagcacaaggggtcggggaactccctcccctagccaagggaagccgtgagtgagggacagacctatccagcccagatactaggcttttgccactgtctttgcagcccgcagaccaggagattccatcgagtgcctacaccaccagggccctaagtttcaaggacaaaactgggcggccatttgggcagacactgagctagctgcaggagaatttttttcgcaccccagtggcgtctgaacctcagcgagtcccaactgttcactcccctggaaagggggctgaagccagggagccaagtggtcttgctcagtggatcccatcaccacggagcccaacacactgagatccactggcttgaaattctcactggcagcacagcagtctgaagttgaccagggatgctcgagcttggtgggggggaggggcatccgccattactgaggcttgagtaggtggttttccccttagagtgtaaagaaagccatcaggaagatcatactgggctgagcctgccgcagcgccataaaactgctgtagccagactgcctctctagattcctcctctctgggcagggcatctctgaaagaaaggtagcagcccccagtcaggggcttacagatcaaactcccatctccctgggacagagcacctgggggaaggggtggctgtgggcgcagtttcagcagacttaaatgttcctgcctgccagctctcaagagagcagcaggtctcccagcacaacgcttgagctctgctaagggacagactgcctcctcaagtgagtccctgactctggtggttcctgacggggagacacctcccagcaggaatcgacagacacctcatacaggagagttccagctggcatctggtgggtgcccttctgggatgaagcttccagaggaaggagcaggcagcagtctttgctattctgcagcctccactggtgatacccaggcaaagagagtccggagtgtaccttcagcaaactgcagcagacctgcagaagaggggcctgaaggaaaactaacaaacagaaagctatagcatcaacatcaacaaaaaggatgactacacaaaaaccccacccaaaggtcaccagcatcaaagaccaaaggtagataaatccacaaagatgaggaaaaagcagcacagaaaggctgaaaattccaaaaaccagaatgcctctcctcctccaaaggatcacaactcattgccagcaagggaacaaaattggacggagaatgagtttgaagaatttacagaaagaggcttcagaaggtgagtaataacaaactcctccaagctaaaggagcatgttctaacccaatgcgaggaagctaagaatctggataaaaggttataggaactgctaactggaataaccagtttagagaagaacataaataacctgatggagatgaaaaacacagcacgagaacttcgtgaagcatacacaagtatcaatagtcaaatcgatcaagtggaagaaaggataccagagattgaagattaacttaatgaaataaagtgtgaagacaagattagagaaaaaagaatgaaaatgagtgaataaagcctctaagaaatatgggactatgtgaaaagaccaaacctatatttgattggtgtacctgaaagtgacagggagaatggaaccaagttagaaaacactcttcaggatattatccaggagaacttccacaacctagcaagacaagccaacattcaaattcaggaaatacagagaacaccacaaagatactcctcgagaagagcaaccccaagacacataatcatcagattcaccaaggttgaaatgaaggaaaaaatgttaagggcagccagagagaaaggtcacattacccacaaagggaaacccatcagactaacggcggatctctctgcagaaacgctacaacccagaaaagagtgggggcacacatttaacattcttaaggaaaagaattttcaacccagaatttcatatccagccaaactaagcttcataagcaaaggagaaataaaatcctttacagacaagcaaatgctgaaggatgttgtcaccaccacacctgctttacaagagctcctgaaggaagcactaaatatggaaaggaaaaaccagtaccagccactgcaaaaacataccaaaatgtaaaaaccatcagcactgtgaagaaactgcatcaactaacaggcaaaataaccagctaccatcataatgacaggatcacattcacacataacaatattaaccttaaatgtaaacaggctaaatgccccaattaaaagacacagactggcacattggataaagagtcaagacccatcagtttgctgtattcaggagacccatctcatgtgcagagacacacataggctcaaaataaagggatggaggaagatttaccaagcaaatggaaagcaaaaaaaaaaaaaaaaaaaaaagcaggggttgcaatcctagtctctgataaaacggacttgaaatcaaaaaagacaaagaagggcattacatagtggtaaagggatcaatgcaacaagaaaagctaactatcctaaatatatatatacccaatacagaagcacccagattcgtaaaacaagttcttagagatctacaaagagacttagactcccacacaataatattgggagactttagcaccccactgtcaatattagatcaacaagacagaaaattaacaaggatattcaggacttaaactcagctctggaccaagtggaactaacacacatctacagaatgctccatcccaaatcaacaaaatatacattcttctcagcaccacgtcacacttattctaaaattgaccacataatcggaagtaaaatactcctcaacaaatgcaaaagaacagaaatcacaacaaactgtctctcagaccacagtgcaatcaaattagaactctggattaagaaagtcattcaaaactgcacaactacatggaaactgaacaacctgttcctgaatgactgctgggtaaataaataatgaaattaaggcaaaaataaataaattacttgaaatcaatgagaacaaggacacaacataccacaatctctggaacacagctaaagcaatgtttttatagcactaaatgcacacaggaaaaagtgggaaagatctaaaattgacatcctaacatcacaattaaaagaactagaaggttgggcaccatggctcatgcctgtaatcccaccactttgggaggccaaggcaggtggatcacctgaggtcaggagtttgagaccagcctggccaacatgatgaaaccctgtctctactaaaaatacaaaaaatttgctaggtgtggtggcaggcacctatgtaatcccagctactggagaggctggagcaggagaatcacttgaacccagggaggtggaggttgcagtgagccgagatcatgccattgcactccagcctgggcaacaagagcaaaactccatctcaaaaaaactggagaagcaagagtaaacaaattcaaaagctagcagaagacaagaaataactaagatgagagcagaactgaaggagatagagacacgaaaaacccttcaaaaatcaatgaatccaggagctggttttttgaaaagattaacaaaattgatagactgctagccagactaataaagaagaaaagagagaagaatcaaacagacacaataaaaaatgataaaggggattatcaccactgatcccagagaaatacaaactaccaacagagaatactataaacacctgtatgcaaataaactagaaaatctagaagaaatggataaattcctggacacatacaccctcccaagattaaaccaggaagaagttgaatccctgaatagaccgataacaagttctgaaattgaggcaataattaatagcctaccaaccaaaaaaaagcccaggaccagatggattcacagccacattctaccagagttacaaagaggagctggtaccattccttctaaaactattccaaacaatagaaaaagagggactcctccctaactcattttatgaagccagcatcatcctgataccaaaacctggcagagacacaataaaaaaacacaatttcagggcaatacccctgatgaacatcaatgcaaaaatcctcaataaaataccagcaaactgaatccagcagcacattaaaaagcttatccaccatgatcaagttggcttcatccctgggatgcaaggctggttcgacatacgcaaatcagtaaatgtaatccatcacgtaaacagaaccaatgacaaaaaccacatgattatctcaatagatgcagaaaaggccttcgataaaattcaacaccccttcatgctaaaaacactcaataaactaggtattgatggaacatatctcaaaataatgagctatttatgacaaactcacagccagtatcatactgaatgggcaaaaactggaagcattccctttgaaaattagcacaagacaaggatgccctctctcaccactcctattcaacataatattggaagttctggccagggcagtcaggcaagagaaagcaatgagggtattcaaataggaagagaggaagtcagattatctctgtttaaagatgacatgattgtatgtttagaaaactccatcgtctcagcccaaaaactccttaagctgataagcaacgtcagcaaagtctcaggatacaaaattaatgtgcaaaaatcacaagcattcctatacaccaataatacacaaacagccaaatcatgagtgaactcccattcacaattgctactaagagaataaaatacctaggaatacaacttacaagggatgtgaaggacctcttcaaggagaactacaaaccactgctcaaggaaataagagaggacacaaacaaatggaaaaacatgccatgctcatggataggaagaatcaatatcgtgaaaatggccatactgcccaaagtaatagtgctattcccatcaagctaccactgactttcttaacagagttagaaaaaactactttaaatttcatatggaaccaaaaaagagcccgcatagcccagataatcctaagcaaaaggaacaaagctggaggtatcatgctacctgacttcaaactatactacaaggctacagtaaccaaaacagcatggtactggtaccaaaacagatatatagaccaatggaacagaacagaggcctcagaaataacaccaaacatctacaaccatctgatctttgacaaacctgacaaaaacaagaaatgaggaaaggactccctatttaataaatgatgttgggaaaactggctagccatatgcagaaaactgaaactggaccccttcctcttaacaccttatacaaaaattaagtcaagatggattaaagatttaaatgtaagacctaaaaccataaaaaccctagaagaaaacctaggcaataccattcaggacagaggcatgggcaaagagttcatgatgaaaacaccagaagcaatggcaacaaaagccaaaattgacaaatggggtctaattaaactaaagagcttctgcacagcaaaagaaactatcatcagagtgaacaggcaacctacagaatgggagaaaattttttcaatctatccatctgacagagggctaatatccagaatctacaaagaacttaaacacatttacaagaataaaacaaccccgtcaaaaagtgggtgaaggatatgaacagacatttttcaaaagaagacatgcggctgacaaacgtgaaaaaaagctcatcatcactggtcgttagagaaatgcaaatcaaaaccacaatgagataccatctcacaccagttagaatggcgatcattaaaaagtcaggaaacaacagatgctggagaggatgtggagaaataggaacgcttttatactgctgggaatgtaaattagttcaactattgtggaagacagtgtggcgattcctcaaggatctagaaccagaaataaccatttgacccagcaatcccattactgggtacatacccaaaggactataatcattttctataaaaacacatgcacactatgtgtattgcaccactattcacaatagctaagacttggaaccaacccaaatgcccatcaatgatagactggataaagaaaatgtggcacatatacaccaaggaatactatgcagccataaaaaagaatgacttcatgtcctttgcagggacatggatgaagctggaaaccatcattctcagcaaactaacacaggaacagaaaaccaaacaccgcatgttctcactcataagtgggagctgaacaatgagaacatataggcacaggaaggggaacatcacacactggggcctgttggtgggtgggtgtcaaggggagggatagcattaggagaaatacctaatgtagataacgggttgatgggcgcagcaaaccaccacagcaacatgtatacctatgtaacaaacctgcacgttctgcacatgtatctcagaacttaaagtataataataaaaaaagagaaatctaggttacctgatttaaacagcaaacttctgaaagtgacccacaaaatatgcatgtgttaagttttcacttataagggaattttacaaaatacctatgaaagttattccaacttgaggaaaactgtttatgatctatattcaaaaaattaaattcatgcccattaatagggacgtaaaagtaacttttcttaagctttgtctacttaaattcccatacacacttctcattaactgtcataaccacctcttggaagtgggggttcttaccacagttttacagatgaaccagttgtaagaagtccgggtgacttgcacaagatcaggtgagtagccagggtagaactcaatctcgagttctctgattataagtcttacggtttaataagtgtaactgcacgtatttccaactgtagccttttgttgggggcatgggggtgtaacagttttactgagatataattcacatacaatttaaatgtacaattcagtggtttctagtatattcagagttgtacaaccatcatcacaatcaattttacaacattttcatcacctcagaaagaatacccattagcccctggcaacccacccagccctaggaagccactaaccactaaaattgccatctctatagatctggacatttaacatataaatggaatcataaccattttttccacaaactatatttttgctttcacctataaaatgtatagtaataatttacataatagcatgttaattattccaacacgagtacaatacagtagaaatttataaccacttatctaagatagcaataaattctctcatatagtttattttctaggatatgtcaacctgattattagatgatgcttaaaatactgttgaagaaatatattctgaaggcctggcgcggtggttcatgcctgtaatcccagcactttgggagactgaagcaggcagatcccctgaggtcaggagttcgacaccagcctggtcaacatggtgaaaccccacttctactaaaaatacaaaaattagccaggcattttggctgacacctgtaatcccagctactcaggaggctgaggcaggagaatcgcttgaacccgggaggtggaggttgcagtgagccaagactgggctgctgcactccagcctgtgtgacagcaagactcttctcagaataaataaatagtaaataattaaaacaaggaaatatattttggaatactttcttaaacattattcctcttttacccaaattgataagagttttgtcaaaatcccttcactattttgtcaccgctacctcatctttttcaataatgttaaatttagactaagttgatcttgcacttcagggacattaaagttgccaatggatgtttgttgagagggaggctgtacagaatataatccatccatattatatagcagatctgttgaggattataatgctgtctgtttgggtaagttgcagaatcctgtgaagttaaatcttctacttgctatataatcttccattataggtaccctgagctttagctacacaggttccttaaaggcagaaagcaggacacgtggtcacacacagctatctcgcctcaccctctaacaggctttatctctatttcggggaatttgtatttattctggacttctacaaactcttctaggaatattaaatttatccaacatttgtgacataatgtatcttttaaaatttcaggttgatagatccacagactcaagtatcaagggccaatgtaagtaccgcatacaggttcatgttagtgattactccttaattcacctttgtatctaccttaaacacagcctaggcactttattaataaagatctgccactaataggactaataggatactttttctcatgacttttccagagagtagccttgtcagtttttaattctagtagttgtatgatctgttgcctttttttccaccccccagtttgaacttaccagtgtcacacaatttgctgctcatcaagaaaacaagagactggttggttttgtcatccgtgttcctgaatccactggagaagaatctctgagtacatacatttttgaaagcaactcagaaggcgaaaaggtctctttttcatgtgaagatcccataatatcccagtccaaacaagtccattttaaaagagttttctggcattacttccttggatatttagttgattattctgcatgtctccatccaggagttcagataatacctcctaagaaggcctcactgaaagaaaactcgatttaaatttctctgtggaaaatacctatcaaccagaatagggtgaatgaggaagaaatttcatggcaagacatattatttagtcgggatataaggaaatgttgaaagcagttcccctcaaatttgttctttaaaaaaaattaaggcaaaagctacaatagagaataatttagtctcagagagaaaaccaaggaagatattagaaaagttacacacaagctgttggtttagtatgaaaaacttttgactctatctgctacttagaatttatcacaattaaccaatcctttcagtaaattatctgtttgccactgtgtatatggacatatcgtggctaaatacatttaagagagagaagaaaaattcctattaagaacttttaacactggaattacctgagtttcacttacctggaatattttttgtgtggcataaattggcaacagaggtcaggacagttggacgcaaatgccccgggccctatgtgatgagtctcctgcagccaggtcctgtgttcccaagtgggaacagtgagaacagtgacctcactgtactcccaaatcacatttgttctaaaattttatccttctctacttttgccaatcactacttttcttgtcttttgcagatatgttatgctattaatttgggaaaagaaattattgaggttcagaaggtaagatgcattctagcgctggtttagtagctactcaaaacacatctgtgtacacataccaagagtcttttcaaaaagaaaagtgatgttcactggaaagtgtggccaagtttgggatttccttttaaaagtattctaaccaccagaggtttttgatcagctagttccatgttcactgttaacacatgaggacttcttatcactgctggagctcctgcttatctgttttcttgcttgcatactagttggctagatttcctctttcagattaagatgatagataagtacccaccgtgtgctgctctaaggccttgctcctcagagtatgatcacatgccccacagcattgacagacgtcacctgggagcttttaagaaatgaggattctgagacctccctgtctttcagcagcttttaatcttttgttcattcagcaaatttttgagagcctagtttgtgtaattgaacaagacagatatagtccctgcccccagggggcttctagttcagcaatgtacagaactttctgcaataatggaaatgatttatatctgcacaatttaatatgcagattgaatatggcaagtgtgactgaggaactggatttttaaatttaactcaaatttacatagtaacatgtagccagtggctaccatattagtgcagttcagtcttggagaggtcagaaagaccaaggactaaggccacatacatgaaatagtggcaagcactgtaagctagtatttaatggtattggtcaaaagttggcaaactttttctataaagggtctttatgtttttggctatctcccttgcaacagattcaactctgctatcataagacaaaagcaggccaggcatggtggcttatgcctgtaatcccagcactttgggaggcagaggcaggaggatcacctgaggtcaggagttcaagaccagcctggccaacatggtgaaaccccatctctactaaaaatacaaaaattagccgggtgtggtggtgcacacctgtagtcccagctactcgggagactgaggcacaagaatcgtttgaaccggggaggcgaaggttgcagtgagctgagatcataccactgctctccagcctgggcgatagagcgagactctgtctccaaccgccgcaccacccccccccccaccaaaaaaaagcagcagcagcatggacagtatgtaaataaatggccgcagctgttttccaataaaaatcaaatggttagccaaatgaccatagtttgccaacttctggtatagattaaacgtgagaaaagaaggagtttaaagatagagaagacaaaagttctgtgaaggaagttcctctgtggaatctttgggaagatgatacgaattgactacgtaaacaatattttggctcagaggaaaacagtctagattctagaagtgacatgcctgagtttgagaagcaaggagactcagcggaaggcacatatacacaagagtcaggagaaacaagactagattacagaacatattgaaagccaggccaaaggggtttaaatgcatcttaagccttttcttttttcccttttaaactctcctaacttcaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttcttt

SEQ ID NO: 38323 - DNA, 68295 bp, Homo sapiens
gggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaaggtgagtcggcggcctggccgcagaggcgccggagggggagcgcggcggtggtagcgtccaccttccgccaggcgtgacgtcacaggcgcgcgccgggcttgggagggcgcgggatgatagcgcctagcacctgtctccgggccttcccgatgagccgcgcttagggtccgtgggcttcagctgcatgaaccacgttccagcagttcggccctcctggccccaacgcgcctttgaaatacgcggacagtgcgctttccttcttggcccgagcggcgcttcgcaatgcgggcttgtgcactcgtgaggcccgcggacacctcccgcccctgcgcggcggagcgctccgccggctacctgctcctcagaagtggcctggaggctggatttccttggccatatctggtccctgggctctcgccgacaaagaagcattgtccgtactgtctgtgtgcccagaaatgggaagcgggtgtaaggggaggccaaacttgactttcttagtgtcgcgaggtgggtcagagcgttacattgacataaaacagattaacaacagaaaaacatacatctcttgaatatgttttacgtgaaaaagacacaaagaaatggcaaaacccaaatacttttgtgctaggcagaaccaagagcggcagctgtgggagagtaaagtgtgcggggaggctaatggaagatggaactgcttgaaccacgtctaggtagaaatctccgccttgctcggctctggtgccgagtgtttctttgttcctggtgtagggaggccatgttttacaggagttttctcttgtttcatgaagaaaagggggcagtttagagcactcttctgtttttcaagtgcttttagcttaaaataatccttatgccagagacatatttttgggatggcataccctgtcacccttcacgggctatctgaacagaatctaacgtgggaggcaaaaagtgggaataaaacagaagattgaatatcagcacaactgttttcatgcttggtaaaaccgtacctttaccaggttttctttttccactgaggtacgtgttccaatggccacttcacctccttggatctccatgtatttcatatttggctaaaactaagaaggtaattttgaaagagccattggtctgaatatggaatctaaggcaagtgacttctgtaaacctctctcttcttgaatgtggttaaaaactcgaaacaggccgggcgcggtggctcacgccagtaatcccagcactttgggaggccgaagcgggctgattgcttgagcccagcagttcgagaccagcctggccaacatggcaaaacaccgtctctacaaaagaaaaatacaaaaattagccgagcgtggtggtggacgcctgttcagctactcaggaggccgaggtatgagaatcgcttgagcctcggaggtcgaggttgcagtgagtggagattgcgccattgcactccagcctgggcgacagagctagacgcagtctcaaaaaccaaaagcaagcaaacctgtgggaacaagtcctaactgatggggatgtgtctgaattagatgaagcatataaattgcctagcaaactgcctgatgtggtaccttaagaaaggcctcaataaatgttaatctcttccccttgatgatttaagttacacggtttagattcatattcaatattggtttttctctagatttcttctatttttacatacaaatatgtgtttcatttgtgacttagtgtttcattttttaataacaaaaataaaaatctggcaagcattgaaaaaactgcatcattcattcttattaccagtggccatctcagtactatccttggagtaggtaggttacagcaatgcttagtgaaagatgaatgaaatgaactcttgacatgagaataacaaaaataatgttagagacatgggaagcaggtgagtttcatttgcagcctcacaggagataaacactaattcaactcaaagttttgaaattgggtatttttctttttagcctttgtatctggataaatgtgatttttgacctcagttatatacctgatttatgttgaaaagaaaattagactacaagtaactaatggggcttgtgatatctctgcaatgaaatgtaagttggggtggggacctatgccagtggttgtgagtatatgctaaagaaagaaatggacatcatattattcttgaatatgaaaatgagagcacgttgaagggagagatggatagtgattttaaaaggtggaaagattgcttcttggttattggaaagtcatcagataaaatgaatatgagttgaacactgtcttccctattaatattttttatgattgacattaaatttttggttttaaaaatctgttaagaatgcaatttgaggatatcacactatgcactgtttttgatagacatgaaatttcatgaaaatgagggtgttatgggttgaattgtgtcccccaccagaaaaaaaggtattgaaggttgaagtcctaacccattggaacctcagaatgtgacatttggaaataaggtcatggcagatgtaattaagatgatgtaatactggaatatgatgggcccctaatccaatatgactggtgttcttatatgaagaaaagagaagcaggtatgatggctcatgcctgtaataccagcactttgggaggttgaggcaggaggatcacttgagggcaggagttcaagactagcctgggcaacatagtgagaccctgtctcttttttaaaaagaattgtaaaagagaagaaagagacatagggagaaagaagatggccatgtgatgatggaggcagagattggaattgccagccaacaccagaaactaggagaggcaaggaaggattctcctctgtaagtttgacagagagcatggccctgttgatacgttgattttggggctgtaggctccagaactatgagaaaataaatttatgtggttttaagccacccagtttgttgaactttgtggtatccctagggtaacttgttaatttgtaagttaagcattgaataattttctctccatgatgttaccgagtaatgattacaaaaatctaccaacacaataacattttattactaagtattctttaagtcattcactctatctcattttagtttggctgcctaggtatgtggtgtgatcagtcaataaaattatcctctgattctaaaaccactcaagtcggcttctctgggccatatttccataaattggtatttataacattttttacaatattgggccaatattatgaaaagcagtgaaccagtgtagtagcagttgtttttaattatggaaagcctgtgacgcagacactcttagttactcatctaacagccatttcctcctttttacttgattttgttgtggccgtggacttaaggggaattgagcccagctctaggagctgaatcatgattaatgtctttgaccagcagcagcagcagcttcaactgatgttcaagtccaaccaggagatgggtaccatgcagagtttaatagggaaagtttaacttaaagaattgttatgaactgtgagactggagtaacaagagattgtctcatgagaaggaaagagaactctgaagagtgtaggaatagcagacagaaggagcagccccacccctagggctgagagggcactcgagtaaaggcccctgtgattagctctgttgctgtgtaataattatcccaacacttagcatctttataaacacttacgatctcatgcagtgtctgagagtcaggaatccagctgcaggttagctgggtggttctggctcacggtctctggagaagctgcactcaagctctgaaccagggcttctgtcattttgaggcttaactgggagagagaatctgctccaggctcattcacatggtggttagtcggccttgctatgtgttttctggaggcttcagtgtctaaccacatgggctgctccttagggctgcctcatgacatagtggctgtcttccctgagactgagtgatcaaagagaaaagtatgcaagagcacccaagatggaagctgcagtcattgtatttattatgtaatctcagaagtgacataccatcacacctgccatattgtattctattagaagcaagacagtaaatccagcccacgctcaagtggaggggttatacaggagcataaataccatgaactgtagagtcctcagccagggctgaaatcttgaacttgtcagagaggtcattgccatacctcattggttgggagagaaattgctgtgatactgcaccattgctaggtgtagcctccagaaccctgcaatgagtattacagtaagtgacaatatgtaaagaatatcttgggggcacaagagaagaaagaagacgtgttaattctgcccattcgcatcagggaaggctttttagactaaaatgatactttcatggtccttgaaagattaagtgggggttttctaggctcagttagggaactccatgagcaaggacttaagggataccacattatgagaatatcaaggagtacggcatgactggagaagagggagcgtgaatggcactggggagtattgaggccgaagacagtgattggagttgatgctgaaggacttgatggattggaaggattcttttaaaatgaaatttaaaattgtatatttaaggtataccacatggtgttatgtgatacatataggtagtaaaatggtttctatagagaggcaaattaatatattcccaatgtcacataattacccattgttttttctgtggccagagctgctgaaatctattcacttagcgtgaatcccacatccagtgcatttttattacctgtagttttcatgttgtgccttagagctctagacttgtttgtcctgcatatcttccattttgtatcctctgaccatttcctctccttccttcaacccactgcctccggtaataactgttttgttctctatctctgtatagttttgggttttgttttgttttttttcgagacagggtctcactctgttgtaggctggaatgcagtggcatgattgtggctccctcccgagctcaaattatcctcccaccacagctgcctgagtagctgggaccacagacaggtaccaccatgcccaactagtttttgtattttttgtagagacagggttttaccatgttgcccaggctggtctcaaacttctgggctcaaggaatttttcccagctcatatgctgctgtttcattttaagaattgtttcctttgctgtgcagaagctttttaatttgatatagtaatatttgtttatttctgcttttgtgccatgagcttttggtgtcataccaaaaaattattgctatggccggtgtccaggagcttttccccatgttctcttgtaggagttttatagtttctggtcaatccaaaggactttacaactttttccacagaaaaaaatcaggaaaacttgtctgtaatttgatacaatcttaagctattggaaatgcttcagtttataattatttaattttccatatttttgttttgaagctttaaaatttgtttaacctcataatatatcatggaagcataaggaaatcagtactaccctaatacccagagaaatgtaatttttttctctttattcaaaatgaactaaattgtgtgtgtgtgtgtgtgtcaggtggaaggtggggtaatatactctacaacttctcagagtgaggtttgtggacctaaatcataagcagttcctcaaagattgttagaaatgcagatcccactccaaacccaaggaaccacagtctgcattttaacaagatcctcatgccagagtactcataaatttgagaagcattgaggaaaactgttctacatgtagctttattaaattttcttttaatatgaacttaattaacctccagccagttttcagttcctgatgtggaaagatattgacgtggaagggtaatggtaagattatggagagggaactaagaagatattatacatgagcattttccatcttttggaaataaattgtagcatagagcaggtaacagttttaatagtcttgtgtttgactcctacttttctgccatttatgacttgtagactttgagcaagttatttaaccacacactgaaccttggttttcttacctcatcaacttgatgtaaatggttaaattgaaaggctaactgaggttcttaatataacatagttgtaatataacgtatttgctaaagcttttaataatgtagatgtaatataaccaccccctcctcactggattgttataatggctaattaggttaatacatttaaaacattcagaacggtgctgagtacagttagtacctaggtacacatagttactgatacataggtgaatagtaagagttgagttaatgatagctattagcattattatagacatagcttatttgtattagagtataaaatgtgataatgaaaaatttgtttacattttatattttcagtggaatacagaaaaaaaacctactttttttgctctttaaagaaatgcttattgtctcctttttttcctaaggaaaatatggttagatgtacaatatttatatggctatatcctcagattgccaatagtttccagatttctgaattccatacacatacattcttcctctcatcatctctgaaagggcatggaactcctgttgatggtggtgagatgataaggaataaccaaaccacttggaaatatggaggttgggaattctacccacagtagaacctaccagctcatgctgtgcacctttgggcctcagcaagattgaaaattgtcatctatcatagcctgggtctccagattcgtaagtttatgcttgaaacttcaaacaggagctctgaacacttaattcatgattaccaagggcttactataattcatttctatttctttttcccacttaactttactgctttctgagaacaggaattttttcttgaacatacttgagttattattttttaattttttaaatatttatttatttatttatttatttatttatttgagacagggtctcattctgtttcccagactggaccacactggcacaatcatagctcactgcagccttgacctcccaggctcaagagatcctcccacctcagcctcccaagtagctgggactgcaggtgtactccaccacacccagctaatttttaaattttttgtgtgtggagatggggtcctgccatgttgcccaggctagtcctgaattcctgggcccaagcaattctcctgtcctgcctcagcttcccaaagtgttgggattacaggtgcaagccattgcacccagggagttatttttaaacatcctcactgcttgatactgaaataagaacgcagtaggtagtaaatgtttgttgactgaataaatctatggaaattaaaaaaatttttttatgagaggcattttttgcattttatttaatgatacaattttgtattttaaaagctattctgtatctagaatgttacatcttggactcttagatgacattccaggctactgtaagtcaagaactatgtaatatgctttgggagttctgggtgaggagtgtgctttgtaaggacaactagcagttggctagggccagactaggttttgagcaaattttgcttgaatagaattgcatataacaaaccgagtttctttttcagaaaatgttcctgtcttttatagattttagttagtaccatgcagcaattgtttaatcaaaatgaaacctaacttttcactgagagctttccataattaaagataatttgaccacaaaatcctgctatctccatgggttccttgtctcttgaactgtaattacatatgttttgagcccttgtttgcagtttattaatacattgtcacttaacagtttgtccttggttctttattgcaattgtaaacttccttgtggttatgccatatatcccctacgaagcatacatagcagatgaatttttatgatacacatcaaaattggattgaggtgtgtgtgcttaggatatgtaatctagaatattttctgttatattactgagtttgaaataagaaaacagaagcagaccagattatgtaaatctatgactatttttagcagaatgaactattttcaaacacctctgcaaaatagcgttatcttgatagagtcagtttaggtaaggacctgtttattgaaaataccactagtgaaggtagatgttttcactaccatctaattctttactgtcagaagatatagcttccccacccctgcctgcttttcccatgtagtaattagctttgaggtaaggattgggggacttttgttttattcattttgtttgcaaaatggaacaaagcaagcccacactcttgctaggtatgtaacatcacatcacatcttcatgtgtctaacattacaagtgaattagcctaggagagctgaattaggaaatgcacttccccaacccatacccctcagcagaagggtttgttaaaatctttcctaagaaaagaattactttatggtatacagtttgcaaagtttgcacatcatcacatatgtaaaatgtgagtcaaaaagctatttttatcatctttaaaatgtaggcaagttattttctcttagcttcagtttctgcatgtgtaccatgatgataatgctgctttaggattatcaagaggattaagttagattaagtgtctcaaataccccatttattaggagtgtagtagatgattttattaagctctcctgatgcatttcaagtattattcatacctaaatgttcaatttatgcataactattcaaaacgtacctttttcttcttaggagctatttattatgtgcatgttgaacacttgtttttagacttttcactctcctctatttgtagttaagatcatcataattttttacaagttaattgtcaaatctttaaagttttctgtatttttatgtatagcagttgtatttcctcaaactagcactaaatttatcataaaaaatacagaagaacacaagtattttagaaagagaatgattgcatattccgtagttttcagatggaatgacttgtttcctcaggaatgcccatggcattctcctaaatgcattttaaataccatctctgtccttcagcacagaatgcccccctgcttttcacacagcgagctcctgtctttctctgagacgcctgtgagaggcttcttcctccagggtcttcctcagagttgcccaggcagactctgttgcttggccattccaaagccacttgaaggattagctaagaaagttgtatttttccgttgttgccataaataccaccaattttgcagtttaaagcagcacctatttatttatcatctttaaaatgaagtcagaagtccaggtacagtctggctctgctggctcctctgcttagaatttcataaggccaaagtcaaagcatcttcaaggctgccttctctcctggaggccctgagggtgaatctgtttcccagctcattgaagctgttggccaaatccagttcactgtggctgctggagtgttccccacttccctgctggctggccttagctcctcaatgccacctgagccctgcccatgctttccacatggtccttacagcagccgcagatcaagtcactctcacacttcacatctctctgatttcaccttctgccctatatttctgacttaaataggagaagtttctctccttttatgggctcatgggattagatgggccccgcttggataatccagcatcctctccctattttgtggtctgtgacctgtttcaggttccaggacatctttgggggccattctgcctaccataaaggtttctagtgcttgtagtctggagtggctgcctgggtttaaactccagtctgccccttactgttgatatcacttttggtaagttactttacctctctcctgtgcttcatagttctcatttgtaaaatgggggtaatagttgtagctttactgtagagtttttatgatagtagtgaagggcagcaacagtcttagacagagtcagtgcattcctttcatggggctcaggatccaccagactccgcatggacagccctgcaaagcaagctcctcagcttttagcccattgaggagcaagctttcagggccttctagtccacacattgccccactgacggtactccctcatcaaagaaagggtctcctaggtccaccaggaagccccctgacgggctcacagtggtcatcgatgcctttccatcccctctccacccttctgaattccccagctacacacttgcctgcctctgtgagtgggcatctgataacaatcccagtaaactcctgaatgccttccacaagggtgaagtaagattgtcttcggatatcagtctacatacatttatatattttcttgagtataccatatttgatattgctagtcaggcatttattatatgcaatcataattatttttacgtttgtctcattagaccaggaacattttggggagtacccagtcttattcagctttgtgtcccaataacagtgcctggcacatggaaagcattatttgtttttcaaaagaataactaatattatactcaaaatttgctaatcatctacattttatttctttcttcctcacctatttcaaaggtatctgaaagttagaaaaatatatatagtgctgggtattttatcatatatgaagttgttaatatgccaattatattatgtttgctacgcttcatgccaagataaagaaatttcatcctttatcttcagtaacagttgttagagtgttgattatatcatctaaaatatttgtaaaattgtaaaaatttataaaatctaccctttattttttccatatgcaatatgaaatgtagcttatgaacatactgaacccataccttctctaaaatctagagttgaggcagagaggtacagaatatgtgtatatgttctagcaaatgacaaattaggaaataaattatacccctcaattattcctgtgatgtacatggaaaaaatatcatgaataaaaaggaatttaatttcttgaaacgtttttcaagaatataactggtgtaatttgtatgcttcagtatcacccagtgtctgtctgccatctgtttatctttttcttcttctttctgtctccttcccctattcccccttccccctcctcttctgtctcgtcttcccaacctcccgtccccaggaaaaaagcttttttatttgattctaagatttattaccatgaaaacattgtgaggaagagaaataaatcttgccataaatgtgccttgtgtatcatttggaataatagatgcagtgacacctcacaaggggttttacaaccagtgattaatatctactccaatatatttctgctttataatacacttgggcattcttgtttgggaaaattgcctactcaccatgtaggaaaagaacattttcttcccgattgcaatgtaattgctaaaaatcaatctcagaatcaagagataaaacctccaaaattctttaactgctcctgctgtttctgggctatgtggcaggtacatatttctattcatatggtatgactgagtgaaggctgtaagtcctgaacatccaaaggtaaaatgtaaatatagaatcaagcaaaaaattttgcagtaagcagagaatgcacagcccaggaactttagaagtagacagtctagtcagagtttcaagagctttatctctcaattgtcataagacctcaagtaagccttggttttcttacctaaaaaactgaatgatgtgacgattaattgaaatacgtaaagcacttagtgccaggtacatagtaagtgctcagtaattgttagttatctttataataccattattgccaggtgcagtggctcatgcctataatcctagcactttaggaggctgaggtgggtggatcacttgaggccaggagttcaagaccattctggccaacatggggaaaccctgtctctactaaaaatacaaaaattagccggacatggtggcgcatgcctataatcctagctacccgggaggctgaggcataagaatcacttgaacccaggaggtaggaggttgcagtgagctgagatcacaccactgcactctagtctgggcgacagagtgagactcagtctcaaaaaaaaggaaaaagtgtgtgtgcgtatatatatgtacatgtatatatgtatatgtgtatatatatgtatacgtgtgtgtgtgtgtgtgtgtgtatgtaaataaaataccattatttagtgagacaaaccagttaaaatttctcctggtacagtaatctccatcaaatgtaaatagaattacagcataataaattttctttgtacatgagaatttggttccagtataaacaaattagaatcctcttttatgagaaataggaaaaggggaaccataaaaagtaccttatggcaaagggcagagaaatgaaaggtttttgcaattaaattctggcaaatattaaagggaactggaggaagcaatcacaagtcttaaaaatatactccagtaggctgggcgcggtggctcacgcctgtaatcccaggactttgggaggccgaggcaggcggatcacgaggtcaggagatcgagaccatcctggctaacacggtgaaaccctgtctctactaaaaatacaaaaaattagccagcctggttgcaggcgcctgtagtcccagctactcgggaagctgaggcaggagaatggtgtgaaggcaggagaatggtgtgaagccaggaggtggagcttgcagtgaaccaagatcacgccactgcactccagcctgggtgacagagcgagactacgtctcaaaaaacacaaaacaaaacaaaactccagtatcatttatgaggaatgaagggttagtagcatatgctttggaattaggttaccatgatagagctaagacggcatgtgagtgtgcattaggcctggaaaactcaacttaaacgtactttaatcagcaggcagaaggggagaaaaattagggaagttctgtcttttttatcatgaaaaataagaacctcccagaacctcctagaagactttcatttaggtctcatgggtcagaactgtgtcatgtggccacccttgtgcataacggggcctggaaaatcaagtgtctcttctggggctggatgccctactattctggatataatcagatttctgttaacaagcaggaagggtgtggggactagatacgggctaggaactaccttatgggttctgccactgcaggtattaaagaggtatcccctatttattccttctcatgcaaatgattctgcatctctttgattacagtagaaaccaaaggtcaagacacaggaggcctaagttactaacatggagtcaaaaagtttttaagaagttggatggagaaccagacagttactctttttggtgcattcagtaacagaagcaaagttaaatacatttacaagcacatcaccaaaacaatagggaatggcaaatccagaaagcattgctagtaagtaaagattgttaagtgaatgtgtttgtccagttaactcataatatcacctttaaggtgggtgaaatattgatactgtgttttttggtgtgccatctttatcatttaagtgagcataattatgaagattttcatgaagctctccttggccttagatttctaactcagctttcgctataagggaaggtattttaccaccatggttgagtaggaattatcgtaatttacttattaccttgaataacatttaatgaaaagatacaattttgaaagctaatggtatgttttagtcacttaatagaattcattgtcttgcctacctattttagtcttgggcaactaataaatataatgtcaaaggggaaagtcgtattcagtacttttagcaaaaatatatgcctgtaaatatgcacgttgaaatcctctttggcacaattggttggtctcaaaatagatttgcccatctctgaatgcttagctattactttcaatgacttaaaaatgtagacaaggatggaggttttatggtatataatatgcagctggagtgcaacaaaagaaggtacatatactgcattgttttttttttttttaacttaaaaggtgttttaggggatttatactttaatgatgggctaagaccctggtggaggactccctgtataaaacaactataaaacttgtatataatataaaaagcaactactcaaaggcactggagactaagcagactgcagtgtaattggttttttgtattatgtccagattctatcgaatatgttacagtgcgtgattggaggaggagggaggttctatagagtgcgttacagtgagtaattggaggaggagggaggttctgtagagtgcattacagtgtgtgattggaggaagagggaggttctgtagagcgtgttacagtgcgtgattggagaaggagggaggttctgtagagcgtgttacagtgtatgattggaggaggagggaggttctatagagtatgttacagtgcatgatcagaggaggagtgaatttcttttttttttttttttttgagatggtgttttgctctttttcgcccaggctggattgcagtggtgccatctcagctcactgcaagctctgcctcctgggttcaagcgattctcctgcctcagcctccccagtggctgggattacacgcgtgtgccaccacgcctggctaattttgtgtttttagtggagatggggtttcaccatgttggccaggctggtcctgaactcctgacctcaggtgttctacccaccctggtttcccaaagtgctgggattacaggcatgagccaccatatctgggcggaggagtgaatttctgtagggtatgttatagtgcattccctgtgaaggaagtttctgtgtccacgtcttttatcctggagctaagtttcatttacatggtgcactcagtggcggcaggggttgcctatggcaaaatcacattttccgggaaccagaaatctaagatgggataacaggctgatgagataatgaggaaaagggatgagccagaggagggatccaaaaatcttgtctgtgtacgtatccaatcaaattctgaacaatgcgtgtctggaacagacccaaagaagcttagctaaagacgaaagatagaaattgagaggagagctgctgccccagaaacagaatttgcaattcaatacaagcaagaaaacagtgtacaaattaacattccagatgcagggcaaagttacctgctatctgtagaaccaggaacatagtgtgagagagaaaaataggttttcctcttacccctcggagtttttagctgggacagacccctgtaacaaaagacaaattaacaagagaaaaacaaataagtgttttaatgtgtgtatttcatatatacatgggacgtacccagggaatgagtgtatctcacacagatggcttaacaaacccagcttatatctcatcttcagcaaagagcaatgcgtttttagagcagtgacaagacaaaggacagggactttgagtgtctgggatgcaaatcatagaatggcaaacaaatgaggtttgtgatgtagatttctctggtgccttctccaggctgatgccttccagagatttcttcgctggttgggagggaaggagggacaccgtttttaagtcctgcttttaggtaggtgcgggaggggagagagctattctggcatctacttctcagttcaaattcatccttatgtcaaaatgaatgattttgaggaggcatattctgcttttctacataaaagacacattttcaaaagaaaagaacattaactgggtccaatcctgaaaagaaccagatagtgaaactagtatgcaaggattttaaactgactgctataaccctcctccatgaaataaaacaaaatatgctttcaattcatgaaaaatgaggaaatctcagtagggaagtaaaaaccattaaaaaaagagtctcatggatattttagaactgataaatacaatatatggcatttaaaagttactgcatggccttagcaggggagtggagaagactgtcagtgtcctgtgagttctgcttgcccgctgcccacacagagctgccttatcaagacgggaatcacaatttgtattcacacaaagccagctgaactggagaccggagtttttttactcaaatcagtgtctctgaaaacttggaatgaggtttttaaaggataatttggtgggaggggacaagggagtgggagtgctgattggtcggatcctagatgaaatcttaggggtcacagtgggttcttcttgctgtcttctgttcctgggtgggatcacagaactggttgagccctgttaccaggctggatggcaccagctggtgcatcagaaggcagggtctgaaaatatatctcaagcaccattcttaggttttacagtagtgatgttatcctgaagagcaattggggaggtttggaatcttgtggcctgtggttgcatgactcctacaccataatttctaatcttgtggctaatttgttagtcttaaaaggcattctggtccccaggcaagaagggagtttgttttgggaaagggctgttatctttgtttcaaagttaaaccgtaaattaaattcctcttggccagcatggtggctcacgcctgtaatcccagcactttgggaggccaaggtgggtggatcacttgaggtcaggagttccagaccagcctggccaacatggcaaaaccccgtctctactaaaaatacaaaaaattagtgggacgtggtggtgatacagctctgatgactggaggaacaccagggtcctttgtctcacgctgatatagataacatgacacagacatatgtggagtggttttaaggagcagagagtttaataggcaagaaggaaggaagaagctcctccttacagaggcagagggagggaggctccaagcagagagagaaaaccccatgtgtggtggatgaggaggaatggtcagttatattgggaggctggaggaggcagtatctgatttacatagggcccaggggattggtttgaccatgtatgtcattcacatagccctcaaagtaattggccctcccaccctagccttttaatatgcaaatgtgggccactatgatgtcctgcacaggtggagatatctgggggtggccatgttgggcagatctagtttttaatccacattagcatatcagtacttgctagcctagcccttcaagccgtttttctgctagaaaataaacatttctggagctgcttttattacaagaaaaaaacagcttgccaaagaccccttatcctatcgcctaaaataatttctgaataactcctataataggggcatgcacctgtaatcccagctactggggaagctgaggcaggagaatcgcttgaacctgggaggcagagtgtgcagtaagcccagataatgccactgcactccatactgggcaagagagtgagacttcgtctctctctatatatatatgtgtaataaaataaattcctctcaaagttaattcagccaacacccaggaataaacaaggacagcttggaggttagaagcaagatagagtcccttaggtcagatctctttcactgtcatgattttttcactgttataatttttgcaggagtggtttcaagacagagggaagagaattagtaattagtgaacttgaaaatagatcaatagaaattatccagtgtgcaaaacagaaaaaaaaaatgaagggaaaaagaaaggcagggatttagggacctgttaaattacatcaaaccatccagctgttggtaattggaatcatagaagggaagcagaggaagagtgggacagaaaaagtatttgaacaaataatagttgagaattttgcacattgaatgaaagatagaaatttatagatgcagggccgggtgcagtggctcacgcctgtaatcccagcactttgggaggccgaggcgggtggatcacgaggtcaggagatcgagatcatcctggctaacacggtgaaaccccgtctctactaaacatacaaaaattagccgggtgtggtggcgggcacctgtagtcccagctacttggggggctgaggcaggagaatggcgtgaacctgggaggcggagcttgcagtgagtcaagatcacgccactgcactccagcctggacgacagagcaagactctgtctctaaaaaaataattaattaaaaaaaaagaaatttatagatgcagaatgcccctcaaaacaccaagaggaataaacacaaagaagcccaaatcaagacaaaggtaaagagcacatcttggtaggagcagaggaaaacaacacattatatatagggaattttactgacggctgatttttcgttagaaatcatggagacagaggagaatgaaataacatgtaagtcctgaaagaaactagtatccagaattcttttttcagtgaaaatatccttcaagaatgaaggcaaataaagacattttaagattaaaacactaccatcatcaccaccaccatgtaaaataatttgttacagcagactgggcatgatggctcatgcttgtaatcccagcactttgtggggcagaggtgggaggattgcttgagcccaggagtttgagaccagcctgggcaacatagcaaaaccctgtctctacacaaaatacaaaaattagccagttgtggtggtgcacacctgtagtcccagttacttgggacgctaaggcaggagaatcgcttgactctgtgaggcagacgttgcagtgagccaagatcatgccattgcactccagcctgggtgacaggagtgaaaccccgtctgaaaaaaaaagtaacagaggtgatacctgatgaaaactgtcgtgggtgagtggcgactttctgggctggtggtgtgggggtgcaagaatttaccaagacagttgttgagtacagaaaggcagatttattagagaaagaaggaaaagatgttgcaaggaggtgacaggccagtggaagagaagctgactgtatcaggggacctgccccgataatcatgtaggttcttttctattttcctaagcgtcgactggctttagaaataaaaggacagagtacaaaagaaattttaaagctgggcgtccgggggagacatcacacattggtaggatccgtgatgccccacaagccacaaaaaccagcaagtttttattagggagtttcaaaaggggagggggtatacgaataggtgtgggtgacagacatcaagtacttaacaaggtaatagaatatcacaaggcaagtggaggcagggcgagatcacaggaccacaggatggaggcgaaattaaaattgctaatgaagtttcgggcaccattgtcattgataacatcttatcaggagacagggttttgagatcaaccggtctgaccaaagtttattaggtgggaatttcctcttcctaataagcctgggagcgctatgggagactggagtttatttcacctctgcaatctcgaccataagagacaggtacgccttgtgggggccagttcagagacctacccctaggtgcgcattctctttctcagggacattccatgctgagaaaaagaattcagcgatatttctcccatttgcttttgaaagaagagaaatgtggctctgttctgcccggctcactggcggtcagagtttaaggttatctctcttattccctgaacaattgctgttatcctgttcttttttcagggtgcccgcatttcatattgcccaaacacacatgctgtacaatttgtgtagttaacacaattattacagggtcctgagatgatatacatccttctcggctgacaggattaagagattaaagcaaagacaggcataggaaatcacaaggatattgattggggaagtgataagtgtccatgaagtctttacaatttatgtttagaggttgcagtaaagacaggcataagaaattagaaaagtattaatttggggaactaataaatgtccattaaatcttcacaatccacattcttctctcatggcttcagccggtccctctgtttgggggtccctgacttcccgcaacatgactgtatggaaacaaaggcttgctgggattggttttacagaatggtggtgtggggtgtgctggagagctttgtgcagtaccagtaatgccaaggctgctgtgagctaagttgtaggtgtctggtcgtaagttgggcacaggagggctacatgttctggaccctgaagaaagacggactttagcttatccggcttttttttgcttcccactgctcctaccagcatgacttcttttccccaattaggactccacatttcccccatgacagagcaacagtgacagatctttggcatgtgggtgaaggtatcatcttccagctgcttcctgctgactaggtcatagagctggccctactaggattgttagttggttgagaagttacgtgggttactgttttggattgtggaatgtaggatattggaccttgctggagaaagggacttgttagagatggggattatgttagggtgaaactggtgttcagctgaatcccagggaaattcgtaaaggtagcaggcattactggggagagattgttatgcaatttgcagcatcatttgaaggtgaaactgatgaactctagaagataaaagtttgggttttttttaaagccagttaccaaaaacgcaaagaaaaaccttttgcagtgtgactttttttggaggggtgtccatttagttaacctggaagttaaacttgatgaaaaagtgtttgaatttaattagacacaggaagagtgtgtttagggttaggaggttatgagtatagcaggggaacacatgactcataggaacagtgtgagacgtttttgattacattgagaatttagataaatgtcaagaaaatccaggagtacagatttaagttatgttagaggaaaacattggttaatgttgaccttcaaaaagaaacgttttagcactaggccacaataacagaactggtggaaaaagttacaggaactgacaaagactgcagaagagagttactatcctaggcctcctccaggggagaaaaagctgaacgcagtgggacacagcaaactgggacacagcaaacgttgaacttctgatatatgcttctgagttttttttggttttttttttttttagaaacttttataaaattctgagtaaaactttttgcagttttattaagagcagattaataccttaagaaaaccttgttttaacatagaggattaatgttacaaagactatcctaaataattttttaaaattataaccaacttaattacatacaaaattccttttataaattctccttcatgaaccttttcatgacttacacagaccgtttatgacatacttggactttgacttgttctaaatatcctttttaaaaaacaaccttactttaagataataatttaccatagaagatttttttctgtaaaatttcttattatacccttccttactaaaaatacctcttttccttttcttctttaactttaaatgagttttcaacgtttacatattagttgcaccataaataatgagtcttagcaccagcaacttggtaacaacagatttaaagcagttaggaagaaagaggggaagagagctttagaaaattctacataactctacattgtaggttaaccatttgagctctgaatttctcttgtagcttgtctatcagtttaaaatgtgcacaaaaacgggccataatatgtaaccagctggagttttaaagaaaatgacaaaatcaggggttaggatgttagagactttttctcttttaaggctcgacccctggattgaacagaaaaagaagaaaatagaagaaaggaatgggccgggcactgtggctcacatctgtaatcccagccctttgggaggcggaggcaggtggatcacttgaggccatgagtttgagaccaggctggccaacagggtaaaactctgtctctactaaaaatacaaaaattagccaggtgtggtggtgcatgcctgtaatcccagctacttgggaggctgaggcacgagaatggcttgaacctgggaggcagaggctgcagtgagccaagatggtgccactgcattccagcctgggcaacagagagactctgttaaagaaaggaatggagaggaaagagttaagctttacaggaggacttgtgaaccatccagccattgcaaggtgcagggccagtccctttactactttcctttatcctttatctccatcagtcagggagagccttgacatctcagacctacatggtataggacgaatttttcccatctcttcaagtcaccacttaaggtgagctgttttcaactggagcagagagccccttcagctcaaggctttcaggggttgggattctgtcctgggagccctttggtcctcaggcctcatttacagtggctgagcttgtggcagagggcacaagtcaagtggggcttttcccgtttatctcattgagggccgtttgcctttgagtggcctgaccctctccactggtagcagtcatttggaggagtatccttagggaaacctggagggggctgggggctttagaacagccaacagttgagcctgcctgtgcttcttgtttgtatgtttttctttttcttcctttttcttttctttgccctgtcctccttatgctgcttttggttataaaagactaaggaagcgaatttgatgtttttctgcataggagccatgctgtgttacacaagaaagttagacatttgtttttgaggatctgggggttgaattcattccagtttttaaaaaatacagcctagaggtgagtctgcaggaataaatggggtctgtcccacagtgggactggaaaaggtgtcactcggggttgactgaactgcagtttctcttaggtcatcctgccaatgaagagggttccgcttatgtccactgagggactctaagactatcagaataaattaacaaagacctaactgtatgttacacaagagatggactttaaatataaagaaaaaggttgaaagtgaatggatggccaagtaagcaagcagtgggcatctgaaaacttagtgactgtgtgaaatgtcccataaaatagctcttagggcgagcaggtaaagagggtgttcagttttgatacttatgttaattaattttgtccagagtgtagcaaaaggtttttgaatcaggaatttcttcctatttacctgacaacaaataaccagtgggcagttcccgggtcccagttcttatctgtggtacaatgcagtgcaggtagggtatgatggccttcatcagcaaagccagtattgtagataaggaaagaaggaaagtaaattgtctgtgcttttttataaaaggggaaaaggcagttgtctccccttccctttctgagagagtctcattagcatcatctttgtttaatcttttcagaatgtacataaatatctgtatggaaaagatgagcccattgtcttcagttttacaagtcagaaatgtctcctggttctggggcctcatggcactttgaaatgtaaacatgcacatccaggattgaggaaacttctctggagttcacacgctgcaagccttagttcctaaggtttacttttagtccagaatcccaaatttcagtagaatttgccctcaaagccctaattgtgcagaaacctaaaagtattttctttacaatctcacggaagaacatttcattatgaaactgagtcggtttgtcaggaagacgtactagccattaatttgcctatgcttaataacagaacttccaaatatatgaaagcaaaaagagagagagagttaaagggagaaataattccatagtcataaggggaaacctcccaattaatagagcaagtagatttataaaaatcagcaaaggtgggccaggtgcagtggctcatgcctataatcccagcactttgagaggccgaggtgggtggatcacttgaggtcaggtgttcaagaccagcctggccaacatggtgaaaccccatctctactaaaaatacaaaaattagtcgggtgtggtggcgggtgcttgtaatcccagttactcaggaggctgaggcaggagaatcgcttgaagccaggaggcagaggttgcagtgagccaagatcgcaccattgcactccagcctgggtgacgagcgaaactctgtctcaccccatctctactaaaaatacaaaaattagctgggcgtggtggcaagcgcctgtagtcccagctactcgggaggctgaggcagaagaatctcttgaacccaggaggtggaggttgcagtgaactgagatcacaccacagcactccagcctgagcgacagagcaaaactgtctcaaaaaaaaaaaatcagcaaaggtaggaaagatcttaacaacactgttaagctacattatttaagaatattgcgtatttctctttggagagactgccaacaatgaataagaatacctattttgtttgctcttagtcttgggacttaattctttttatatatatatattttttaatctggtaagaaatccatggtacttgtttttatttgcatttcattagttactgagtgattgaacttttttttttttttttttttgagatggagtctcgctctgtcgcccaggctggagtgcagtggtgcgatctcggctcactgtaagctccgcctcccgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcggcctcccaaagtgctgggattacaggcgtgagccaccgcgcccggcctgaactttttttgtgtatgcttatcatttgttttttcttttgtatgaagatgttaataatttggggtctagttatgtattatgtttattgttgatttatatcttatattctatgtatttcccctttgtcattaacttttaaaccatctttctgatgttcttgatcttacagaagttgaaatgtttatatagttaaatccatccatttttccttttttttttaattctttgatttctgcaagttgtttgttgttttttgtgattctacttatgagttatagtctaaatagggtattatctcattaaaaaaagtaaccttataaaaaccaagatagactccaaccaatgatgcactgagatggtccaaggaaagtaacttctgtctgttatgtttgtacaacttagactttaaagtatttattgcaacattgtcccattcttgtgaagttaaagttatctcttcttttggatctcagatcattcataatttcataagacggatccagaccaaaattaaagatcttctgcagcaaatggaagaagggctgaagacagctgatccccatgactgctctgcttatactggctggacaggtgaggctgtggggtctaaatcactgatacattttattcttagattatgagatgtaagacttgactgaaattttcttctcttttaaaatggtaaagatttggccaggcacggtggctgacgcctgtaatcccagcacatttggaggccgaggcaggtggatcacctgagcttaggaattcgagaccagcttggccaacatggtgaaaccccgtttctactaaaaatataaaaattagccaggtgtggtgtcgggcacctgtaatcccagctacttgggaggctgaggcaggagaattgcttgaacctgggaagcggaggttgcagtgagccgagattgtgccactgcactccagcctgagccacagagtgagactccatctgaaaaaaataaaatggtaaagattttatatcttttttttttctttttttttttttgagacggagtctctgttgcctgggctagagtacagtgtctgttgcctgggctagagtacagtggtgcaatcacagctctctacagccttgacctcctgggctcaaaccatcctcttgcctcagcctcctgtgtagctgggaccacaggcacatgccaccacacctggctaattttttgattttttgtaaagacggagtctcactgttgctgaggttggtctcaaattcctgggctcaagcgatcctcctgcttcagcctcccaaagtgctgggattacaggcgtgagccactagcctggctgattttataccttttaattgaggtcttgctctatgtcttcaatgatgagatgatttggaattttatttctaaagaaatgctttcttcctgaagtttaaactttaatatctagtgtgtcttttttttataacattatttatttaacctaatatatagctgtctatgaaaatgtgtaactattaagagcaaactttccctagggtcagttttaaaggattctttgctgctctggtcattgtgacaggctgtggtgagtggtctctctgttctgtgatataaactaactaccctactgcctgtactcatttgactcatttgtgcacataaatgtttttatttttattttaatgataacaaccaataatacacttcacatcaaaaaatgtaattgaaaaattaacttgccttaactaatctttgcattcttattattttacccagtattcagaacattctaataattattcggggaatataaaggatataaaagataaccttgttctcagggattagactgaagtccaaattgctaatgacaatttatatacagatttagagtgatttcttgctgaattcttgtagcttaattaataaacagcataggccaggtgcggtggctcaagcctgtaatccaaagcactttgggaggccaaagacggcagatcacttgagctcaggagttcaagaccagcctgggcaacatggcaaaacctgtctctactaaaaatacgaaaattagctgggcatagtggcatgggcctatagtcccagctactgggaacgctgaagcaggagaatcaattgagcccagaggcggaggttgtagtgagctgagatcacatcattacactccagtctgggcaacaggagtgagaccctgtctcaaaaagaaaaaaacaagcaaaccaaaaaccaaaaaaaaacagcatagacagagatatacatgttagagccaccatgaaccaaacatgggcccttgataatattgtatttgtatttatatttacattcatttttgtgaatattgtatttatatttacattcgtttttgtgatgcttattatttgcctattatgcatgcaacatttacatagtgacattacatatttcaaacttataaacttacttcaaacttcacacttataaacccagacagacatggagccagttcacttacaggaccaaagatatcttaaatgtaataaaattagataattgtggctaacctgaagtaaaatacaaagaataaggatattttggaaggaaaataacatagctattagtctcaacgggtttcccctaacaagccttttatttacagctttttcgcttgttgagaaagggtttctaaacccctgatcgttaggttccaaactggctatgcatcacaattaccaagagagctttgtaagaaaccacagttctcagcctccagcccagaagagttacattaggaactctagaggtgggttccagaaatcagtattgcttaaaaatccctagccattgctgtctttaggaatcatcatggaagtatttggtttcagtgatttaaaataatagggtttaggggttcaggtagatgtatggaatccacctagatccatacctcccctaaactgtgtatacgatataggaagaaggctgggcacagtggctcatacctgtaatcccagcactttgggagatggaggtgggaggatggtttgaggccaggagtttgagaccagcctgggcaacataacaagaccccatctctaaaattagctgggcacagtggtaaacacctgtagtgccaactactcaggaggctgaggcaggaggatggctcaagcccaggaggtcgaggctgcagtgagccatgattacactgctgcactccagcctgggtgacagagtgagaccctgtctcaacaaaagaagaagaagaatgaatgaagcacccacaacttatccctttagcaaaactttgagacagaaaacacacaagtcatgttgggtaaaaaacaagcagcatccagaacaagtgtggagagccatggtgtgcaaagaggaagcccagggtccaggcatggctgaatcactccgaccccacccaccctcccagaatcagcaaatagctattccaggcagagtgggccacagcctcagtgggaacttctgtgggcacatctgagtgcagagcgggcaggcggtgtgccaggagaagctgggaataaaggcatggaaagtgcacagggaatggggttggagagctgtagaacaggcatggcttgcggagaagcaggtttagcttgcaaggtggagcggcatccttgctggcccccgctgacagtgtagggaaggaaggaagcagtagcagtgggcactcctgatacaaggaagggtctgagagtcaggaaatctggccaccagactccctgtatgtaacatacactgttcttcacttagcaagaggacactgttgggataaaagttgggaaagctacattaaccattttccccttccagggatttgtcctattaatagttgatatagaaaaattcaattttaagaaaaaatataattattttatccataatataaagaagaaaaataaaaatttctcagtggagggagaaaaacgcaccaggaaaatgtcactacaaagtggagaaaaattggcagtactttcaacattcattttgtaacttagttaagcagtgagttcacaaagcggaggtaaagacattcagagcagagatggctagacagtaagagcatgtgaaataagaattgacagactaagaaaagaaatttaaagaaaagataaaaaatcatttcagaaatgaaaccaaagcgcaaggagccaaagaaagagctgatcccacagagagcaccggggcagagtgtccttgtgtctaggaagggtgtcataaatgtttgcttaataaataagtgactaaatgaaactatcaaggaaaaaaatcaaagagaaagaaagataaagagagacttcagttttccagtctagcatataaagagtttacaagtcaccattgcatcctagcaactaaaaagctgaacaaagtgaaaactaaacagctcttcttagctccatcagagaagtgaggtcacaggggcaaactgctccaccaaaaactggcgaaacaggtggatgccgagaattacagtcatgcatcgcttcacatcatggatgagttctgagaaacgcatcattgagcagtttcattgtgcagatatagaggtgctcacacacacctagattgtgtagccaactacacccctgtgctctgtgagatagcctgttgctcctaggctgcaaagctgtacagcattactgcactgaatactgtagcaattgtaacacaatggtgtttttgtatctaaacatagatatagaaaaggtacagtaaaaatatggtattatgattacgatcttatgggactatgcctatgcagtttgttgttgacctaaactttaaatatgaattgtgggggctcagtgtgggcaagccagagagactaaaaactcaatggggacccagtcatagggggctctcacacttttgtgaactttacctctaggagctccaccaggtcttcatggtgagtatcagagacaactcccctcatgcttctcataggttcgggggaaggaaccatactgaattccatcagagccttcagttcttgacaagccctgccctctggagaaattgcttcaccggagcctctcctgcaaagggtttatcgcagccccgcctacccggagcaagggagatgcctagctccagctggttctagctttcagcattggggaagggagatgatcagctgcagcttctgctggccatcctggccaactgagggcgtggggatgggaggcactggtgcagttcacagtccaaaggcacaggctggccagaaggttgagcctgctcacaggcgcgtgctccccagcacctcccaccacatccctaagggcctgttcattccagctccttttacctagtgcaacgtgtccgcctgccaacaaaaaacgacaaagcatgatgacctttttttttttactttaccttttaccatttgctttaaaatactgaagcattaagtatatataactgtaagtttttaggttcataggttaatcagatcaacatcctatttttagagatttctgagtaaatcagggaatactcatttgtaagcctttatagtgattattatgtttgaaatttgtaagtatttaacttttactgtctgtttcctgtatgcttatattttttgaatacagaaaacatgctctcagggagatgataagcaactcatgctgaagaatttttttttcagagcttccaaatattctactttcatatccgtttgactcaacatctttaaagaaatggataatgatgaaagacttcaaaaagtgttaaggattaatttgaaagagaagttatataccctgaatagaaaaattgaagaaagaagaagctagatatttggagaaatttaaaaagcaaaatgaggctgggtgcagtggttcacgcctgttaatcccagcactttgggaggccaaggtgggcggatcacgaagtcaggagttcaagaccagcctgaccaacatggtgaaaacccgtctctactgaaaatacaaaaaatagccaggcatggtggcatgtgcctgtaatcccagctactcaggaggctgaggcaggagaatcacttgaacccgggaggcagaggttgcagtgagccgagatcgtgctgctgcactccagcctgggcaacagagcaagactctgtctcaaaaaaaaaaaaaaaaaaaagcaaaatgaaaaatagtaaaagcagagtaggatattattagacaaagactagaatattgaagaacctcaacttaaacatgaaagaaatatttcatttgcccttttcaccagcatgtcatctctgtcaatgttggttcctataaaagacttcagtaaatacatatttatactgattctttttttttttttttttttttacttagctgtcatattgtcttctcgaacccagatgtaaggacatgcttctttaagaagccatataggcccttctttggagattctcagattcatttgaagacctgagtctgttctttatctagaatggaaaggttggtgggtggtgaaccacacacgccctttgtactgatcaccttactctgtactgtgtggctgctccagaaatggcgagttcactcaccagttcattggtcagttgtagggttgttcactaaagaacattgaaaaattgggaaaaatagaaaaaaaaataggaagaagggagtataaagttcagaaaagcaatcatttgggataacataggagaaatgattttacaataagtaaaaagaagaagatccaagttaggatctacaagggagaatgaatacaaccttggaatgaatgaaaattaactgaggatgagtaggaagtgatgtatcttctgttgtctgtgaataagaggtattaaatcactgtgccaggacaagcaccaagataacatgtacaaacatggtttctgttctttcctccctgatttctctgtcttggttttattttgtttattcatttttaagaaatatatgaaatgtattgttttggtgttacccgtttggaaacatagatttatgtagaagaaggtatttcatgtaattataaataatgtcctgaagataaaaggaaaagataataatgcttttcttttggggtgggaaattattccaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaagtgagttttagaactggaaacattttctcccaattcccagtggaagctcttgctgtagaaagatattcagaaaggaaactatttttccattcatccattgttgtaaacagatcactccaaaatgttaatcttgagcatagtggtgggatcatatgccctctttttatccaagcatgtgtgtgccttaattttgggaagaataaatatatttccttattttaaccatgtttcctaagcaattttttgttttcttcaatgcatgaaaattagcttacctgctttagattcaccataataactaaactgatgttaggttcaacccttaagtaactgattagatatgctaatgatggaacaattagggaatgtaagcttttattgcacctattggtttacgttcttccttgaagaagcagaaatcacggttcattcctagggtctggtagagtatctggcacgtgctagtcagttaatgtttgttgaaagataggatgacgctgggtatagtggcatgtgcttgtagttccattaacttgggaggctgaggcaggaggatcacttgagctcaggagttcaaggctgcggtgagccatcatcctgtcactgcacaccagccagggcaacagagcaagaccctgtctctaaagaaaaagaaagaaaaaaaaaaagacagaatgacagtctaattcccaagcattggtgacattgcagtccttttttttttttttctgagatggaatttcgctcttgttgcccaggctggagtgcaatggcgcgatctcagctcactgcaacgtccgcctcctgggttcaagggattctcctgcctcagcctccaaagtagctgggattacaagcatgtgccaccacacccagctagttttgcatttttagtagagacggggtttcaccatgttggtcaggctggtcttgaactcctgacctcaggtgatccacctacctcggcctcccaaagtgctgggattataggcgtgagccaccgtgcccggcctgcagtaccatttttatttaaattttaaatcactttcttttacttctggatttcaaaataaaattttatggtttaaaatagatgtaaaggtagaaattaacagaaagatgttttgtttttaattttgacattcaaaaggggactagtaaactggagacgtttttgttgtgttctggatttgggagtatttttaaaaataattgttttaaatgtaaaataaataataggtaattcctaaagcaacagggttagtgtttcaggaagaagtactttagacttccactgggaaaaaattaatttttcttattggttagacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtactatggggtatgggtaactatgggcgtctctaccattcaaacctatttgctagcattgagttgtattaacagctggactttacttctaggtagcattacttttttaaagcaactcatcaaaagtaagaaatagtccctgcttttttctaggaacattaacaaaaaaaatctgtactctctttcatcttgtattaatttatcagtttttactggagctaaacagcagcagcttcagaaagttagaatgtttatttatctttcgtgagatgtctcagctggtaagcatttcaggctggtatgagtggggaccagcttcttctgtctcattctgccttatcctaggggcatacccttatttgcaggaccaaggctagtttagcccctcagcctatgaagggaaaagaggaggtggaggcaacgcagcttccttgttagggactcagtctccaagttgccctctttacttctgctcccatcccagtgccagaacttcatcaagtgtctgtgttcagctgtctctaactagggagccagatgcccagctaaaacttggaatactttcccaaaaaggatgagaggagatagacgtgaggaaacagtcatcccagacatgatattctgttgatctaactgaaatccttcatgccacagcagacctcatatcattagccttttataaataaagccagttcctccagcctttcctgataggtgtatgtgctgctcttttgggaaaaatactgcagctacgaagcaactaagaaatccaaaacagttttataagaagtttttctagatttttcgttgactttttatgcaaagaattttttatttcttagacagtatcttttcctactctgacattggctcctgatttctttttgcctgcatttattaatttataaaataaatataactatattagctgctaactgcttaaagacttttagattaaggcttctgcctctctctctatatatgtcatatatatatgacatactgttaattagactacaacagggtacatatacagttttagatttatgctgtcttgttatctctgtaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcaggtaggtaagaatactcttacacactacagtatatttgatcaaacatgaaatgggaaatgaatcctgcatataaacaaagcagtctggattgaaataccctactttgaatcgctgatgcgtaactctgccacataaaccacaggcagtggatttctaagagtccagtgagttcctgagtacatttggtatggagtcttttttttttttttttttttttttttccaattttcttttttttttttttttgatcattcttgggtgtttctcgcagagggggatttggcagggtcacaggacagtagtggagggaaggtcagcagataagtgaacaaaggtctctggttttcctaggcagaggaccctgcggccctctgcagtgtttgtgtccctgggtacttgagattagggagtggtgatgactcttaacgagcatgctgccttcaagcatcttgtttaacaaagcacatcttgcaccacccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacatggcaaccatccgatttctcaatcttttccccacctttcccccctttctattccacaaaaccgccattgtcatcatggcccgttctcaatgagctgttgagtacacctcccagacggggtggtggccgggcagaggggctcctcacttcccagtaggggcggccgggcagaggcgcccctcacctcccggacggggcggctggccgggcagaggggctcctcacttcccagtaggggcggccaggcagaggcgcccctcacctcccggacggggcggctggccgggcggggggctgacccccccgcctccctcccggacggggcggctggccgggcggggggctgacctccccgcctccctccccggacggggcggctggccgggcagaggggctccttacttcccagtaggggcggccaggcagaggcgcccctcacctcccggacggggcggctggccgggcggggggctgaccccaccacctccctcccggacggggcggctggccgggcagaggggctcctctcctcccagtaggggcggccgggcagaggcgccccccacctcccggatggggcggcttgccgggcggggggctgacccccccacatccttcccggacggggcggctggccaggcgggggatgacccccccacctccctcccggatggggcggctggctgggcggggggctaacccccccacctcccttccggacggggcggctggccgggcggggggctgacccccacctccctcccagacggggtggctgccgggcggagacgctcctcacttctcagacggggcggttgccgggcggagggtctcctcacttctcagacggggcggccgggcagagacgctcctcacatcccagacggggcggcagggcagaggcgctccccacatctcagacgatgggcggcctggcagagacgctcctcacttcctagatgggatggcggctgggcagagatgctcctcactttccagactgggcagccaggcagagaggctcctcacatcccagacgatgggcggccaggcagagacgctcctcacttcccagacggggtggcggccgggcagaggctgcaatctcggcactttggggggccaaggcaggcagctgggaggtggaggttgtagcgagccgagatcacgccactgcactccagcctgggcaccattgaacactgagtgagtgaacgcgactccgtctgccatcccggcacctcgggaggccgaggctggcggatcactcgcggttaggagctggagaccagcctggccaacacagcgaaaccccgtctccaccaaaaaaatacgaaaaccagtcaggcatggcggcgcgcgcctgcaatcgcaggcactcggcaggctgaggcaggagaatcaggcagggaggttgcagtgagccgagatggcagcagtacagtccagctttggctcggcatcagggggagaccgtggaaagagagggagagggagagggagaggagggagagggagaggaggagcctttccaattttctttcggtatggagtcttaaagcagattagttatctgttccccacacttttctgggttttttttgtttgtttgttgttttttttttttttttttttgagacagagtctcactctgtcgcccaggctggagtgcagtggtgtgatctcggctcactgcaacctccacctcccaggttccggtgattctcctgcctcagccacccgagcagctgggactacaggcgcgcactaccacctccagctaatttttgtatttttagtagagacggggtttcaccatatcggccaggctggtctcaaactcctgacctcatgatccgcccacgtcagcctcccaaaatgctaggattataggcatgagccaccgtgcctggcttgcccacccttttcttctgtgcttgtcttcctgttaattgcagtaggaactcttaatggggaaaaatcttcagggagcaacagggcctgcagaacccaactgaggcagagactttgtcatgtcctgataactttgcttgctgtcagttgtcttctgtgcttttgatgagtttattgctgtggttatgatcttgtctctcaaacatccctgacaacgatagagtactgactcttctatcaggccagtagagaccccataactaaacattgcttcaggctgtgcttggcttgagcataagcctagggcttcagcctagcctgtggcctaagttctcttccctgccaagcgcacagccgcctctgccaccgcctcctcctccttcttctcctcctcctccctcctctacctttcttcctgcccactgttctcctcctcctccttctttcttcttcttttaaatttaagctttctttattctgcaaaactacaaaactagtaagtcaaaggatatggattagaatttagatatcttagactggaaaacctatatattactttttaaaattttacttcagattctttttatgtctaacctactgcctcatgttctcactcactaaaggaaaccaggaaattcatacctacacaggattaaaactttttctagttattgtctttgtttattgttgttgaaagtaaaacatgcatatatgcatatagttcattttgtgaattttctttctttttttttcttttttttttgagatggaatcttgctttgtcgcccaggctggagtgcagtggcgccatctcagcccactgcaacctccgcctcctgggttcaagccattcttctgccttagcctcctgagtagctgggattacaggcatgcaccgccacacctggctaatttttgtatttttagtagagatggagtttcgccatgttggccaggttggtctcgaactcctgacctctggtgatccacccacctcagcctcccaaagtactgggattacaggcttgtgaattttcttcatgatgcaggtacatgctttcaaagtaaccagaattccatacctcatttaaaaatggcactgttattttgaacagttagattttgtgtatgtgttagggttctccagagaaacaaccaataggagataaatattatatatgagatgggatttcttaaaggaattggctcacgcaaccatggagtcccagaagccccatcatctgtcatctacagtcctaagacctgggaatgccagggctgtaactccactccgagtcagaagactgagacccaggggagccaaatcccagtccaagggcaggaggagactgttgccctggttgaagccggcaggcaggaaggaacagatgttttctttctctgcctttggttctgttcaggccttggagggactggatgaggtgcacccactttggggagggccatctgcctgactgagtccacaccgttcaatgctaatctcaactggaaacacctttagagacacacccagacaccatgtttaatttgacacataaaattatctatcatagtgtattctgtattttcccgggaaaatgttttaacagtggttcaggaacttttttttttttttttttttgggacagggtctcacttttgcccaagctagagtgcagtgacacaatctctgcctactgcaaactccatctcccgggtttaagtgattctcctgcagccccacgagtgtgctgggattacaggcgtccaccaccatgcctggccggaactttttttttttaatgctaattcccttaggggaacatagtaatgtaagaaccatgccagtgtctttcatgtgtttaggctgattttgctgtatattatggacttccttgggaggaatacaaatcataaaatactccattgatctgcttttaaagtgaggaacttggaacactatgtagtaagtacttgacttagagattgagccaggttttctttcaagattcttaggcagtggcgtggtagagccagcatggggagctgcccgcatctcttccctgctgcacggttcgtggctgttgtcagtgcagaactacgattcagaaatgtggaaaggagggctttgtttctcatacagggttacagcctgcagctaatcatacgtagccttgggctagaagccagaaatattctgagggagtggaaagggagcaggaacgtatgccaagccaggtggccgaatgtatgtgtcggtgagctgcaggaggagtggagtagttgctagagaagtgtgtgcctgcagacttggacttcgtgctccttcttgagatccatgttcagaaaatggtggcacaagcgggatccaagggtagcattttccaccctctgagtcaaaaggtgaagcagaggaacaaaacccctccctgcatgtccttcataggctggccagagcgtccctggtgccttctcaggaacaagtgctggctgcttgggttgttgaagccacagaagatgggggagcagtcaggtggttgtcgctggcagtgcagagtcggctgaaagatctggttcccgcttagcccttagggcagaaagcctcatggggtcagcaggggacgggcagagcagggtgagccccacctcttagcctgtcatgactgggagcttagcttcaaggttgcctcaggcttccttggccaagaaagggtctgctcagtgagttgggggcttagaatttggttcttatttctcattgtctagtagtttagtcatgtaaaagtggtagtttcaactggagggtgtcgttggaaggctatcagaacaatatatgcaaaaactcttaaaatatcacttaaaaagaactccactttcatgatagcagaataaaaacagttcgcctcttgaaaataatctcagaacaaccagaaaaacaacaaaacagaaaccgaagttctttgatgaagctaggggacatctggagctccagctgcaaacctgtgaactgaagcaggcaaaagaatgacagctgacctgctgggatgaaagatggcgtcagtgcccgagggggacggtgcccacgagaagcaagtcagtttgttctacagaaccccagaactcaggaggggaaagtgccatgtccccagtaggcattgccatacgtgggcttgggggactctctggcacaggaggcttctttgagcatgtgcagtggttggacctctgtgagcacctgcacccagcacagggagggaactgcctatccttcaactcgtgctggagacaaaaggagttaggtctggaaaaactgactaggctcttttcaattcaggaaagccagatgtagaagagagttggagtgaagcacagaactaaaaatagggggcgagagtgagtgtccatggtccagggtgagactgcctctctgtcaccgccagcctcaggcaccgtcacctctccctcaccccaaggggcagcaccacctccaccccactcggggcttgaagtcacttttccgaagaaacaagtagctcagataaaagtttcataagtacaggtatttgaaagcccccattaaaaagttagtctgccatccatgatggttaattttatgtgtcaacttgactgagccctggtgcccagacatgtggtcagacattctggatgtttctttgagggcgtttttgaatgagatttacatttaagttggtggactttgagtgaagccagctgccccataggatgtgagtgggccttgtcaatcagttgaaggtctgactagaacaaaatgctggacccccaggcaagagaggattctccagcactctgctttcagactccagctgcagctccttcctgagtctccagcttgctggccaccccaggcagtttgtggactcatgaagcctctgcagccagttccttggagtgaatctctttctctacttttacacatcccgttggtctacttctttggagacccctggcaatcccccatccagccactccacagtgattcccaccgttccgcagcccctccggtgcactgaggacagcgaggagctgtgccttatgcgtgagcacagaccagtagccgatgagcggacatggcagaaaagccccagcttgaaagatggagacctgaacaagtagaaataaaaacaaagagaaagcaggaagtggaagaaagcttcgaataaataataattcataattaatatcctcagggaaataagagaagctgttgcatccaagaaacaaacatttgagggaaaaagagagctcttgaaaataaaatatataatagctgaatttttaataagttcatgaaaatgggaagcaaagtcacatatcttagaaagcaggcagaaatagacaatgggagaggaaaacgtaagaaagaggattaatccaggaggttcagcatgtgactagtgggagacctagtgagggagaacacacaataggagggaggaaaataacacaaaaatatgctctagaaatgagggacataggctgggcgcagtggctcatgcctgtaatcccagcactttgggaggccgaggtgggcggatcactgaggtcaggagtttgagaccagcctggccaacacagtgaaaccccgtctctactaaaaaaatacaaaaaattacctgggcctcatagcgggcacctgcaatcccagctgcttgggaggctgaggcaggagaatcgctcgaacccgggagggagagattgcagtgagtcgagatcacgccactgcactccagcctgggtaacagtatgagaccctgtctcaaaaaaaaagaaaaaaaaagaaatgagggacatagttgcatattggaaagacctaccagtttcctacacaatgagtgcagacagacaaatccacatcatgcccgttattgtgaaagcttaagataaagggataaagagacaatgcttaaaacattagacgggaaatagctgggtgtagtggcatgcgcctgtagtcccagctactcgggaggctgaggcaggagaattgcttgaacccaggaggtggaggttgcagtgagccgagatcgtgccactgcactccagcctgggcgacagtgaaactctgtctcaaaaaaaaaaaaaaagaaaagaaaaaaacaggttatgtacaaagtccaaaaatgacattggactttgcaacagtttcattgaagctaaaagataaatggaaatgatttccaagttttttttttttttgagacggagtcttgctctgttgcccaggctggagtgcactggcgcgaactcggctcactgcaagctctgcctcccgggttcatgccattctcctgcctcaactcctgagtagctgggactacaggcacctgccaccatgcccggctaattttttttttgtattttttagtggagatggggtttcaccgtattagccaggacggtctcgatctgacctcatgatccacccgcctcggcctcccaaagtgctgggattacaggcgtgagccaccgtgcccggccaacttccaagttttgagtaaaaatgatttctaacgttgcattctgcccagaaagttaccaattaaatgtggagtagagcaaagactgtttaaaacatcctgtcccccaaatttaatttccctgtacttcatctcaggaagctactggagtgtggtgtctaccacaacaagggagtactctaagaaggaggatcagatccagggaagaggggctcccatacaagacaggggagcagaatccccaggaagttgacaggtgcaagtcccaggacagcagtgtcacagaagacctggaaagcagccaattatggagagtcgcctccagggaaagcaaagtcatagtagatttgaccatgtggaaaatcttatcgagagactttttacagagctgttggtgggtatgaaaaagcttaggtactggtttaaagaaaactaagcaaataaaatgtgagaaagttactccaggaaaaactaaaaggtgtaaaagaatatctgtaattcagtgtatttcctgtttcaggagcaaacaatatttgcatagtatagtctgtaaagaacacaggattatggatggtgaccagagtgaaactaaaaatggtgaccagagtgaaattctcttgggaagatcagaggaaggaaagtgtccctcatctgccacaaggggaaacctagaatcagtaactcagggcacagccatgcatggattgtttagaaatactgtggtaatatgaataagcagctaacaaccaccacaacaaaaaggaactcagttgtgtcctaggaacgacatggtctgttggtctttgagataagctcctcaacattttttgacattttaaagtggttctgtattgattacctgtaagaaagtaattttaaaagtaccatgtagccttttggaaataaacttaatgacctatagtttttaaaaagctaatatattctctaagtgtgtatcaggaaaaacacctaaagattttctactaagtatagttttatttcaatgaaatttagaagtattgatattccttaaattagctttccttcatttttaataaaattaactttttgttgaagaaatgaggtttttatttcattctgtaggagatgtcatgttgtaaactttggtgcttatggaatgatgagaatttaaagcaatgcaatattttatttcagttttgagagtactttacgtcacccctgacatgtgcaattaaagccaagtgaaaaatcagtggccagaggcgggttctctatctcagactttagcaatatgcggatttatgtggtgctaacatgtcactttaaagacattgtgtggtgttaacatgtcaccctgagacgttctgtggtgctaatatgtcaccctaagacgtttgtgtggtgctaacctgtcactctaaagatgtcgtgtgttgtgaatgtgtcaccctaaagacattgtgtggcattaacatgtcactctaaggatgtcatgtgctaatgtgtcaccctaaagatgtgaggtgttaacatgtcaccctaagatgttctgtggcactgtcattctaaggatgtcatgtggtgacatgtcaccctgagatgttgtgtgatgttaacatgtcactctgaaggcattgtgtggcattaacatgtcaccctaaagtcattttgtggcattaacatgtcaccccaaagacattgtgtggcattaacatgtcaccctaagatggcgtgtgggctggcatgccaccctaagatgctcacttagcccagctttgccatctgactcttctcaccaggttttttcatgggaagctgtacagtaacttgagactctttgaatgtttttatttaagtccttttaaaaaaacagtgcctcaaaattagcaaatattttccaactatgtttttagtcttagtccctgtagtaaaactttaacacacaaactcagtaataaattctagtaggtaacatttaatgagtgctttcagttcgtaaaaggcagtattgccacaaattgttggatgaaggggtgaggcatgcatttttttcttacaaacaccttaggagttgagtgctatgattattctattttagagataaagaaactgaggttaaataatttggccaagtaacaaagccagtatatagatttgggagaagaggggtacctggctttttaggaggtgtgagccccatggaaggaaatcaagtattggtattttaacaaagcaaagcaacaaaacaaaacctatctactcctaggttcacttgccatttaatcatttcctttactactctcttaggagtgtagtcctaatccaccaaagaagagacaaaatacactataacactaagatttcaaacagttgaaacaagttttgcctaagtcttaaataaccagatagttgaatgaattctaattttatgtgctttttttgttttccaggtaattgatgttttgttagccatgatacaatgtaaaagaaataacttcagagaaaataatttgtgtttcatttttgtttgtttaaagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtcagtgcttccgccgtcacggccgtcccctgtgtggggagccaggtttccctgtcaggttttgggtcttgctttggtaaggccatttgactgtacactaaaaaccttttagaatgattgtttttacaaaataaagtctctgtattttaccactcatcaccactgtcattagtgctgcaagtctgtgtgtgtgtatgtgtgtgattgtgtgtgttaacagggtttatattcatgtgtaaaagaaaacctagatgacagagcagtggtgagatgattttcattctaatgagtatggatatccagtaaggtagtggacaggattataaccaaagtgcttttttgttcattttcacataattttattttcttgcttgaataagcctttattgctggattatgattgtccaagaacttttgagtttaaaattgttatgttattctcaagacatagtggtactcaaatttgtatacgtctggggtactataggaaaattggctaaaccttcactgattaattctcgtaggctttaaatatatttgggcataatattaagagcgctattgatttctgtcctggactaagatttatcatttaagatttatcatttaagttgaagtgatgcttcttttataattttattttgtatttaacacatctgtgtttgtaataattgatgttggagattgttgctcatacatcagagtatatagctgtaacacaatgattgctctgttcaacacagtattttggcaagttctctttgtttaggatagataggtggaattaatggagtggaactcatatttctacctggaaataataagaactgatacctgagtcaattttattttttctttacagctaccgtaataaattacttaggaaaattgtggggaattatctctcatgatttaggctaatttctcagaaatttttagtcctcctacaacaataccaaaatattcaaatcatatataagatatgatcattcaagaaaacaactcagaaagttacgacgtttggtcagtgaaacacaatgaaatgtattttttgaaaataagatgcatcttcctaacagtaccctcacttttacattaaaacataattctgttcaaatcactgcctcccttttttagagttttggagcagttataacttcagtgtcctagagggacatctgtgatacaaatgtccaacaataacgtgtgagcacaatattgactgtacagacaggggccctctgatacttttaaaacaaatatataattgctaaaatgtggaagctcctttttgtcaaactccttttcccttcactttaaagaggctcagccaacacagctgggtgttcccggtggctgatctctgctgccaggtgtgcttttccactgtgtttcaactgagccctgtggagagcaagcaggtgccaggaaccaggctgtcctgtggggacccttcctcctgggcagttccattttcatgagttctgcagacagtggccaccatctgttttcaccactgctggccacttgggagcaagccagcacggctctgccactgacgggctgcaggtggctgcggccagctcctcctggcagggcttctgcatagaataccattcagacaccttgctttgccctgctggttccaaaacaaatttctctcctccagaaagcatagagccaaagatgtcaagatcccatacttagtctttaaaacttaattctgtcctctacattaagattcttgaacatgaggaacgaggaggaatatcagaatcttctgggggtaggaaggcatcagtggtaatttgaaaaagcatatatattttgtatttcaaaatagctagaagagaagatttgaaatgttcccagcataaataaatgataaatgttcaaggtaatggacatcctgaatacatcattacacattgtatgcatgtatatcacatgcacccataaatatgtacaattattatatatcaatgaaaaatttaaaaaggaaaaagcatatgtaatatggtcttagaattgggggtaaaaatacatcttcttcatagtataaactacagaaaataagtgtagactaaagctctctgccagcggagaaacagaccctgcgccgtggagtctgcacatctgtttgcgtctctgagcagagggcgaggtttgtgtttgaccaaggcagggggttcagtgggggaggcaaaactagggaagtacagctctacactgttttctctcaagttacagttaagttgagagggcctccatttattaaagctgtctcttaaaattaggtaggaaatgttcaagttttatgtaataacaagctctaacattttcttctcctggcatatgaagtcctaagttgttcaggcatgcttatgaaggtgtaaagtgttcaagtacttgaaaaaatattattaattatcctttacaaagaaaactgtaagttcagtccagactcacaaaatttattttccctccctgtagatgctcatcatgtgttagtatttagtagggtatatactcttctgtgtaggaacgtgtattacttgttaatttaaagttatgtggtattttagatggccttaaaatgtaaaggtttggccagacactgtggctcacacctgtaatcccagcactttgggaggccaaggcaggagggttgcttgagcccaggagttggagatcagcctgggcaacatggcaaaaccatgtctctactaaaaaaaaatacaaaaattatctgggtgtggtggcacgcacctgtagtcccaggtacctaggaggctgaggtggaaggatggtttgagcctgggaggcggaggttgcagtgagctatgatcatgccactgcactccagcctgggtgacacagcaagaccctacctcaaaaaaaaaaaaaaaaaagaaaagaaaagaaaaaggcaaggttttaacaatattctacattgtattaggaattttattaattgtgaatgattttctaacaaattacatctgacaaaaaatcatgggtaatggtggcaaattcttccttctattcacgttttgagttctagggcattaggaatttgtgtgggtttagccactgtaaacaaatacatttgttaaatgagattgtatttggaaaggtaaatgcaatgtccaaaaaaagcatataatacccccaccagggtgacacgagtgcagtccttagatgctgaactgaatctggcagcagccacagcatcactgcttgtgcccacacgcctgccctgggaagccccagagagaactgcattgggagtgccccctggtggccaactattgtatatatgtcagaaaatgctttcatacaaattctgttcccgaagcttgtttgcaagttgattatttgaaacatggaatgtttttctaggggtatcagaattacttgaaaagtttttttaagctatactttttttcctccttactcaagattctgataccttcttaattttaagcatcacttaaataaatgtaccatagtttatcattgtttttctttcttttttttgagacacagtgtcgctctgtctcccaggctggagtgtgcagtggcgcagttttggctcactacaacctttgcctcctgggttcaggtggttcttgtgtgttagcctcccaagtagctgggattacaggcacacgtcaccatgcctggctaattttttgtatttttagtagagacggggtttcaccatgttgcccaggctagtcttgaactcctgaccttaggtgatctgcctgccttggcctccaaaactgctgggattacgggcatgagccactgtgtccggccagtttatcattgtttttcatcggtttccaggttttggctattaggaacaagctgctatgaacattcttgcacaggtctgtctagagacacatgtcttcatttcttttgggttaatatctaggagtagaattactggatcggagggtaggtgtatgtttagttttagaaattgccactttttccacaagttctggttgttctgcatctgccaacacttgatgttgaaagtctttttaattttaattattttggtgggtatttcattgtggttttatttgtatcttcctgattgaccagggttgattaatgttgcatgtgctcatgggccaattgtgtatcttcctttgttgactgtctcttcatatcttcttcttattattattattttttgagacagggtcttgcactgtcacccaggctggagtgcagtggtggatcttggctcactgtagcctcgaccttcagggctcaggtgatcctcccacttcaaccttccaagtagctggggactacaggcacgtgccaccacacctggctaaatctttttatttttgtaggggtcttgttttttgcccaggctggtttcgaactcgtggactcaagcaatcttcctgtcttggtctcccaaagtgctggaattataggtgtgagccactgtgcccagcctgtctcttcgtgtgttttacctacattgttttattttattttatttttgtctttttgctatttttgaaagaattctttatatgttctggttaaagtccctctgtcagatatatatcgtacaaataatttctccctgtctgtagtttgcctaatcatattctttatggtatcttttgactaatagagttttaaattttgataaaatctatttttcaatgttttctttttatgataattactgtctgtgttttgtctaagaaaccttatctaccctcaggttatatagataatactctcctttaatctttattgttttagattttacctttaggcctgtgatttatctcaaattaagttttgtatattacatgaggtaacaaacgaggtggtttttttttttttttttttttttttttggagacagagtctcactctgtcgcccaggctggagtgcagtggcacgatctctgctcactacaagctccgcctcccaggttcacaccattgtcctgcttcagcctcccgagtagctgggactacaggcgcccgtcaccacgcctggctaattttttgtatttttagtagagatggggtttcaccgtgttagccgggatggtctctatctcctaacctcatgatctgcccgcctcggcctcccaaagtgctgggattacaggcgtgagccaccgtgcccagcctgaggtgtttttttttaaccatagggatatctgattgttcccataccttttgtggaaaagacatttatttttcccatttgattgattttggttcctctatcaaaaatcaaatgacctaataagcctgggtctgtttctggactctattcagttactttggcctgtttacctacatgatattaccacgttgtttttcttattctgcatttattgtaagttttgagatcaggtaacttaagacctcactttgttctttttcagaatcactttgaatattccaagtcctttgtattttcatataagttttagagtccatttgtcagcttctaaaaatggagcctattggagttatgagtcagagtgcattgaatcattgaatctctagatccacttgggtagaactaactgacatctttttttttgagatggagtcttgcttggtcgcccaggctggagtaggtgtgatcttggctcactgcaacctccgcctcccaggttcaagcaattctcctgcctcagcctcctgagtagctgggattacaggtgcccaccaccatacccggctagtttttgtatttttagtagagacgggggtttcaccatgttcgccaggctggtctcaaactcctgagctcaagtgatctgcccgccttggcctcccaaagtgctaggattacaggcatgagccactgtgcctggccagaactgacatcttaataatgttgagtccttctgctcgcaaatgtggtatatctctccatttatattttctttaatttctgtcaatagtgctttatagtttttgctctacaggtcttaacacatcttctgttaaatttattcctagatatgttatttatttacattttccaattatgtattgccagtatatagaaatacaattgcgtttttttttttggagacatagagtctcactctgttacccaggctgaagtgcagtggtgtgatcacggctcactgcagcctctacctccccaggctcaagatatcctcctgacttagctgagtagctgggattacaggtgtgcaccaccatgcctggctaatttttgtatttttttgtagagatggggtttcgccatattgaccaggctggtctcaaactcccaagttcaagggttctacccacctcggcctcccaaagtgctgggattacaggcttgagccactgtaactggccacagctgctttttgtatattgactttatattctgtgctaaattcacgtatcagttctggtagctttttatacattacttaggattttctgtgtacacatattgtatctgtgagttttcttcttcctttccaacctctgtgccttttatttcctttacctcttttattacattggttaggagctatagtataatattgaatagaagtggtcagagtggacatctttgctttattcacaatcatagaaaaaaatattaaatatttccccatcaaatatacttttaactgtttttcttagatggcttttatcagattgaagaagtttccttttattactggttatcatgaagggatgttgaattttgtcatttttttttcctggatttattcaaacgctcctatggttttcctcttttgttttattaatatggtgattttacattgattggtttttaaaagttgagtcaaccttgcattcctagtataaacctcacttgggcatgatttttatccttttctttttattaatattgctacatttggtctgctaatattttgttaaagatttttatgtttcttagtacatattttctttttctataaaatctttgtttttattaggaatcaggtatcaggattatgctggtcacgtacatgagttggaaagtgttttctcttattttcagaaagattttgtgtacaattggtgttattacttgcttaaatgtttgtgggaaaattttttattatgaattcaatttcattaatagaatcattttgcatcagttttgttaattgtgtttttcaatatgttttctcattttatctaagttgtcaaatttattggcataatgttattcatacctcttttttttaatgtttagtaaggtctgaagtgatagtttctcttttgttcttttccttttttttttttttttttggagatagaatcttgctgtttctcccaggctggagtgcagtggcacgatcttggctcactgcaacctccgcctcccgggttcaggcaattctcctgctgcagccttccatgtagtcgcgattacagacacgaggtaccacgcctgactaatttttgtgtttttagtagagacaggatttcaccatgtaggccaggctggtctcgaactcctgacctcaggtgatccgcctgcttcggcctcccaaagtgctgggattacaggtgtgagccaccactctggcctctcttttattcttgatattagtaatttatgttttctctctctcatcagtctagatagcagctgtgtcaaagttgtattgctctttcaaagaaataaacataaattgtagctttatctattttctatttcattgatttttcttcttttctttttaaaacttccttctatggttctgggcccagtggctcacttctataattccagcacttttggaggccaaggtggaggatagcttgaggccacaagttcaagaccaacctgggcaacatagtgagacctcatctctacaaaaaatccaaaattatctgggcatggtggtgccactgcactctagcctaggtgacagagtcagaccctgtctcaaaaaaaacataaaaaataaaaaataaataaaatttctttctatggactttagatttactttgctcttttctaactttttaaagtggaatcttaggttttgtacctttctttttttctaatacaggcatttaaagctttacattttcctctaagcactattttagctctgttcccaaatattttatgtcttgttttcattttcatttagttttagatattccctaattacccttatgatttctcttttgattcatgggttatttagaagtgggttgtgtgtttttcagatatttgagaattgtgtggatattttcatcgatttctgatttaattccattgttgttacagaacatattatgtacgatttaacattttaaaatttacttagatgtattttatggcccagtatttagtctgtcttgacgaatgtcccacgtgcgtttgaatggtctagttgtcaggcatagtgtgctagaaatgtcagttaggccaatggttggatgtattgttcagatcttcaattacagaggtcagcgaacttcctgtaatgacccagatagtaaatattttaggcttgtggtccatgcagtttctgcaaccactcagttctatcattgtagcacaaaagcagccacagccagtgtgtgaatgaaccatcatgacctcactccagggaacttcgtttacagatcagactgtgtgggcttgtagtgtgctgaccctcacagatttgccttacatatttgtttcggctgtttgtttactcagtcatgggaggaggagttttacagtctcccaactgtttattttcttctctttaattttcttagtgtttgcttcatgtattttgaggctctgttctaatacatgtttatgatggttatgttttcctaatgaattgactcttttatcatcatggaatgttccttttatctctggtaatattctttatcttgaagtctactttgtctgatattaatgcagctgctccagcattttgtaattactgtttgcatgacacatctttttgctttcaacctgtatgggacttgtgttatagctagtctaataatctcagtgttttaattggaattagttcatatatatttaatgtaattattgatgtggttggattcagctctgccattttaaattttttaaaattacattttgtgtgtttcctccctctactttttctttcctgccttttttttttttagggaggtagagagattagttggaaattttttaggattctcttttttctgttgactctttttttttttttttttgagatggagtgtcgctttgtcacccaggctggagtgcagtggtgcaatctcagctcactgcaacctccgcctcctgggttcaagcaattctcctgcctcagcctcctgagtagctgggactacaggcacgtgccaccatgcccagctggctaatttttgtatttttagtagagacagggtttcaccgtgttggccaggctggtctcaaactcctgacctcaggtaatccgccagcctcggcctccctaagtgctgggattacaggtgtgagcgccaccgtgcctgggcctgtgttaactctttaactgtatctatttgcgtattttttttactaatgctataggggttgcaatatatatgcttagcttttcataatctccttagagttaacactgagccacttcgcataaactgtaagaaactcataggcaggtggttctgcttcctccagagctttgcactctatctgccatatttataaaatctatgaatgttgtaaaccactaatacaatgttagaatttttgctttatttttaatttaaaaaattgtttttgaagagacagggtcctcactatgttgcccaggctagtctcgaactcctgggctcaagtgatccttctgcttcagcctcctaaagtgctgggattacaggtgtgaactaccataggggctggccagaaattttgctttaaatagacctgcatattttatttgaattgatacaagcaaaaaagatagttttgatatttatttatgtatttcccatttttagtggtctttgtttcttcctgaagatcctgatttctatctggtattatttctttcatcctgtagaattttacttagtataggtttagtgacaacaaattgattttcatttgtcttaaatttgtttttatttcacctttattcttaaatacagttttgctgggtgtggaattctgggttgacttttttttcttttcggtgctttaaaggcagtgttccgtcgttgtccacctctgttctttcaaggtcattctttgcactattctcttgtatggaacatgtgctttttctctagaggctttcacagtttcctcttaattttgggttttcaatagtttaactgttacatgcctagatgtatttgtatttatcgtgcttaagatcctttgaacttgaatttgtaagtgtgtatcttttagtacactggggtgactggccactcttttcctacaggttcctgaggcttttgttttccagatttctcgttcttctctgtaattcggatcagatgattgctatttccctggttttgtattcattcatgatttcttctgttatgtccagcctgctcttaaacccacccagtgagttttgtaattttacctattgatgttttctaggtccagaatatccctttgtttctgtcttattctccctttctcttctgagggttcactgatgatgagtatagttcccttttcatctttgaagatatttctagtaactgcctaaaacccttgtccctatttctgacgtttgggtcatcttgggatccatctgttttgtagcatgggcgcacaggcccaggtcgggtgcggtggaacagggactctagccctgcctctgactccagagccctcgggttttcctttgcattgtgctgtcttttcacactttctgtcctgtactgcccagggaaacttaccatttgggggaggtaatgtggataagtacatggattttgtagcccatgtatgattgctgtaatacaatgtggagaagatgtatctgtgattaagtccaggagcttttttctatagttctgaattcttggatgtctcgctgttagaagtagctgtttgcttagagcatgagtgtatgtggtggcaggagtgggcatggtaggctgctggtgctgagaagcagcagtgcaggctgcattgtgggcatggctctagcagcctcagcctcgcaggcgcagggacggcatgaaggaaccctgttcagtttccctgtggaccatcactcacccaggctccaccagcaggggcagctccagctcactttagggctggcctcactgtgtgatttcagaacacagcctctcaaacaatatcttctcacccattagctttgaccaaatatttccttaggatgggaaaacatgttttcctttacagttcattttcagaggcttaagatgcaagtgacaggatgaagtgtgtgtgccggcacaataccgtagaaagagtaatggttaatcatagccaggaaatagctagcacttcccatgtgccaggcactgttccaggagctccatggatgtgatcacattttaatcttcatagcaagccactgaggtgaaggaatgtcatccctttatagttgagaaaactaagacatagactttcagtgacttatccaaggtcacacagttaaaaggtgacagtagggactcagctcaggctgtctgaccccagagcccacatcttagcagcctttgtgactgatagagggtgtcctgcgtctgattccctaacagcctaactttgggaacatttaatctccctggtgatttgctgtgcctctgtttcccgctgtgccctctgtagacactggtcgcagttctcatgccctgccccccaacctccgcctttttcctgaggcctcagagcccttctcggctgagtgtccagctcatcagtcacaagtagagggacctgacctgccacccaagtagtgatgacctttgtgcctctgattcattgtccaaaacccatttgcactggaatgtgatgagtttagcaggtagggataactaagaacagactctgagaaaaggatcaggaaaacagtacatggcctgtgaggagaaagaagaaaatgtacaagggaatctcaggaagtgaaaacccacagctgcttcttgccgtctcttgccttcactgagcctgcctgtctctgcagctgaccatataaacaactcagggaggtggtgcttgctcctggaccccagaaagctttgtgccagcttccttgggatgggtgaagatggatcttcctagcctggtggtgcagggtcctcaggtcctgttgatgtgtactgatcagtgtattggatactcttgccctgctaacagggcctcactctctcgattgccttctacaagagcagaagttttagagctatgggatgtatgtgccaagaaacaaggaaaacatcttaccaaaaagatatggcagctttaattttaattttaaaaactaaattttagcattactttagtaaaaccgtgaaacagaaggaggacaaggggaataggctaatgcaggggtccccagcccccaggctgtgaattggtactggtccgtggcctgttagggactgggctgcacagcaggaggtgagcagcagcgagcaagcgaagcttcaactgtatttacagtcgctccccatcacttgcattactgtctgagctctgccacctgtcagatcagcggccacattagattctcgcaggagagcgaaccgtatcgtgaactgcttatgcgagggatctaggttgcgcgctccttatgagaatctaactaatgcctgatgatctgagctggaacagtttcatcccgaaaccatcccccactcaccttcctggccattgaaaaatggttccacaaaaccagtcactggtgccaaaaaggttggagaccgctgggctaatggattgagattgcgagattctatgtactgtgttgctggtgtttttttgtttgtttgtctgtttttcacccccagtgccatttcagttttcctaatatcatgccatattctaaccagaaagggaaagtattttgccaactcatcgttgaaactgtctttttaacactgctttgtttttaatttgcccaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaaggtgagggtggctctgttggaactgcttctgaacaaccccgagtgtgcacagaatccagagtccagaagtacaactcctgttccttcttttaacctgtttctcccagttctgtagcttcctctttttcttctggcacagccttatctgtggtttctctgggccacagtgtccctgtctgtagaatggagaggacaaatgtcaatggcttctgaagaatatgtgtcctggagtcactacgtgatgagaattaccacctgtgccatttattggctttatgagtttggatatgtctcttcttcaagcctcagtttcctcatttgtacagacagaaaaaaaatactacccacctcctaaggatgttccaagcagaactgagctaatgtgcagattgtttgtaatcgtcctgccaaaaccctccacggcttcccattgactgcagatggagcctatgctcctccgctgagttgacagagccctgcgcaccttggcccctctctgtgtctctgcctgatctccttgccttaccctgccctctagcccgccataatacagccatgttgccctctctaagaacggagtgtgtcactcttgtttccgctggacctgtcgttaactgttcccttcaggagcactcttccttcagctccttgccatgctgatctgaattgtgacattcttggagggatctttgagaccccccaagtggatgatcactcagttgctcattgtatgttttggcttgtttcttgagtgtgtaggctggtagaacataagcttcttgatcttgtctgtctgggtcactattctacactagtacttggagcagtgcatagcaccgagtagaaactcagtaaacatgcactggacatgtgaagatgaatggcatagagcaagactcagtaaatgtttgctagtatttttattatgtacacatttcacaaaatgtagttgtgtgcacacagaaaaaagattggaagaaaatacactaaagtgtgtacagtgacccttgttagatggaggcattgcggctgatatgttctttatactttttgaacatctattactttctgaagacttctcaaccccagtggaatgggccctacctcgttggtgcactggaaaatgcacacacatctgtggctcccccactgatggaagcatgaaggaggctgtggaagcaaagagggcagggcccaacttggcatagcaggtcagcaagggatgtctcagccaagacctgagggacagctcgaaattaagcaaagggggatgaggaaagatgtgaaaaggagaagaaactgctgttccaaaggcccggaggtgtgagcacccagggcctgtgtgaactacactgtggctggagcacgggggatggggcaaaacaggagccagcgagcggggagcagccagattccgcaggcctgggccagccttgatgatgtgatgatggtagatgactatgcaaatatgggcaatgcgagaagaccgcaggaggggtgagacgcagccggttctttaaagatgaggggtttttcaggtgggccaggcaggggtggcctgcagaggtggaatgcagttctgataaggagaatagcttgggcagagctgcagagcacgaaccagctctgtgtgttcctgactccgtaagcacttcagcctttgggatgcaaagggaaggaaatgtgtggccaaaggtaaaagtcagacaggtgggtagaggccagagaaagttagttcttccctgtagccagtagttctcaaccttgtaccactgggaagctttcaaatcatgcctggacctcactctagaccagttaaatgaggaagcctcagcactaatatttttcaagctcccccagtaagtttaataatcagctagcactggatactgatatggaagatgggggctcatggaagggtttggaatccatattcagactcctcttttggaaagattgctgtagtcccagtaggaagaatgaggcgggcttgggtttccccaaatagtggtttagtaattaatgcaagaaatgttgagtcataaaccaaagcataggttgggataaaaaatgagacatttagaaacacctatgatgtaaagcccacagaatttaacgcatgtttttaaatgtggagaagatggaaatatctgaaggtctttctgttgtctgactcggaaaactgggtagatgggccatcaaacaagctaagagtgagcagattgggaggggaaaagcagagtgagtttctttttacgtgtgctgaacttgatactcctcatgtttattacttatgattcttagtgtacaaatgacccttcaaattatgatagcttaggcacaaaagggaagtttattaaaacgatatggaaacacccattgaagaggtctaagaagaaagggtcaaggagctcagaggagagcacagggagggctgagggccgggggctgggaaggtggagaggctgccaagcagcagcagcagctgtggaggggctgcagtgagaggcggcgccccaggcagggctgaagctgtttcccagctggggccaggggagccagcagctgctgctgagagccattttagagccagggttttttgttcaggatagagcaggcgtttcgagttgcttctggaatcatcagctgaagcggcaggaggaaggtgccagggagaacagagtgtcgttgagccgttcggttttcacctcggacttcccagcagctgtaaggcagaccccactctacagctgaggcagccgcaagcagagccttgctgggcctcacccctggaagagggggtgcagtagcccatggagcccacgctgaatgccctacagctgggggtccacttccctgatgcctgtgaagacattgcattctcatttattgccttttcaccaggtagaaactccagtcttaaaaagaaatccctttcttttcagtttgcagagtggtgtctagattacggagcacacgggtgccgcattcctgacagaccctattcgctctttgaaggtaagagtgagaaaaatgctatagattaaatgtttgggtgaaattggttctcctgcccttgtggactggcactgttcatatttgacctggctcaagtaatacttccaaactgtaaaataatcagcagagtagcttattgctgaaaattatgttgaatctcttcaccttacctattgttttgtgctcctgtgaatgtcttccaagtgttcttaggttttttgtgaggtgtctatgcagacagaacgtagaaggcttgctgttagcaatggaagaaatagtttactcctctgcatttcatctgtaatgttgcatatttaatattggtgtattcatgggaagcttgaataattacttaaatatatttaatatcatataaagaagtatgaataattaatattagcaattagaaatattagtaagtagaaaaaatagcaagagtgaatattgaagaaagttctgaaaagaggagcactgataggcaggcagtgaaagcaacaaggattccagagtccaccacgggcgcagggaagggaagacaggagcacaaacagaagccccacaaacaggcccggatattcgttagatttgtatgtgggtatgggcgtgctttctgtttgctaacattttggtaaaggtttttgcatctctattcatgaaggatattggcctacagttttcctgtcttgtgctgtctttctctggttttggtatcagggtcatactgacctaataaaccatgttgagaagtatcttcttctcttctgttttctgggacagactgtgttaattggtggaagaattggtattagtgtaacttaaatgtttggtagaattctccagtacaaacttctaggtctggagatttatttttctagacttttaaaataaattccgtttttaaaatagttatagggctgttcaagttatctatttcatattgggtgagctgtcatagtttgtaatttttgggaaattggttaattacgtacatgtggtgaaatgcaaatatgtaagctattggtattccttatcatcctctgtctgcatcgtctgtagtggtatgtcctgttttagttttcatactggtaatatttttaaatcatattttagaaatacgagcagaaaacagagcatgtgtcacatgttttgcagaagatgatcttttttaatattcagagaactcataaggaaaaagtacttactagaataaaagttgtagtcctctatgtcataaaaatgcaatgcatttgcatcagatataacagagttaatgcctgaactctaaatggagtttatcaacttgataatagcaccttcagagccccagtgggtcaaaagctttggatgtacagctccctaaaggcgggaagttaataggtcacctccttcccctgtgcctcgccagtgcctggcagacagaactgtgggggactctcaccaaattcccgtcaggggacggagggattattaagccgtgtgcctagcaatgcaggccattgtggcaaactggccggctggaggagccactgggagggctcactggcacctggcaccccttctggaggagctcactcctgctggagtgcaccgcccagtggatccgctgcccacacacctgagcaggaaagccaggctcatccccgcagggcctgctgtagggcctcctaggcttgttatgggtccctgtttacttctcatgggcactcctaggtcagtggttttctaattttttaaacaagtttctggaacctttctttaaacaaaaacttacagagaaggctgggaacaccccagatgaccgtcagtaggaaaaatgggtaaacaatctgcagtgtactgttcagcagtaagaaggggccaactatgaacaggcacagaacgtgaatgaattgcaggaaccctgacgaaggagccagatacaagggctgtacactgtggccatgctcataagagtgccagagcaggcagaactaatccatggtggaccaagaccaggctgctggttacctctggggggaccacagggatgggagggactggagaggggcacttggaacttcctggggtgatggaaatattccaggtcttaatcgggttttgtttgcacatgtatatgcattttacaaacctcagagaagtacattttggatttatgtgttttattgtacgtgaattttacatcaaaagaaaaactgtaaacaaaaaccctgtaagggaggattgttctgatttgagtggggacaggagacctggaggccttggtgggctactagcaccttctccaccccacacccttcctaagctgctgtgagtctagttgaaaacccactgctcaattactgcaatgatttggggtggggattttgaccaaattgaggtttgttaaaaataacattcttcaaatatcaagaagatataaaatgcaactttgagcatatacaggctctgaggggaagctccgtgtataggaatatcgtaattagcagcatccataacttccatagcgattctgtgatgccaccttaaagtttcaagatataagattaaagcccagtaaccagttttttaaatataagatagtgaggaaaactggtgttattatattacctgccaggtgctaaatataaggatatctttggtttttaatgaagtcatctttagagtcctcagcacctttcccacatgcttgcagcccctggtaagggaaatgattaaaagtcactgttatagacactacccttatgccattcctaagaggctcctcattttacattgcaggcatggctggcgctattcactttctctctgatgtcctgggaccagagacatcacggtttccagcatttgaacttgactcttcgaagagggattaaaaggtgcaaaaagacaactaaaatacccatttggaccaaaagccaccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcccgtttggattttacactcaccttcgtgttttaaagaagcctcagagtgcattgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagtacatctcattcatttcttagatttgtattcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgacctatggaa

SEQ ID NO: 38324 - DNA, 7481 bp, Homo sapiens
ttccgggtcggcgctcctgcctccctgcagggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggtacggtccgcgaaaagtgaccctgggactgcgtgcatgcatgcctccggggtggatggcattccgccaacagggtcactccgatagcgcccggcagcccaagcacccttcctacccttcctgcctccctgaagtccagcattaatcccctacccggcgacacccggcagccccttcacccctgtgtacctcgcaggatgcagagattgtgcggacccgggatcccgaaaaactcgcttcctgtgacatcgtggtggacgtggggggcgagtacgaccctcggagacaccgatatgaccatcaccagaggtaggttctcagataccatttatttaacttccttgacctcagctttcctctgtgctccaattcagccatccactgccgtagtccgcgtcagcgaaaagaactgcttcatcactgaaatcaaactcccactaggactacatcatccttccggccctgcctgttcttcacccatctccctggcctgggacctcctttggttcccagggagtccctcaggccccttatctcatctccttccttagccaaggctttttttccatcagcaacttcatcaccccaactaaataaacccatctgtgattaatccattctggtgcccttgctgctgcacctaactgctgggcccacatgattgtggcagttggtgacagttcagatgtgtgaagttttctacttcatttacacccttccaaagggaaatccttcttgctcaagggtagcccattccaatccttttcttctccctcaagcctctaccgcatcaaactgagtgtccctgcctcttttcaaaagaagttgagcatttcctcagtctcccacctcaaacatcctcagctccctcctaccaactaagggaaatttcttcccttctattggaggttaatcctctgtcctgtttccagtctattactttcttctctgggattcttttttcttttctttttttttttttttgagacggagtctcccactgtcgcccaagctggagtgtagtggcacgatctcggctcactgcaacctctgtctcccaggttcaagcgattctcctgtctcagcctcccgagtagctgggactacaggcacccaccaccacacccggctaatttttgtatttttagtagagacgggtttcaccatattggccagagtggtctcgaactcctggccttgtgatctgccccgccttggcctcccaaagtgctgggattacaggtgtgagccactgttggcctatcctctgggatttcatgtcacagttccactagtgtctctgcctctccttccctacagcctaaaacccttctcaagtatcttccatcttgaaaagaaacacaggtgtaaaaacaaaaccctccctcaattataccacaccacgagaagtaattatcttggagagagggattatgatgttttaagtctctctccttttttctttttttagcatacatattataaatgatgtcaggaagaaaccctcccaatatttacagcctaagctctcacccttgcttctcagccacccttcaaaaaacagctgaccgtggcttcacctgttcctttccagttcattcccctcaagcccactctcccagtgtcttctctggaactgctcggcagaagggcaccagttacctcagcaccaaaccagggagctggtaaagggtctcaactgatctctttagcacttggcattattgaccacttccttttatcaaattgtttttaagatggagtctcgtctgtcacccaggctggagtgcagtgatgtgatctcgactcactgcaacctccgtctgctgggttcaagtgattctcctgcctcagcctcccaagtagctgagactacaggcgcccagctaatttttgtatttttaggagagacagtgtttcactatgttggccagtctggtcttgaactcctaacctcaggtgatccacccgcctcagtctcccaaagtgctaggattgcaggtgtgagccaccatgcccagcctcattttttttatttttactttttttgagatggagtttcgctattgttgcccaggctggagtgcagtggcactcagctcacttcaacctccacctcccagattcaagtaattctcctgcctcagcttcccaagaagctgggactacaggcgtgtgccaccatgtccggctaatttttccattcttagtagaaacagagtttcagcatgttggccaggctggtctcaaactactgacctcaagtgatcacgccttggcctcccaaagtgttgggattagaggtgtgagccactgagcccagcctgtatttactcaatatttaataataaaagtcagttaacaaatggagctccctaggtaattctgagatggactggtatttagaaatcatggctgtagtttctgcttccctaacatctgttatatcttttctctattttctgccccactgctgttcaaattcttgccttctttattcacctgaaccattgcaggtaatctccttgcatctgttctccatgctggctggtgcaatgctgtaacatgcacctgcctgcttaaaatcccccaatgacttcgattacccacagataaagtccgatggtctggccctgcctgcccttccagctttttcttttgccattcacttctcacacctgagctgcctttgctgaagttccatcaagacacttgtctctcagccatcattcatgttgttctctctgcttggaatgctttttctctttcaccccttgtctatctggtggacacccactaattcatctttcagaactgacctgaaggctctcctctgaaccctttcctcatcccttccttcctttcccttgtctcgtctagtgagagtactcagggggttgtgtttgtcggcctccggcagatgaatctgaaagcaaggacagtgtcttggttttttatccttaatgtctaataaaacataaaatgtggcagataggaagcattgagttaaccattgaatgaatgcatggagactctagccaaggtccctcacctcagccccacctccctatgctcctcaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaaggtggggacctgaggacagagatgccccccacatgcatttccagcaggccgcctgggagcagtgctcacacagcactcagcactgggcctcgggtcagggttcctggcctatagcaggcccaacactcatcctctccctcagtcaggctcatctcacaagggaatggtgatacctcccctgtctacatcctggggtggttgtgagaagtggatgctgtaatatatggggaagggctttgaaaaccataaagcagcatggccccgtctttttattgacacacacaaacagcaattgctcagcacctttgggtaaacagaggggaggctgcttatgtgtggaagcagatggctcagaggttctggctgccctgaaggttgaggggagtgtatgttaggcaccactgtagttcactagtggcacataaattgggaagctcagctgagaagagttttattatgaaactgtctttggattccaccagtgtcccctgcaagcagcttcctgctcttagggaaagaatatggctagtggccctggcatgcaagtcaggtcgcacagtactgaggacacttacttgtttacaagtcaaagcccaggttcagtcagctgtatttcttgcaggtaggctgttgaattcagttctcagtttttttgttgttttttgttttgagatggagtcttgctctgtcgcccaggctggagtgcagtggcgcaatcttggctcactgcaagctccgcctcccgggttcacgccattctcctgcctcagcctcccgagtagctgggactacaggcgcccatcaccatgcccggctaattttttgtatttttagtagaggtggggtttcaccgtgttagccaggatggtcttgatctcctgacctcgtgatctgcccacctcagcctcccaaagtgctgggattacaggtctgagccactgcacccggcccatcagttctcagttttagcttgcccattttctgccctctgtaactatagagtttttggaatatcaagattttagactgcctgggtcagttttcccttccactgctgaagggtttctaaacaactgactaaatttttgttgttgtttttttttgtttttttgagacggggtcttgctctgtcatccaggctggagtgcagtggcacaatctcagctcactgctacctccgcctcctgggttcaagcgattctcctgcctcagcctcccaagtaggtgagattacaggcgcctgccaccacgcctggctaattttttatttttagtagaaacggggtttcaccgtgttagccaggctggtctcaaactcctgacctcaagtaacgcacccaccttggcctcccaaagtgctgggattacaggcgtgagccactaatcccagcaacaattgactaaatttaacccgtatttttttttgagagactgttgcccaggttggagtccagtggtgccatcatggcttgctgctgctttgaactcctgggctcaagcagtcttcccacctcagccccccaagtagctgagactacaggtgcatgccaccatgcctggctaattatatatcttaatttttttgtagagagggtcttgctatgctgcccaggctggactcaaaaactcctgggctcaagtgatcctcccacctcagcctaaacccatgtttttttttttttttttttttttttgagacggagtctcgctctgtcgcccaggctggagtgcagtggcgggatctcggctcactgcaagctgcgcctcccaggttcacgccattgtcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacccatgttttaactgagcatcaggttgggatccaaaccaagaagagctgggcataggagttactttctcagtgctctgagagtagcacttttctacataccacaggtgtactgttatggaggcctattttgtagggtaattttgcataaagtttctgccccgagactcttgaggcattatcctaccatttattcagacccaggagacaactgctgatgtcatgaggcacattatgggcttccctggaaccctaacccagcaaccagcttttggtgtctagtctcacactcattttctcccacttgacttgtgttctcaaccagagccgctcctgcacctcattaaccgtgtcactgaatacctactcaccccacctggagatttaccagccttcagccacagggacccactcccacagagagcctctagcacctagagaccttccttgttcaaaagttagcagtcccctccctacacgtgttggctttggtttgggctttgtgcagcagaatgagcatggattagaaatcaggtgatctgaattccagtcacagcacaacgagctgtctgagcttcagcgagctgctgaacttgccaattctcccttttctcatccagttaatgttgagagatcctcacagggctgaaagagtgtgtatgaacatactttgaatcatgtaagatttcacataagtagcaggtagcctcaagaaggtttcccctgctgctgccttagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggtaaggtggcctgggaggagacccggagacctgtaagaaccttgggtggggggaaaatgggagcatttgctcctcctaagccctagcaaattccaagtttgggccagcatcatggttctaattctcatcattcccaggcagggttcaagcgtgcaatggatctggttcaagaggagtttctgcagagattagatttctaccaacacagctggctgccagcccgggccttggtggaagaggcccttgcccagcgattccaggtataggccttggaggaggcattatggcttgaggattactgactgccaatcaacaggaactcctgcttcttctaccctaaaccctggagtgcagtggcagacaacctcaacctcttaggctcaagcagtcctcccacctcagcctcctgagtagctgggactacaggcacacaccacctcacccagctaatttttgtattttttgtagagacagggtcttactttgttgcctaggctagtctcaaattcctgggctcaactgatcctcccacctcagcctcccaaaatgttgtgactacaaacatgatcaccatgcccagcctaccttaaaccttctagctatgctctccctctttcaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggtgaggccctagggaaccactctgcagaccttcaggcttgtctcagccttgttaagagaaggctgccaactctgacccctgctgtactccctctttctgcccaggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctcatactgac

SEQ ID NO: 38325 - DNA, 10062 bp, Homo sapiens
gtaaggcgatgctgtagaggctggcgatctccagtcttcacgaatccgcacgtctctccattatccaccgcgcccgcccactgggccccggggcggccggcggccgggtctctcgggctccgcgtgtcgcccgagccgccgccggagcgagggtccctgccccctggggagcggtctccagccgcttcgaagccgccttcttccccctccgtgagtcagaaacaaaggcgggggggcggggggagcgcccgagctgcggctccgcgattcgccctttattctgaactcgcaacgtcagcggcccgcggatggagctgcggggtgcggactgggccgcccacagcgcaccgggccgggggagcggccgcgctgggccgggcgggcgggtggcgggggtgcgctcggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggcgccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcgggtgagtgcgcttgcctgccctgcggccgccgccgcctccgcgctctgacgacccccgctccgtcggcgccgcggcggcctgggagacccacggcccggccgcgcccccgccccggcggcccggtcccctcggcctcggccccgccaggcgcccgcgggggcttttgtttgtttactcgcctcggggggcttcaacttggctgagtttccccacgacccgcacctcccccgcccccgggcgccgggcgagcgtttgcctcgcgctccgccgtggcgaggagacaatgggagagaaaaccagagaaacgccgttagtccccgcgcggcgaggacggggcggcgggggcgcagggcctggagggaacctgggagcctctccgcgcccggccggcgcccctgccacttgcagccccggttgtttattcgggagcgggggaggggagcggggggagttcctcggagtgaaaacctttccgaagtgggagcgaacctggggcggccccccgccccccggccgcagccttcggaggagactgggccgccgaggcggtcgtgagagacggacggagaggaagcgccggctggaatctcctaaccgcccgcttctcatcttgtcctggggcagggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtgggtgcctcttgcctctaactctccgttttctcatagcccccactttgtcactccccaagggctcgcctagcttactccacccccgttttgttccaaaggcaagttcagtggtctcctctctacccccatctcatctgcagagaaaggccaccctttaatgagaagaccagagtgagaattagaagttgagttggccgcttactcagtgtttttttgtttgcaaatacctttctaacaacgataagcccctcccaagatgccccagaagttctaagtgtcccttgctgcctcccaccctaacctggcctcctgcatataggatttcttttctatttctgctgaaacagtttagcctattcgccaccccttcctgtccccccaccttaacccagccagcctcccctttcctgtctgtggcaggagcgtgcacaggtcctgtccgtggcgcatccgccctgaatcacagaaaacacgcaccccgccgtcaggcccctgtgacctcgggtgtgtgagtggcagttattttcgttgaagccagtgtccctaaccagtatgctctctgttccccacccccaccccatttaaaaaaggcaaggaacccattttctacccacttcctgcccacccctccatttgtatcagaagggagagaaatggagttaagaacccctgtatgtctttggatagctttggctgtgtagttaaccatgaaaaccacagtctacactgtgtcaagacctgagctatgataattgaatccagacccatctcccttttttccctaagtcttgggatcaataacgtgtactaatgtggagaaatcagaattgcccctacagtggttagaagtcattccattccctgcctctgtgactgtccaaaggcagtcagtatagcctggaagactgtcctgtgtaccggttagagtggcccttcctcccgccctcacgggaggtattctgtgttccctcacccagggctaactgggaagtcctccctgagttctaacctcttctgctttctgcagtagacatccttattcagtagattatatttaggtaaataaaaccttttatggtattgaaacatacacacacacaccctgagacaaagtactcatctaaaagaacatctactgaggcatctagggaagaactaagctgtgccacagccaaagagatccctcttaagggtattgaaacctagctgtttacacaaaactagcaagttggtgatggaaagtcttaggagtgaggtgagggcacttttcttggtctgtcatccaggcaggaatgcagtggctcaatcacagctcacttcagcttccacctcccaggctcaagtgatcctcccacctcatccttggagtagctgggactacaggtgggtgccaccatgtctggctagtttttgtattttttgtagagacagtgtttcgcgttgttgaccaggctgctctcaaaactcctggcctcaagtgaaccacccgcctcagcctcccaaagtgctgggattacaggtgtgagccaccgtgcctggccaggaggatttatttttaagagttacctctgcccaatcacaaatcctccagaaagttttctccacaattttctggctttctaattaaaaaaaaaaaaaaaaaaaaaaaaaaaacaagtgtcaaagtgtatctcctgtcttccccgaacttcttaattgcaggaaactctagttacgaatcagggagaacttcctacacatcaaagagaaaaacataatagtgaaagggtaagaggaataagacatccattgcttgtttgtatttgcccaaagagcagagtctgggggcaaaagcgtagttgatccttgcttttaggtacagagacagaggaaaggatggaatgacctcagcctaggatatctggtgtcctatgagtcaggaccatctgactggtcatggagccagctgtctcctgctgggaagggcacaggaaagagggactaggcatattgatactatgcttttttagagccagtttcaatgctacagtgggcctggttaaaaagtgaaattgacagagtactctgggctttattttgcccacttgtgaaaagctccagggccaatagaatcaagacacggtgttctgttttgttttgttttttagagacagggtctcactctgtcgcccacgctggagtgcagtgtcacaatcgtagctcactgctgccttgacctcccgggcttaagcaatcctcccacctcagcctccggagtagctgggactacaggcatgcaccaccacacccagctaattttttttattttttgtagacatggggtctcactatgtttcccaggctggtctcaaattcctggcttcaagtgatcctcctgcctcaacctcctgaaattctgggattataggcgtgagccacagtccctgaccaagattttttttttttaaggcagagtataatctatatcatttactgttaatgcaagaaaatttctaaccctatctcccagaattttcaccagtctcttttgttatttcctctcttaaaggcagggtctcccacaaccacctctgccgtagaatttcttctgtgttcgatagtaatcattttcttccttctcaaagggcatcctctctcaaagagggctggagcaccttatgatcacaggctgatgtgtaagaacagaagctagaccttaggaagacctcatggtggaggaaattggattcagggcaactctttggacaggcgtgggaaaaatccctttctatagtcaaggacgaagaatcaggggaaaggaagggttaatttggaagatgggtagttataaatgagactctgggaattagatatgtggggaaaaaaaaaaacaatatggtggagaacaaggctgcttggctttgtccatcttcccaggcactggaatatacttgtcctactgcttgcctcaccccatctcccaccctctccaccaagggctaacctctatcagtgtctcctgctccccagagctcctaatcagtctgtatgcaaggtagaataactccctttccttcccttcccctaaggaaaacatagtaagttaactctcttcccctggctacattcacacacccaacactttcctctccacggtttctgggctctgctgatagtctcagctctggagaaggagggggagaggagggatgatgcatcatcttgtatccctgtcccgtgtttctgggaattgctcttggacaccccttgccagcaccttgtcctacttccacccgtaatcattcaaggcctctggccactttccagcccaaagccagggaaccctggaaagtgggaggccctggaggagccaagccttgctgaaacaaatggaggtagatgtatgaggcgtcactcacctgaatggggccatgttgacatctgtcctcatctgtcatcagcctccaggtccagcagcagttcagaaggatgggcagatacaagactgtagatggtctgggtaatggaagggagaaccacttccccacttccaggtttccaggaaccaggaggatagatgagttcacctccatgcacacgagtcctatttcagaacttgggaagttggggactgttttggaaaataatttcagtcagggtgggtagatgtcatccaaggaagacgtgaggctacttttatctgtttgtttagttttaatgagacaagtgctggtgcttttaattctcattccaggaaaacgtgaccaggtttttcctgaggtgttccaaccctgggctcaagccacggagggtggacagactgcacggtctggacttgtaactaagtctcctctctgtaactttggtccttgcaagccaaaacaaatccataagccactgcttcagagtcccagagttgtaggaacaccaccttaggggaaaagagaaaacattgtggtcagtttcagatgaacctgcgaagaaatgttcctagagctgctttgcagtgctcagaaaaggctagttggggttggagaatgtcactaggaatgcggcctcgatgagacgttcagcaggagtgctaagagctaaatgttgcttaaaacctgctaaaggtggaaccagagtgcgggacggagactatagcagggagggctaagtttagataggaggaagagcttcctggcagtaaagggggcccaggcactcaaactggaataatggcaagaagtcacagaagtcacttttttccaagtctaaagtgtagtctcccagggagagtctaagtgcattcttgcctagagatagggggtctggaggagttagtttggattgtcacagtaccttagagggaggaggaaagggtaggaactgtaattgtagttttcagcttctctggacaaattcagcaaactgaacacggggctgccgtcctgtggtggcgatgctcctgaaatgaacaaggaagatgagtctctataattgtacataccagagaaggaagcgaggtggggtgggagagctatactgcacacatgtgagtggggaggccagagaccgcccctcgttccctccagacaccccgataactggccctgccttgatcttctttctgtggaccatcaagggccatacaggtctgtcttactgagggcaatggatcaaccatctaccatgtccctttaaggacgtgagcctttttagaacatgtaagctgtgtccttaaggaaaagagtggggcggttggtgaagagaggcatagtgggactctggaagtggcagcctggctaaggagagtgaagagaaggggtttaaacagaaacacaccttaacattcaagacttggagctgccctagcgtcctcctcgatgtgaggaccttgtaggctttgggcagacggccctctcctctcctggcgtgcctccctctcctcaggcttcctctgtttcccaagatgatctaaactaacagtctgggtggaggggctaaataattttatcctcctcacctcaccccaaccctcccctaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggtatgtttctcctgccaccttggccgctggaacatggacagggttggagggggcaggggagaactccttcccctcagtttctctctcagcaatcttggttcagattccctgaattgctctcctgctggcttttatcatttcacctgagaatattgtagccatttccttctttccaggcaggccaccctttaacctgttcagccacaaagatcatctctctatatatctctttatttttctctgtcttatacacacacatccacacatgtgcatatttacatcccttagaagaaaatccctgtccttgtaccctgataggtggttgaagttctgaatctaattcatcttgtctgagggaacccagggaagttattcctgtcacattctatttcttcaaacattgaaagatttgtattttaatacctatccttcatcagacttcctctaattatctctaataccatactaatattcagtatccttcttagctcctccttggtcatttctaaaacaacctcctagctatgcattttgcaggaatagaagctgggtttccttaagttatggatgactctggaagcagaatatctctccttcctggagctaggtctaagaaagtgagattataatctcttatttcttcattgtcaaggtgaggcaccacctctaaaaccctggctgaaacaggaatcttcccctcacaggcacccaacctgatcttcctggcagtgagtccagaagagaaggaatcgtggatcaatgccctcaactctgccatcacccgagccaagaaccgtatcttggatgaggtcagggggctcactgtggggagagggaggaacgctggggcagagggaacagctgtggcccactgaagggggaggattgtgcaggccccgtttactcgctcctccaccagctctacttctttaccgcccttttaaaagccctgatctctttctaccttctctccaagtctcatctgacacctcctcttccccgcttcatgatgggggagccagccttgggtcagcttaaagagcccccttcgtgtccagtaaatccccttgcccattcagaagcagtgaatggagtgggcacatgttcaggcctcgggatgctgggttgggacagcgagtcgctgaagagcactcatgattcacagtacatctcttcaggtcaccgttgaggaggacagctatcttgcccatcccactcgagacagggcaaaaatccagcactcccgccgccccccaacaaggggacacctaatggctgtggtatgtaagactgtaataaacattgccaaagggccaattctgtgtcagtccatctcagacagaactgtatgccaccagaggcatttgcgggaggcctccttgatgccaagatcaaaggcgagggaagtccttccacccaatgcctctgccagatctaaatcaaaaggttttattcagcgcccattaggagttcaaaagtcccagctcccagtaatgttaccctctttcggagaaaatgagttatacccacaggaaaatgaaaaattagctactgtatggtggctgtcttgatgggtaacaacatgtagtaccgcgggtgtttggaggagaaaggatcacaatgaactcctgaaacatacaacgtgctagtttctttcatgcctctgagctcttaagtcttcagagagagaggcaggcaggtataatgcagagaacacaggctttggagttagaacctgagttggaacctcactgtaatcagctacctgtgtggttccctgaagttgcatgtctccaactgtaaaatgaggcagtaatcatgcctgccttgaagggctgctgtgaggaatgactaaaacaacatatttggtattgaatactcatcatttttagtattctggaaataagagaacaaattttattataaggcaagggggctgaagtgtgggactcagaggatgcagatggaggaggacagtcgtgccatggggagcatcctgtgtgcatcagatgcagtttaattgctgagagtccacaataccaaggaagagggcgcccctcaggaagcttatggtagagtggagaatacaggaaacaagtaacaaactaaatcacagaagaagaaacattcaagtcactatcaaaggaataagaaacagcacattcagtaggagggttcagtcaagagcagagggctttgccaggcaggggggctcacacctgtaatcccagtactttgggaggctgagacggtgtatcacttgaggtcaggagtttgagaccagccatggccaacatggtgaaaccctgcctctgctaaaaatacaaaaaaaaaagagctgggcgtggtggtgcacgcatgtaatcccagctactcgggaggctgaggcaggagaatggcgtgaacccgggaggcggagcttgcagtgagctcagatcgtgccactgcactccagcctgggtgacagagcaagactctgtctctaaaaaaaagtacttctcattcaaggaaggcttgtagaggaaaatgaccacagcttgcatcttttaggcagtcattccgaaaatccctcctgatgacaggttccccactcattccccccttcctccacaggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaactc

SEQ ID NO: 38326 - DNA, 2643 bp, Homo sapiens
ggggcggacgccgctcgccggctggccccatcctccactgcagcagtaacgtcgcggcgggttgcgggtaggactggacgccagagcagccgcgcagcgcctgaaccgctgcgggccgccgcggccgccccttcccaccctcgcctctgctgtctccagcctcgcttctccgactttcctgctcctctgctgccttcgtttctggtcctcggccgtcctcgccgcccgcccagaggagtccccgcgcccgccaagaagccgctttccgctggcccgcagccgccgcgacttcggcacagtttctccctctggctagtctcccaaacggccgctcctcgcccgcgggaagaccaggctgcgaccgcgaacgcccgatcctctccaggagccgcagcgagcgcccggcggccacgccccgcgaccacaccccggcggctctcggcccagcgcgcctgccttcgccgcccgccgtcgctcctcgcccgctgcacgacgacgcgacgcccctgctgcaggcggcggacccgaccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagagagctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggagggacatcccagggcctggagaggaaacctttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgccaggtaaagggttggttggacacagcgcttagtgcacgctgtcatcatggacatcataatcagttgtgaaaaacacgcgaacctatgacacttcttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacatctttgtcagagaatagttcttgttcatactgagtgttctaaatttgaagttatatatacaaattaaaatattttaaaaattc

SEQ ID NO: 38327 - DNA, 6046 bp, Homo sapiens
gcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggtcctcttccaggcctagccaactcactacccttttacctttgccagagcttggccctcgagaggaccggctctggactcagacctggctgggtttgaatcctggcttgatcacttcctgcctgcgtgaccttaagaacgttattcactctgcttatcctcgattttctgtctgcaaaatgggcgtaatatagtgcttactcttttatcaggctgttaggattaaatgagatagagtatgtgactgtcctagcacagtgcctcgttcgtaaggcgtgttcagaaaatgtttctatatatatgcatatatatattatattatatatatattctatatatatgcatatatattatattctatatatatgcatatatattttatatatatgcatatatattatattctatatatatgcatatatattttatatatatatataattttaaagagctggtgtttacctttcagttcacagctcatagggatactgctctctcctgatgggaatacagtgattccttcaacctgcatcttttaaagaccctgaagcttgctgaagttctaggctttggagtcagaacccaaagcactactcattggctaactctgttaccttgggcaacttcaactcctctgaattatagtttcctggtttcgtatataaatgatgtgcattatgaggttaaataagacagtctgtgtaacattcgcagcacataatatatgcccagtaaactggtaattaacaggtgtgctttcattaggtagttttctatacaggaactaagtaggttaaatatgatgttaacagaacaggactggacttttcccacacgttgcattggtgttttggaatttttggaagttatgaggattgaatgaaagttacaatgtgccaggcactgtgctaaaactctttttgagtactatttacatatcacaactatttggatgattaagctctactactgtccccattttacagatgagaagacaacatgggaaggacaagtaggtcatacagagatacctctttagtaggtgatagagcaaaattctaaccctggtttgtgtaacccacagcatctgcttttaactagttggttatactgtctccagccagaaccttgttaacttgggaagagggtgcagagagacacatttattacaaactcacatgattgggtttgatgtgttagtgtgatgcattaaaaaagaataaggcctcagtcagacctgaaattgaaaccaagatcttctgtcttctagctgtatgcctcagggtagtttcaattttctcatgtgtaaatagaggtaatactaccagtctctttggttctgttgattaaatgagtgtgtgacactatcatttattaatcaatacatgtaaattctcttgcctaatttttttttttttttcccttgagacaggatcttactctgtcacccaggctggagtgcagtggtatgatctcggctcactgcaacctctgcctcccgggctcaagctgtcctcccacctccgccttccaagtagctgggaccacagatgtgcgctaccatgtccggttaagtttttgtattttttatagagatggagtttcatcattttgcccaggctggtcttgaactcctgagctcaagcgatcctcctgtctccgcctctcagagtgctgggattacagacttgagccactgtgcctggccatcttgcctaatctttaagaatgattgattgaatcaataaataattgctcagggtctgttatggccctattttacatgccaagataacaatggagatcaaaacaggcaaaaattcctgtccttgtagaacaaactttctagtaggggagacaagaaacaagttaaaaaattaaaatcatttaacatgttagtggtaagtgatgagaaaaaaaataaagcaggggagatttggagtgtgtgtaagtagtaggggaggtaagcagctacaatcttaggcccagggaagccctctgtttgaaggtgacatctgaataaagatctgaaagaagtggggtgagggacctagctctctaggaaggcagcctactcatcagagaacggcaagtgcaagggccattaggcaggagagtgtcaggttaattgaaaaaacactggagagaccattgtgactaaagtggagaaaggtgagggcagagtgggacaagatcacaccaggccttgtaggtaattgtaaggacttttactgaatagagaatttcgtgatctggacttaacaatttctctggctgcttagttgagaattgactatgggggaaaggacaggatcagggagactaggaggcttttgtagtaatccaatctctgttgattaccagggtggtggcagaaggcggtgagaaatggtagattccaggtgtattttaaaagtagagccaaccaggtttgctgatagactagatgtggtgtatgaaagaggagtcaaggatgactccaaggtttttgacctaagtgattttaagaatgaagttgccttttactaagaaacacaggaatgggagaagagaaggtatggaggtggagtagactgttgggaaatcagtttgggatatgtgacgttttagatgcctgttagaccgtatgtcagagttcagcagttggttggatattaagtctggagagttacagggctggaggtaaaattttgggaatcatcagcctttagatagattatttaaagttatctgaccagatgacatcatcaagggagtaaatgtagataggaaagaccagcgaggtccaatattaagagattggggagatgaggaggaaaagagcaaagaaatgaagagagaatggccatagagttagcaggaaatccaagcaggtgtgggcctggaagtcaagtgaagacatgattttcaggagttttcaccatgtcagatgctactgagagtgcactggacttttagtgatgtcagaggaggaaaactctcttcatagtgtgtcttttggaacctctcaataacattaccgggcttaatgaactatggtcatggggcaattggtatttttatgaaatgaaatgtctgtttctggaagacagatctggcagatattaaagcacagagaggtgactagcaaattgagaagtctgccatttgatagtcattcagatacatttatagtagaaaggatgtaagaatagatgcattaatcctttcagctattgagctttaacatccccttggacctaatctgtgtctttaccctcttttttcttgttggcagtataggcataataataaacaatgctgcagaacacttgcatgtgctttcattttaatgtggtgtgataatgtcaatagtttctagaacagcagaagatattttgggactttgtatctagtagtgagtgcttacaccgttgaggaatttcagtctgattaaaaggaacggaagcatttccatcataaggtttttttttttgtttttttttttttttaaacttctgagctgcagctgattatctcagggtaaattgttgtaatttagtttgaaatatgactgtggaagaccttgtgaaattattttagtcctacaaatcatgacttcttgatgttggttaggaccttgaatattcatgttatatattaaagtcttaaagctgattttatttgcttatttttatctgtcagttaattggagagactaattttgtaaaatcacttgggcatttagctaattaaatttatgtgtttgtgggtagatttgctattcatggatagttattctagtataaatatattaaaatggacaattattttcttaagacagtctgattatttttctttaacaactttgacctttctacaaaacttctaatagtgtgaaatgtctgaattaatgcttttcacactaggtcagcttaaaaaacttacagttcagctagcctaccccctccttcatcttcctacagcttatttgtagcctggaaagactattttggtgatagcattagaaagggtcctggaaacaaaatacaaagcatgatagagcatatgaaatctgtttctcttcattgggaatactgcatggttctgatggtcacacttgacaatgaagctaaaaacagtccagagaagaatagatgaaaatgacaaaggagaaaaagtggcttctctgacagttagattaggttagattagttagattaagattaggattcttaaataaacagaaagctaattagtgatatgagccttctacattctgaaggatttgaacaagatcattagaattcaaaaaacaccagaaatgaaagatctttcctgaagctgtttaggaatattcatgatatacccttaactgttctagagaacaaaatgcgtctgtgctccttcacaaaagtccctatgaatttgtttctcaatgtgatccttcttaagttctataactttttgttttcattaattttaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatatatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcatt

SEQ ID NO: 38328 - DNA, 6048 bp, Homo sapiens
gcacttcctgaagctgaaggtcagcatagacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggtcctcttccaggcctagccaactcactacccttttacctttgccagagcttggccctcgagaggaccggctctggactcagacctggctgggtttgaatcctggcttgatcacttcctgcctgcgtgaccttaagaacgttattcactctgcttatcctcgattttctgtctgcaaaatgggcgtaatatagtgcttactcttttatcaggctgttaggattaaatgagatagagtatgtgactgtcctagcacagtgcctcgttcgtaaggcgtgttcagaaaatgtttctatatatatgcatatatatattatattatatatatattctatatatatgcatatatattatattctatatatatgcatatatattttatatatatgcatatatattatattctatatatatgcatatatattttatatatatatataattttaaagagctggtgtttacctttcagttcacagctcatagggatactgctctctcctgatgggaatacagtgattccttcaacctgcatcttttaaagaccctgaagcttgctgaagttctaggctttggagtcagaacccaaagcactactcattggctaactctgttaccttgggcaacttcaactcctctgaattatagtttcctggtttcatatataaatgatgtgcattatgaggttaaataagacagtctgtgtaacattcgcagcacataatatatgcccagtaaactggtaattaacaggtgtgctttcattaggtagttttctatacaggaactaagtaggttaaatatgatgttaacagaacaggactggacttttcccacacgttgcattggtgttttggaatttttggaagttatgaggattgaatgaaagttacaatgtgccaggcactgtgctaaaactctttttgagtactatttacatatcacaactatttggatgattaagctctactactgtccccattttacagatgagaagacaacatgggaaggacaagtaggtcatacagagatacctctttagtaggtgatagagcaaaattctaaccctggtttgtgtaacccacagcatctgcttttaactagttggttatactgtctccagccagaaccttgttaacttgggaagagggtgcagagagacacatttattacaaactcacatgattgggtttgatgtgttagtgtgatgcattaaaaaagaataaggcctcagtcagacctgaaattgaaaccaagatcttctgtcttctagctgtatgcctcagggtagtttcaattttctcatgtgtaaatagaggtaatactaccagtctctttggttctgttgattaaatgagtgtgtgacactatcatttattaatcaatacatgtaaattctcttgcctaatttttttttttttttcccttgagacaggatcttactctgtcacccaggctggagtgcagtggtacgatctcggctcactgcaacctctgcctcccgggctcaagctgtcctcccacctccgccttccaagtagctgggaccacagatgtgcgctaccatgtccggttaagtttttgtattttttatagagatggagtttcatcattttgcccaggctggtcttgaactcctgagctcaagcgatcctcctgtctccgcctctcagagtgctgggattacagacttgagccactgtgcctggccatcttgcctaatctttaagaatgattgattgaatcaataaataattgctcagggtctgttatggccctattttacatgccaagataacaatggagatcaaaacaggcaaaaattcctgtccttgtagaacaaactttctagtaggggagacaagaaacaagttaaaaaattaaaatcatttaacatgttagtggtaagtgatgagaaaaaaaataaagcaggggagatttggagtgtgtgtaagtagtaggggaggtaagcagctacaatcttaggcccagggaagccctctgtttgaaggtgacatctgaataaagatctgaaagaagtggggtgagggacctagctctctaggaaggcagcctactcatcagagaacggcaagtgcaagggccattaggcaggagagtgtcaggttaattgaaaaaacactggagagaccattgtgactaaagtggagaaaggtgagggcagagtgggacaagatcacaccaggccttgtaggtaattgtaaggacttttactgaatagagaatttcgtgatctggacttaacaatttctctggctgcttagttgagaattgactatgggggaaaggacaggatcagggagactaggaggcttttgtagtaatccaatctctgttgattaccagggtggtggcagaaggcggtgagaaatggtagattccaggtgtattttaaaagtagagccaaccaggtttgctgatagactagatgtggtgtatgaaagaggagtcaaggatgactccaaggtttttgacctaagtgattttaagaatgaagttgccttttactaagaaacacaggaatgggagaagagaaggtatggaggtggagtagactgttgggaaatcagtttgggatatgtgacgttttagatgcctgttagaccgtatgtcagagttcagcagttggttggatattaagtctggagagttacagggctggaggtaaaattttgggaatcatcagcctttagatagattatttaaagttatctgaccagatgacatcatcaagggagtaaatgtagataggaaagaccagcgaggtccaatattaagagattggggagatgaggaggaaaagagcaaagaaatgaagagagaatggccatagagttagcaggaaatccaagcaggtgtgggcctggaagtcaagtgaagacatgattttcaggagttttcaccatgtcagatgctactgagagtgcactggacttttagtgatgtcagaggaggaaaactctcttcatagtgtgtcttttggaacctctcaataacattaccgggcttaatgaactatggtcatggggcaattggtatttttatgaaatgaaatgtctgtttctggaagacagatctggcagatattaaagcacagagaggtgactagcaaattgagaagtctgccatttgatagtcattcagatacatttatagtagaaaggatgtaagaatagatgcattaatcctttcagctattgagctttaacatccccttggacctaatctgtgtctttaccctcttttttcttgttggcagtataggcataataataaacaatgctgcagaacacttgcatgtgctttcattttaatgtggtgtgataatgtcaatagtttctagaacagcagaagatattttgggactttgtatctagtagtgagtgcttacaccgttgaggaatttcagtctgattaaaaggaacgggagcatttccatcataaggtttttttttttgtttttttttttttttaaacttctgagctgcagctgattatctcagggtaaattgttgtaatttagtttgaaatatgactgtggaagaccttgtgaaattattttagtcctacaaatcatgacttcttgatgttggttaggaccttgaatattcatgttatatattaaagtcttaaagctgattttatttgcttatttttatctgtcagttaattggagagactaattttgtaaaatcacttgggcatttagctaattaaatttatgtgtttgtgggtagatttgctattcatggatagttattctagtataaatatattaaaatggacaattattttcttaagacagtctgattatttttctttaacaactttgacctttctacaaaacttctaatagtgtgaaatgtctgaattaatgcttttcacactaggtcagcttaaaaaacttacagttcagctagcctaccccctccttcatcttcctacagcttatttgtagcctggaaagactattttggtgatagcattagaaagggtcctggaaacaaaatacaaagcatgatagagcatatgaaatctgtttctcttcattgggaatactgcatggttctgatggtcacacttgacaatgaagctaaaaacagtccagagaagaatagatgaaaatgacaaaggagaaaaagtggcttctctgacagttagattaggttagattagttagattaagattaggattcttaaataaacagaaagctaattagtgatatgagccttctacattctgaaggatttgaacaagatcattagaattcaaaaaacaccagaaatgaaagatctttcctgaagctgtttaggaatattcatgatatacccttaactgttctagagaacaaaatgcgtctgtgctccttcacaaaagtccctatgaatttgtttctcaatgtgatccttcttaagttctataactttttgttttcattaattttaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatgtatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatcattaa

SEQ ID NO: 38329 - DNA, 2952 bp, Homo sapiens
ctgggcggagggcaggagcatccagttggagttgacaacaggaggcaggtgaggccagagtcccagagggagggggctgcagagttctgggacccaggggagctggcccaggaggctgggcagctgaggcagggagggagggaaataactgtgcctgattctaggacagggatgggggtgcagcactgatccaggacccagaatgggtgagtggagggaccttaactccttgagccagggcttgggggagggtgagaggcgatgagttagacctaacaactgaagggtaagaccagggttcctgggtcctggccccataacacataagaaaccaggaaaagcctggggtgctagagctggcagtgggacccagcagaggggactgtaggggcagccagtcacccatgctcaggtggatgctgaaaggcgctgagcatgcagaagagtgagcaggtgtcgctttgggcgtttgtgaattcctgtgtgtatgcagagctccaccatctgggtgagccagtgttaattaaataaggagcaggcgctcaatacatatttgttcaatgaaatcgattacctgtgggagtgtatgaatgtgtgtgtccgtgcaagtgagggacagggtctatttgggtatcagttgtgtgtctaggggggtatagtggatttctgagtttgcctactgtgttttgtaggtgcgtggatgagagctgtgtttgtgtgagtgtgtgaagatgtgggtgtgctctgttgcatgtgtggatgtgtgtgagtttgtggttctgtgtatatgcgtggggtcctggggctggattgagagtggacattgagagccccagagggtgcatgtgcacttggggaggactgtgcatatatcattgtgtgcatgggactcaagggtgggagctgggtgtgagtgtgatgtccaacctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggtaagcacccttcctcgggacccagccccttggaccttggcctgacttggcctccagggtgaaggcttggggtggcactgagaatcaggagtccgtctgcccccagtgccccatgaatcctctccagtttgtacttggccacaggggctaagggaggcctagccttctcgggccatgtcctcaggcctctccactccctgtgtactgcctgggccctctttcttcggcttcaccttccccctctggagaatgacttgctttgaccagtgaaagtgaaagttctggcagcaatgctgagtccttgttcatgtttctcttgccagaaaaacgaggactcagagtttagactcaggagccactgccttgctgtgtgacctcaagcaagttattggccctctctgagcctaagtgggctcatctgtaaaatggaaaaataacactgcctggcacatagagagggatcaaataactgaatctgtcccttcacttccttccagcacccccaacactgtccctgcttccccctccccagccccttcaggcttcagagactcacattctagaagaaaggccaggggtaatggaaaagggaagaggtcctgaccaaagtagaaagggagtctcatggaatcaccctgggcctcctagtccaaagcagaccagaaggatcacatagacatttgcagtaatttgcatccgggcatcctacatgtggtacctgaacctgaagccaagtcaaggtcagtgccccagaggggtatgaagtcctcagccttgggcaggaacacagcagagcagccagagttccatgcatttcccagaacctgacactttcccaagtgcctgttcacacttctctccactttacagatgaagtggaggctcagagaggttgagacacttgcccaaagtcacacagccaatcagaatcgatgtcctgaaggcccaggtgcttcattgccctttatcccatagactcagggggtccagctctctccctgaggaccagtaggcattggactctcacttccaatctggcatttctccccacaggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctg

SEQ ID NO: 38330 - DNA, 45551 bp, Homo sapiens
ccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggtaacggccgaggaggaggcgggcggagcgggccgcgcccaaggggagcgggtggccgaggggcacgctgcctggcctggcagccggggcctgactcggggcgcagagaagaagcatggagagagaagtggggaggagacatgaatgtgtttcagttgagaggctgagaggtacactagctatcaaggagggaagacaagttgggagaccagagttaagtatccgaactgcccacccccgttacaacagcagtgtgtaaaaatcacgccccgggcctctgctcctgaggacggtactcgtgcctctgtccctgtaactacggctcaccttctttctatgtgcagactgctcctaaagccactctgtgcgctgagctctttttctccctgctgcttgactcctgaaccttccattctcctagtttccttctcttgcaaaatggaagccgtagttgggcctgcacattgatcatctgtatcctctatttttatactagagcaatcgggatttctatgcctttcaaccctctcttcatcctctagcaggaccagtcctattctaatcctatcccttgcttgtgactctaccaaaaaatatttttgcaaacacttaagtttgtgtttttctaagaaaactccccttgtggccagtgtggatggtcaaatggagcagggaaaaactggaggcaataaattaaatatttattgatagagtttgtggaggcaggaaaatgagaggcgaataattctgtgtagctggagtagattaataataatgtgttgcaatgtgatatagtaaatgagaaaaagctagttacaaaacaatattcagtatgatctcatttttataaaaaatatgtgtgtagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaactagtttgactggtttctgttccatgcaaccaaatggtccttgaggatgactttttttctaattaagccagcattgaaaatgaggaaactgagaatatcagaggcctagacaagaactgtgatcatgggaattaaaagaagtatatatccatgtctgtagttggagtggtgggggtaagggaagagacaaaaaccatgaccccagttagattgttgtttaaaaacagaaggaaagaagattggggtggggacttggcttcttgctaaactttttggcttttaaagaattgcatcatttgctgtgattggtagacttggcaagggtgggaataatttggaagaagtgtgagaattctggttttacatgagagttttagggagtaaggctccatctttgaggcatttacaggaaagataccagtttactgcttgaattttgggatatacttagtcatgatctaagtaaggtaagatgttttgattatattacagaaggagaaaattgggatgactagaaaacattttcagtccttaagtaggtatagcctagggtaatgtagaagaagccctatttgagagaaggtaaagccaaggagaaggaaaattccatataggggaaatgactgttttggaaaacacatatcccacccgccagtgctctgtgctttgggcccttgtttatctatcccctcttcctgggccagtcttactcctgccgtactcttaagtcaaagcttatgtgtcaggcctctcagcctagtttgggtacttctttgtgctttcattacaccctgtgtttcctggccttggcatttactatgctattggtagtgcttatcttgtttacccactaaaccaacttggaggtcaacatgattctggtacctggaacacctgacaggtagtggacacttagtaaatactctatgaattcatgtaagtagttatggcatgcagcttttcagtcactcaaacctgacctcttacactagcgtgccatagagcctacatttcctacactcagccaaattctttaaagagatatccatatttttgagcactagtatgttccaggccttggggatagatatatagctatagtggatgagacagagtaagtcctgttctcataaagcatgtgttataagagccccttaaaaaaaaattgtgaggctcggcatggtggctcacacctgggaagccaaggtgggaggatcacttgagcccaggagtttgagacaagcctgggcaacatggggagtccctgtctctacaaaaaaataaaaaaggtagccaggcatggtgacacatgcctgtagtcccagctgcttgggaagctgaggcgagaggatatcttgaacctaggaggttgaggctgcaatgagccatgatcacaccattgcactccagcctgggtgacagagggagaccttgtctcaaaaaaatatataaaattaaaaacttgtaattctgtaaaagcagcaaatgtagggtcaagatagaaaacataagaaaggaatctactttaggcacggaagttaggaaaggtgttctagagattacaggaagggagagagctggctgtgcaaagaggagagaaaatgcattctgggggtatagcatgtgcaaaggtcctaaagcagaaaactggtggcatgaggaactgaagatattgaacaaagatttgcatgtttttgtagcacagtagacaaggagaagggcctgtcctctggagtccatgggaggaagagttggggtagtagggattttggattttaggttcagtgggaatgacgtcttctttactttgattacagagtggggggagatgaattatagggaggctggagtagaagcagagagagacactataaagagttgaagtggcctggaagggtagaagctagtgatggagaagagaaggtaggtttgaggtatattttagaattgaattggcacagaattggtacacttcaggaactgtggaagatgaagaatcaaagatgactactgcctagctttggggccaattactgaaattgggaagcttaaaatggaaaatagattgggaggtggaaaagatgataggagtcaaaagtttcatttgtgaacattgtaagcagtggctatgtgagttggagatcgtggaagagatctaagctggagacaaattttatgagtccttgccataaagatgacataaattgattaaaaaaaaaaaaatagagggtgacaaagaagtgggcccagaacaaagccctaggcaacttcagtatttaaagtttgggtcaaagaagagttaaagataagagtatttgtaagtttgggtcaatgtaatggtaggaaagtgcaaaaatagggtgtggaagccaagggtttcaaatagggaatagaaaaatgtcacctggagttaacgtggaggtcactaggcagtaacagcattagtttactgcctaagaagagtaaacattaccactcattatacagaggaatggcttagtttggttttccaataaaagaatcacatgaagacattggaagaggtgagtttaggcgggagcagggatgtcatagggcaaggatacagcatattctcttatggtgacagtaagaaattctggaaagtcaatgtttgtttaagggcattagcctttgaagataaaaggaagctcaaaaaggatgtggaaaaggattaaaaacttttttcctctcccaaaactttgcctgtggggatagtaaacagaattacttacctggagtttaattcctctaaaccaaggcctgtcaggagatgaaaacaaagtttaattagtggacatcaaggtacagactgatgatagtagatgaagtacagtgggaaacacagccagaggcgaccgctcaccacatcacaacttcattgcacctaaaagaatttagactgatcacgtagaatgcagtcttgaatgtctttagggtgaccataaactcacgggttcatacaaaacacctgcagaaggcagttgggtggagggaagaaactgagaagggggcaggcaggttaaccaagagtcttgtatatgtgaaaggaatctgcataaagtctgtagggacctgagggaaagctgagttggtccaaaaaggactagggagatgaatgtgaatcttatacatcctgtgaaaagttaatccgcatctgatttgcactccaatagcatttcattctaaataaactcatgccagtgattcaagatcagaaattctcttcagctgtaaagtactgtgacttttaaaaagctgattattaaatatataccaaaggcttttaacatgtagtaattctgagtacttgctggtactttctattttcaaagtactttacaagctaattatttacaaattgcatatagctgtaacatctaagtactctaattagttggcataatgcacaggttcacacagaatctcgagagatggaaaggtgtctacaaagtggtctcttcagtactgacccaaagagtgtcttgcatctcaagagataggaaagcatatcaagttccgtggcctaccactccccactcttcttttagtttcccttaaacacgttattcagattttagatggtctccagatcactagacaaaagtcttctttttggttagcgtaatttagagtcattctttgtaacaacctttaaactggtctcttaggaagtttacccaaatctacccatctgctttcaagtacttattaagacccccaaacccagccttttcttgctcaaattcttaatgttgctattttcttttcctgctttataaactatcctggtacagttactgcgtgggtctggtttttttttttttctcatgatgaaattcttctcaaacttggattattagatctctaattatttaactatacagtaagtatgtacctaatagtagcacagtcctgagaaatggtggaaataagagactatgagtctgtcctgaaaacccttctgtggttttggagaaggcagacaagagctgtacacatgaaaaagaaaaccaattgtattgacaatgaagtgcccgaatgtgcagtgtggagtattatgtgatgaattcagaatgggatgggtgaaaggcactgctgaaacatctattctttcatgagcactcattctgttggccagtgaagatggcaaataagaattggcggcttatgattaataacaggaataaatggtttccttttttccagtgtaagagagctgttaaagattcttgagctagaactgccgtaaagttttagtttttttttttttttttttttttgtcccatgcctgtgtgcagaatgggtgagtggaaggaaactggaagacagcagtgaactggggacatttgtaatagtccaggtataatgtaaggagggcatacttgtaagagaggagataaaaggatggatacaaaaaaaaaatgcttaaacaaaaaaagtaacttggagacagattctatagaggggtaatagaagagttgtagatgaccccaaaggccccatatccaggttcatttacccctttgtttatcctaccattccctcacaaccaaaaaccagtaaggcaggatttatcatttcttttctccagcctgtccttactaacgggagttagtgggtgcaaccacccttacctccttccccaacccatatcagaagaattcatgtattttacaaggatatgaatccagggctacagatgtgaaaattgagagttaagaagaggcgatcagggcagtgaacagcctggctcttacggtctgcactcaccaagctgcttgctttacagggaatgttttcattaattggctctgtaaatattgagcacatactatacggaggcacagtttaggggccaggatacggcagtgaacaagttggcccacatgcagtttattttctgatggcagagttagacaataaagaaacatgcaaacatttaatttcaggtagtaaactaatgatgacaaggagaaaacactgaatagttaaggaaggcctttctgaggaggtaacatttgagcagagaaatacaagaagagagagaccaaggataaaagagaatgagcccagaatttttttaaaaacctgagcttagattattcagcaatgaaagaaaaattatgaacctttctagaggaataaattgtatatttcagccttgtgtttgtgacttttattagtgcctaaatttatatcatctgtttttaatctgtatatgtatttacctaacaattatagtaaagaatattggactactctgtgggaaggaggatatgtaggatattggagttgttttcgattggctgatacatgtatgtatattggaggggcttattttaattgaacttttttattcttcttttgagacagtcgcactgttaccaaggctggaatgcagtggtgcaatctcaactcgctgcagccttgacctcccaggctcaagcagtcctcctacctcagcctcctgagcagctgagactacaggcatgtgccaccatgcctggctaattgtttgtttttgtttttttgtgtgtggagacagtctcactatgttgcccaggctggtcttgaactcctggactcaagtgatcctcccatctcagcctcccaaagtgctaggattataggcgtgagccactgtgcccagccaaaatagaccttccttaggaacagaaattgatatgtgtggaatcttgggtatcttttcagtaagcataggcatagcaaacttaggcagtataacattggaatttagagctgttggactcacaatgcctgggttttgatcctggctctagacgttagccatgtgaccttggacatactgtttgatctctttgtgcctgagtttcttcttctgcaaattgggataacaataataccatatagggatgttacaagtgttaatttagataatattcaaagtgcttaggacagtacctgaaccataaagcatactctcaatcaatgttagctattaatgttattattgtaatatcattgatgttgagcaagctgggttggtttatattccttcatgtgaaaactttgaaacaaaaaatcttagtagcctgtgtatttttttgttttcttcagtctgtaatatgatttgaggacccctgtatggaaggttatcagtctgttaaacccatagcttttaagaaaaatactttaaaatagcattcttattaataggatatagagaaaagtcgcagacaaattgtgtttctcctctttttaaaaagaaattaagattctgatggaacattcgtaatcatccttaagctttaagataaaggttaagcagaaggaaaagcaagttctgtagcagatgggtacctggcttggtgccaggtatctggactattggtaggtagccagggctcaatctaggtcagttgattgtaaaaactgcattaaaaagactttatttatttatttatttatttatttttgagatggagtctcactctgttgcccaggctggagtgcagtggcgcgatcttggctcactgcaacctccgcctcctgggttcaagagattcttctgcctcagcctcctgtgtagctgggactacaggcacccgccaccaggcccggctaatttttgtattttttagtagagacggggtttcaccatattggacaggctggtcttgaactcctgacctcgtgatccgcccgcctccggctcccaaagtgctggaatagccagcctgattttttttatctagtactgtttctcagtatattccctgttcattatgcaaggcacttagcatatctcaaaaacaaaagctaccttggtgcttttctaagttttaccttcctgactggagtcaaacctcaaaaaaattatgaataatgcccccaccaattttattaaaaggactccaagagaaaatccaacagcctggagcatctaattacacagagattgaactagttggcttaaacaacagcttggggttacaatttttgttttttgtttttttcatgggtgggagagactttctctttctctgctgacctctttcaaggcagtgttgtgtagaggcgaagggtagggactctgaagtcagagggcctgttggctccacacttcctatcttatgaatgtgggcaagtgatgtaacctttctgagcctcagtttcatacctataaaattaggctgatagtaacacctacttcatagggctattgtgagaaataaatgaaataaaacacttagcacaatttctagtacacttaaatactcaaacattagctattgctattgatatatatggttgttgttcaagtcaattagtgggagttaaacttatggtcttcatagtacaggttgtgtcatgttatccataggagccctcctggctggcttgcatgagctgcccgcctcccccaccctgctgtctacccaaagcatcacctgtgactctgccacgctggccttctcacttttatgcatataagcctaacattgccatttcagggccttggcacttgccctttacttcccgaacctctcttcccctaaatcttcacatggcctgtccatttccaaagtcgtttgctcagagagaccatccttgactgggtattagtccattgctgcgtaatagattatcccaaaacttagtggctgaaagcaacaaatacatctcagtttctgtgggtcaagaatctgggtggagcttagctgggtgattttgactcagggtctctgacaaggctgtagtcaagatgtcatccaggctgcactcttgaggattgcatgggagacgatttgcccacaagctcactcatatggggctgctacatgccatggcagctggcttcctgccagagccaggaaaacagagttagagagaacccaagacagaagccagtctttttatgccctactctcagaagtggcattccattgcctctgctctattctgttggttagacatgagtcagtaagtccagcccacacttgagagcgagtacatgagggtctgaataccaggaggtggggatccttggcaccatcttagcggctgcttacccatccgccttctctaaagtggcatgcacacccacatacaaacctccatcactctctattcctttaccttgctatattccttcatagtactcattgtcaactgacattatattatatatttatctatttattgtctaactccacttgaaaaatatctccttggcggcaagggctttgtccttgttcgcttctgaaccccaagcacttaaaactgggtcaggcacacagtaggctttcattaatgtttcttcagaaagtcaatgaataatgtgcatgattacataccagtgtcagagtatgagtaccacaacaggaagaaggactgatgatttataatgacattattttgtacacttatcagctgacatttgcaactcagaaagccaccacagtaacaagcttcaagaagacaaaaaattattgagtgggacaaggaaccatgcctatcctgtggcttcagtgggaggaggagctgaggggaggcaggagtaagcatcatagagagccttgataaaggtggttatgctttatattctgtttcatttttgtcttctctgtgtcctcaagagcctctaacactactatcttcaccaccttgatcccatgcctcatctgttgtcttgtctattggtttaaaaaggtagaatatctcccacttgaagttgattgatggatatttttactttgcaagagcagtatgggagagtgatatgaattttccttgggatcttatccccacagaactctaggagggaaaaagtggtaggattgtagttttgagtaccatgaagtggaattgaaaggatttgattccaaggtatgctgttttttcaatgccgaatagtacactcatttcctaaccagctgtctcgtaaatctatgccatttactacaaatagcattgctttggaaaaataacagaatgcatgcatttgtttttccagcagctatttaaggtccatttgttttccaggtaccaagaaagcaaagacgaatctcatttcatgcctaccttcacagagtttgcaatccgactagaccaaagagctgtgtagtaaagaactgaaggataggtgtcatttcttgtaactcttttacctcattaaaattgcagcaccccccgccccccagcactcctaccttgtattttttctatagcacttatcttctaacatatgagatatataatttacctttttattatattcattatatattgcctttccctctacccctcaaacacacacactgtaacataagctctgtgagagcagagatttttgttttaatgttcactgatgtatccacaacccctggaacaatgcctggctcatagcaggtgttcaaaaaatgtttatcaaatgaatgaatagcagattgactctgtattgtttttacattaaataccccaagagctgaacttgaatttaaaaagggaaataactattctataagcttcgaattgagaaccacaaatttgtggttgtgtgtcttcaactccatagtttgtcacatgtagttggcaagagactgggcctgtccaggaggagtcagacctagaggttcatttaggcaaagggtgaccagagcaggcaaagatagagtgccagaggagtagcctatgcagtaggaaccaagcagatctgatagatattgccaggtagatgattccagaggggtcacctgagctaagaagaattgggcatgttgtttatacacacataagaaggcagggctttgtatctgcaaggccaaatttgactgcaacgcatctcacattaatgagaactgacccccgccaaggccgacaatgttggttttgtgagcacctgttctacccatatacctactgtgtgattttggatttggggaattcccagaccgataatatttcaaaaaaatctaatggggtgaaaggatgtaggattgcttaagttttattttgcccttactttgtgaaatggactttccttcacttccatggaaaattgccagaaatcctagtctttatttaggtgacctgaagcacttgaaggacaaaacaaagacttaaagcattcaataatttgatgtctgttgtgccatttttatcatgtttgctccacaataaattgaacagactcttgcacttttcccttgggtcctcatgagcatttgtctacaactgttaataagttacatgggatctaagaataaattttcattggaattcagatttcaagtgaaggatcacccaacattgcgatccctcatctaacattatttcagatcctgagttgctgctttgttctgcatacttaaacataagtcccggagcttggaatacttaacaaggggtttgtgttgctgttgttgtttccaaaagtgattaaaattggtaatataaaattaatataagcttcatttatctcttcattccctgaagatgaggagtaagagagtaccatcatcatattcttgtcaaagtaaatgagttggatttatattctttatcagaccttgtaattgaagccttctagacttgattctacagttttatttctgctttttgtttattggtttgtttacatggcaaagactgcagtttgtccttaaatggatggaaaatattagggattccaggggcttatgattagaaacttatgattagtttgtttatatggcaaagattgtactttgtccttaaatggttggaaaacataaaggattctaggggtttatgattaggaactgttgtgctgaaaatgtctgtctttagaagtgttagcttacaggtgtgtcactgtctgctgcccagacttgtagcaagcaagcagaggattcccttcctatttccttgttctaataagttggtccccatcggagagcaatgaaagatcagaacaagccagaacatgaggaagccaactagacttactcctggccaaaagcagacagcctaacagacacgtaactgtgactgtaaagtaagaagactgatttgcctcaccaggtaggaaaacaagtttaatcctccttcaaggtagatagtgtcttttcccctttatagaaaaggcaactgagacctggggaagttaggtaaccagcctaaggttatatgactagtaattagataggaactgaaagatggcctgactccatagactctgcttttttttttttttttttggcacatggtctcactctgtcacccaggctggagtgcagtggggtgatcttgactcactgcagccttgacctcctgggctcaagcagtcctcccacctcagcctcccaagtagctgggaccataggttcaagccaccaagcctggctaatttttgtattttttgtagagatggggttttgcatgttgcccagcctggtctcgaactcctgagctcaacctatccacctgccttggcctctcaaagtgctgggattagtcatgagccactatgcctggccaaacttagcttttaatgggcgtgatgttgtcgatgttacctgccttggactcataaagataacagctttgccagagcatatcctccaaggagttcagtttaagagacaaaattgttggcctagctgaaacatgctggcaataggggctgttctttgtaaatcttaaacatgaaaagaatcaaatgaatgagagagtaacttgttaagaacccaaataaaggtttactgacaatacttggtttctgaaaacaccatttttcatattattaaacgttattagtattatctttaaatatgttcattttaactttttcatctatattgtgctaaagcagtacttgatcatcctcaaaatatagaaacttttattcacggattgaatgaaataagggtatgtgttatttgacaggactctggatatgaagtcagaaagctctggggtagagtcagctgttccccttactggttgacctcagacaaggcagcctccctaagccttggttgcctaaacaataaaagggaaacaggaacttcaagggttcatctcagacttggtgaggtaatatatattattcagtaaattgctgtgcacatgatattttagttaacatacataactatcaatagtctatctatgattactattaaaattataactataaaatgattatttttttaaaaattcttaatagatttgttcagtgctctatagttacaaagtaactatatatatatatatatatatatatatatacatacacacatatatatatataaattgtatttaatccccctaagaattctgaaaggatagtagaaatatcttcattttaatcgcatagctttgtgaccttgaatatcacaggatcacagagctagtaggtgcggaactgggactcattttctcaccactatattgtggctgctttcttattctcttaaggttacttgatggtgtcctagatttaaaactgtaaaggaagaactgcataatttgtcttctaaaagcactgagaggtgttttagggactatataaagatagaacagttactgagtaagtctattcagtctggatttttcgggtaagaaattctgctctgaagcttgtgtattgcagatcacaataatcatagacacatcacatagcattgggatagtgttagtgttggtacttaaagtgttgtcctctaaaggtaatgatcctgggctaaaatattataattataatctgtctcctcatcgtttctccctagggtgaccatacatgccatctaggcttaaatattggtaattttgagttaaattttcaaaaaccagatattatttagtgttaggcaagttgttaacttctctaaaccataatttcctcggttttatatgacaaagttaaaccagatggcctctaactctaacatttgagaaacttttcccttacattttttaataatatagattgtatttaatggatctttacccaaacattttggttcaggtaattaaaatgaaagttatagtgaaaagatccttgaaacttttctaaaaacactgggcgttcaggaattaatatagtgtatgtcccgatttctatcaagcaaacgctaagagagaattgtaaatttaggggtctaatatttcaaatgagatgtgaaagtatggtcccaagcatttgtactgaaaatgcagcgcccctttcttggtaagcgtaagagtgtattagactttgggaggaagccaaattatgctgtttggataatcagcatgatctatctctcagaattttcccctgcggtctcaattgggtacctattctatttttaacttagttctaaactctttgttagcattgctccatccaattaagctgcagctgctgttccatccctaaggattgtttatgtttcagtggatgagatggtcctaatatgtacggctacttaaagtatagttttaattcagggacaagaaaagattgtgtttaagtttgtgatattttttaaaacaatgcatagttaaacattggctctagaacatgctttcacatttcccttcttagttatatcatcacatataatttataagtctctgaatgataaagtgtggtttgctgggttttggttgtcttgcagctggtttctgatgccagaatcatcgattgtattactctctgtggtttctttcttttggcagctgatgtgttgttggtatgatatgtgttatgatataaaggtaaaggttggattaatcgtaatagaattttccatgccttgggtttttctccatactatagagattagtctccatgagctgcttccttccttcctttcagttaatctctgcagcctttctagtggttcctcctgtgctgttgaattcagcatctgtaagaatgtgtttgcattgtaccagagctctacaactttggccagctaagaaggaagcatctctgggagctttgaatgtcaatataaaaccttatttgcacagttgtgcacttttggctgacttgttcagtggaccatctaagttcatcactttgaacttttataaacattttccttaaagggatgctgctctcaaagttaggtttatgtgtatgtttaagcgcttaactctattaactactcctttatataaatatggaattttcccaaaacacttgtatatatattaactaagtttttaaaattgtaaaatgggatttaaaattaccttgtcctacttaatttcattgccgtataaattggcaccagaaaaacaacttgaaacttgacggtgtagggtttaaagagttaagaatttactgatgggttttaatacattaaaaaaaattttttttttttagagatagggtcttgctgtgttgcccaggctggcctcaaacttttgagatcaagccatcctcccccatcagcctcctgagtagctgggactacaagcatgtgccaccacactggcataaattttttttttgtatagtatatttttgtagttaattattgatgtagaaaatattgtctacgtatatatgtactattttttcaaaatctctccctgccagtgtgtagaggaaactaccatatgcctcaaagccatgtttgatgcctagagtgtgaaagacagaaaatgcctggtgatcaagatgaggcctggtctggcagtccccacagcaggagggaagcacagttgctctagagtgggctacaccctctatttcactggcccttcatcatctcttgcctctaaggcaggactgtgccttgcacttaacggtcacaggactgtcactgaacctgtgatgttgtctgtggagtgcaggctttctcttcttcccatctcattgtgtattgctagatttctaagaattagaagtatacacatgttttcttcctggggttaaaaatggctttattcagatgatgacaggtaaattatttatcttgaaatagcattttcaagagactaatttctatgtgtatttttaaatgaaaacactttttaaagagcatgaaatgatgagatgccaaaatcctacacattctagaactttcttttatgttctttttttccctattctttggcttttagctttgagtataatttataatcatttgctgaatcagagactgaaatctacaaggggtggacagcttgttttctagcagattactgtagccttgacacgctgaagaaaatagcttcagcaggctgaccagactttctgctgaataggccatcctcggggctgagatccaagagctctgaggtattgtttaggacagtctacagagaactgcagatgatttgtataacataaagctcttttaggattaagagagtgatttacagacaaagcttttggtgaggtgatttttctggtatgtggtgtgtttatcaaaaacagtacacctaccaaacttctccctcattaaaaaaaagctgtagaggcaaactttagaggcttatgttgtaatgttttcttttgtacaaattctgcaatatttttttcctgtctacattttgaacagctatttggtgagagtctgaattttattttttatttctgctttttggtcttctgccatttttcctatcctttactaaattcaagcagctgccatattagcttttctttgcttgggtattggctcccttccacacccatctttctagactttaaatccctttttcttttgcagttttgttttcatcagttttgttctccaaagcatctgttctcttaaagagataacaaaatacattttattgagtaaaagaactcaataattatttgaccttatattctctgtgtggatttttcccctaactaatatttcagaagagcatagactgtaatatttttaaacctaacatttgacctatcaacagatctgctcttcctgttattgtattgtccatgggcttttctattcagagtttaacatttcctaagtaaccctatcatcaccaccccacaaagttattttcagtaagaggggcctttcttcatagcttatataaaaatttaccatagcacatttactcaggttttataatatgaattgaaaaacaatcactgtattttctgtatcaggatttaagaataaatatttgtaaaaatacttgctgctttgaaaatgaggtcagtagaccctacagtgaagtaggtgtcttatgaactgagaaataagttttccctgggagctaaacgttaagaattaacccacattttaactgaagaagtgatctctctgtaatagtaatccactctcagaggccatctataaatggatagttgcagatttgagaatgtcgaagtccaggtgaggggacttgagttttgtctttgccagagcagttcttgtcatgataagtaccattaaatattgctgctctccttgcccctctcactagactgagcttcttgaggactaggatcatgttttgtaatagagccgtagtgtaaggattaagatcctggggcctagagtcagattgcctgggttcacatcccaggccgtatcatttatcggctgttgtggccttaggtaagtttcttgacttttccttatattctccttatttccttatctatgaaacggtagctacatagagttgtgaggattagctgtaaggtacatggtacataagtactgttaccattataatttttcatcatgtcccagtggtgcatattaaatgcatattataactgtattcaaaggagaattgcctggaccctggatgaggagagcagccctatatatcacaaatatatagatgcctctgtcagtggagatccagtgctcagtgcaattcataacccaggaaacaccctactcatgttttgacctgcacccttgaatgaaaggaaactgtttaaatatgtgaagattgtaccaatgttgactttccagtggacactaatttagagtatggaaaggttttgaactgcagaaaagttaaaaaagacattaacttgtcaaatccttcatcttggcatgaatgcaatagatccttcactaagaaaatattgtttcccactagtgctaagcttccattttcttgcttgtcatattatttcagttcatgactctgaagatactcatgatttaataccgtacttgaaacagctgcacctggaaactgagtaacattttgcaatcttaaatcatattactcttatatttgtatatgtgtaggtctatgtggaacatacaagaaatttgacactgattcatagatcattttattattttacattttgttttttaatacttttagactattatggtttatagaacatataaccttccctcagtatccctgggggattgcttccaggacccccatggataccaaaacctgatataaaatggcatagtatttgcatataacctacatgcctcttcctgtatactttaaatcatgtctagattgcctgtaacctaagtaatctattattactaatattacattgtactaggtataatctagtcttacctagtacaatgtaaattctaagtaaatagctcttattccgtattggtttttatttgtgttattttcattgtattgttatttttttgcttctttaaaaaaaattttcaatccatgtttggttgaatccacagatacagagggccgattgtacactcttgtgcttacaaaaaaaggggcactgcattttcaatacaaatgcctggaaccatactttcacatctcatgtgaaatatcaaatgcctaaattcacaattctctcttagcgtttgcttgacagcaattgggccatatgctaaacttccatattaattcctacacatctggtgtttctagataagccccaagtcaaagtatttacaaggctctttttcctataatttgcaaggaatgaaatcacttttaatttatatgaaaatcttgattataacaatataattagggactttattaaaatcagtgcaagaaaataagtttcatggaatatatacgaaatatttctgtctttccacattaatccaaatattaccattaatccaaatattaatattaatccaaatattcagccatttcaaaaaatggctgaaaatattttttattttgttatgatgaaagcatatttgtcaagataggaagaagaaatatatttaaatatttttagcttattttataacttttacatgtttggaaatattgtatggggacttcatgtgcccctcagtgggcctataagaaaggagcagttacatctattgatgtggagcaaacagggagatcgggaaaggcttggtggagaggtaatgtgagagctgagtgtctggtgtaaaggttgtgagtggagagtgatttggacagagggcataacctgggcaaagctcccccgtgcatgtaacagcaaatgtagtgttggcagttggtgggagtgtctaagccatgttatgtctctggactgtcagagccaaggccctagatgtggttatcccacagagcatctgtgtggcaaggccttgcagagacaggccagtggccccactgtgacatctcaccctctctgtagtggcaccctccactccaacactaggcgctgtcatctcaaaacacaattagcatctccactaagaaatggagttcagaggatgttaacaggtatatatatacaatgaagcaaaagaataatattggaagctaaacaaaggccatttatctctgatcagtagctcactgaagggaaaagtgttttccagatctgaaaccttgctgagattttcagacagccctagtagatcaaagtcctcaatcctgacaggaaatattccagctctgcctcattctgtgtccttggtcagtgtctgtggtttcccagtctgccctaatgtttgatgacactaaggatacgtgttgctgttgtgcccctgtttgtttggccactacaggggattgctccctcaggaacctgtagctcttcatttttttcattacatttatttacccagtgacatactatatttttttcttttatcttcttctcacctcctttgtctttcctcttcttccatctcacccatcatcatctattctgtctacagatgcagtatttttatttttaaaaccttgcatttgtatcatgtcccacacatacccagaacccatttattccccagatcttaacttaaccatgtatgtgccaggcatagagaaaactaggttgaaaaagacaagttccgagacctttaggagtgtaaaaaaatagctatcatatttcttctgcttcctataaaatacagaacacttggatccaaatcaaatattttattttatcctcataacaaccctgtgaagtaattattatcatcattgcaaaaagcaatctgcagtatctttgtcttatttttccaccactgcttaaaataccactttcatctatctctttagttcatgttgggcatgaaatcaacaaaggatctcattaattttcctttcaaactcatgttcctccatcaccttccagtcttttaccagcataagttcttcttaaaaattcagcaccttttctcatgactttctgtttgttattttataaatgaatattggagctccctcctcacattctcctagataatccagtatttgtttttaaagtacatatatggctctttattttatatgcaggccctaatagcctcttcagggaagagcctaattcaccgtataaatcacagtaccttgtatttagcaagtgcgtaatgtagattagctgaatttaacaaaatgtgcagattaatttattgtgcctttagtttatgtctgtgaataagtcttttcatttcccaaataacctcagtgttcctattgagttttaccttgtctttaaaaacgcttttcacaatttgaatttttgtacctttctttagagctgatacatgaccccagacaatctgatattttactgaaattaaataaggatatttctgaatttttgcctgtgtctgtagtcaaaacactaagtcataaagaacccaaactttgtcctgtggtttctacagatccctatgactactaaaccactagttactactggcagtgtgaacctataagcagtggtttgcagatgttcagagtgatctgatcatctgtctatatttttttaatcaatgacctgacatcaaaactttactgaagatcgagtagatagttccatttttctctctaagctttatcattccattatgggaagaaatttagattgccatagtaaggtttcttttacacgtatgtggacgactccacaagtataaacatgtttgccttcagcactgataatgtgttgggccttttagataacttcccagtcaacagcagcaaatgatgctgtactcatttctgccaattttctaagaagtctgtattcttgtcaccaagtcatgcttgtttgaacacatcaagaagagagtagtcttattaagcaatgtattgccttttttgaacctgtttttctgtccatcatgtgacagatactgtactatacagctagctgatcaaaggtgacttttaaagactgagagagacacaaatgaggaaagcttctaacgttcagccttgtgttcctagctttccttcaccatcacaggaagaggcctatagttccctctggctgactccatcatttttgagcagttatttgagatttagcttctctgattttattcctttaaaattcctgttttcctactttattatttaattttcctctcaatttctggtgctttatttcagttgccttcaatttcttgctaccccttctgtacactggaacagttaaccctcagttgattaaagtgattaaaaagaaacagacccagataactcaaaactaatttgtttgactttggattttaagatgattttgtaccagatttgcattcctacttgggttttatttaagctgctattatgatcagttgacattccttaagcatgtaccagctggctaatggagtgaacaggcaggcctgaggaagctgtgctagtatggaaaattggctggagataatacacacatggatcattgaaaattgattgtggtttgttcctgtgcccagaaaaccgtctgcttaatgactcagctctcttgggtctccatggaacttagtattctaatataattaattagttttacaaagaaaccttcaagatattgaaaagaaccaagtgtaaaaactagcataccaagaactaagtttatgtctgaataattttttaattgttcaagttctgtatatacttagttcttatatattctcctatttgcttttcctgtattttaattacagtttatacttctttcatcacctcattaaaaactatcttgtttcatgcatgttaatgtttcataatctttgataatttaagttattttgcccctgtgatcatgtagaatagaaactggatttataatttccttacccaataattcattaatgagatttctagaggaaacaacagaggctacagtaatggggaagttgctgactttctccccttaattttgaaggtagttatagtgttttaaggttgggatacttgattgctaagaattgttttcttctttggaagtaaagctctgtagagggagcttatgcaggagacttttgggtgggaagtagcgaatgctcaacattcttaggacaaaatagtgatcagtcctccttcattccttccgcctctccagtatcagcctatcccccagttctctttgaatgaatgcagtagtggcactctgttaggccttttttttccccatttagtttattttttgccttttaatgataaacaatttctccaggatttgctgcgcagatatttgtggaggagatagtctaatagaaggatcagatgatacctagccttaaaaacagaggttgggttttgtttgctttgttcctcttcctcattgcccttctccttgatcgttagcagtgttactttgggcaagttagtcgatgtctctgaatatcactttccacatctgtattggtggtaataactatgttatcatggttatatagaatagtacttggtatacttaaagctctatatcttcattagttgttgttaaaccaattgcagatacctaacttgggtagatccgaaccatgggaatgggtcacgctgcaccactttggctgtgaacagcagctaagccccctttaccagtgggaacacggtagacaagctgactgagtgccctcccacccagtatctactcctccttttatggtcctccatccttggtgaatttgtttcaccgcaggcagtctttctcatacatatatcttcttttctctttgtactcgtaaaccagaaggcatccttaagcgtgccaggtaaaattaataacagtgctagagacagttttaagtagaatcgaaactaaagaagagtcactgtcaaacttcaagctcttgaaagcacctagaatatgccttcagggtctctgcaagaatctttactgagtatcttctgcagatgtatagcatttcagctggattctgactcaaataagtttctatagtctggtccagaaagctaggcaaacattttaacatagtttttatgggaaaacacattctagtttatttgtaactgatacatattttgttcataattggggaactgccccaaaaagttgttttcctgattatttttaaccatttcttttgacagaaggagagcacataggtggatctaggtatgatttatctttttattttaaaactaccacactaatttatgggaaaggaagaggcatatttggaatatttataccctttaatttttttacttaaatctataagggtgaaaaacaatctgttttggaccttattaggataaattttgcttgaactgtaagagacaaagtccccagatcatttcagcaggccatatcattattctaaagagctggaagaagcagcatatgtggtcatcagatgaacttacctctttgtgattccataagaggttgggctgcgaaacttgtgattgagggagtcaacatgtcagtagataggcaagcgctttagtttttcattgatctgtagcagtgggccttcccaagaaggatcagaaaatgtcaagctgctgagttaactgaaaagacatcttttaaagatctcaataagagtttattttaaaatgagttacacaaaaataagcagatgtatttttgaagattaagaggtggtgaaatagtttgaaagcatagtattaggaatatggaggtaaataacgagaaacagatgaaaaaagttgaaattgttttctttggtgggtagggcaggataatttagaagactgttgtatttaaaatcttttaaataatatttgtctttttaaactatgtgcatgctttactttgataaaaatcaacatgaaataaaacattcttgtaaacagaatgttaatatcatttgaagattatatagtatatggtagcattataatagtgtcataacattttaatatagactctatataattatccagcttcaaaaattcatgattagatttatagttctgtctttggactatatttgttttggactatatttgtttatacctctctttttcttaactttattttttcttaactttgttattgatacatcatattcaagtcagggacgatcatcttcctatgttgctacccatagcaccttgcacagtatcttacacatagtaaagtctcagaatatggttgataaatatgttttctgtttttttaacctcttcaaaaattacacaaataatacatgttcattgtagaaaaaatagaaaatgcagcaatgcaaacagaaaaaatcaccttaaaactcatcttactgttttgataacatccctccaaatttttttattattattatttttattttttttagagaccaggtcttgctatgttgcccaggctggtctcaaactcctggcttcaggtgatcctctcacctcaccctcccaaagtactgggattacaggcataagccaccacacctagccgtctccaaatgtttttctatgtaatatatatgtaaataaatttgaaattaaggttattctacacatattcttttgtaccagctttatatactgaatatgttatgagtgtcctgtgccaaaaattcatttgtcttcatttttaatgactgcctaatcttccacatatgtggatatgttatgatttatttaaccaatcctttatcagtaaatatttaagttttctgttttttctttaattgttaacaagtagtttgaatatccttgtacatatacttttccatacttatttgaatattttcataggacaaagtaaaaaatttttagatcaactggtatatactattcttaaggttctttattatgttgctggattgtcctccagaaatgtaatatcagcttcagtccccattagtagagaagaagttatccatttctctaccccctcactaactaatgggcagaaacatttatccttgttgagttcactggtatttctttgaataacagtgaatttgaaaaaatatagatatatacatatttggctgttcatgtcttttggttattcaaattaataagaaaagataattcttatattaaggatatatgatttaactgtctcatatcaaaaatatttttccagtttgtaatttttttctcttcaatgttgcttctctttatattaatagtttctttttaatttatgtgttcaaaattgtcaaccatttaaaaaaaaatttgccccagcaatcatgcttcaaaagttagttcctttcccaagatcatggacctggaatgaattgattttcagaacttagtagggtgactgcctctcaaatcttttcctttttcttatcaggaaagcaatagaagaactgcttaaggaggcaaaacgtgggaaaactagagctgaaacaatgggacccatgggttggtaagttctttgagtaatcttccttaaaacttaagaaaaaattcttagctggagatataaatatgtaaatctttagcatatagaggaaatgggaaaccatggaagcagaggaaatctctcagagacaagtgtagagtaagacactgctgagaactgaatgttgagaaactctaataacatgaagaaatgggcagcaggcgcctatggaggatacgcagtataggttcattgtccctttagttcacaagtctccaagaggtatttagatactactgtgcgcaaagtcacctgtgcaagagtaatattatgttggtgttcattgtttaagaatttctagtttacttatagtccttagtaaattaaaatttattttaggaaattaattttaactgtaagcattttgattatgtgacaattcagccatgtagaattaaagattacctttgcagattatgtacaaaatagagcttgttaaaacttaataatatgggctgggcacaatggcttatgcctgtcatcccagcactttgggaggccaaggtgggagtattgtttgagcccaagagtttgagaatagcttgggcaacatagtgagacttcatctctacaaaacaaaccaaaaaaaacacccttctaggcactactttagtgatgccatttgcatttgatgaatttgttgattctggaatttatatctacagttaaaaacgtactgcaatggaataaggagggtcattaaaaagagtaaaatgtaaaaatgtgaaaagagtagaagctaaacttctgaacatagctcattttgtaattttgacatttagaaccatgcacatagttcacctaaattccaagacaaaaattaaaatggaaaagataatacctaaaaatcaagcaaaataaaacatggacctgataaaccattgagtggatggcttagctacatggaaagaaactatttcaggtgatctggaatttgactatatttccaaaagataaaaaataactacaaagaaattgttttcagtcatcatattgttagtaataatattggtattgctattctgaaaatattatatagtaggataaaacaagcaatactttctatatataaataccaagatttaacatgaaaattttaaagagctacaaatataaaatcaaagaaataaaaacctacctataatcctaaatttgaattggaaacatcagtatgaggttgtgctagattttctcttaaaaaagagagggagagagaaaagctttttctagttctcttcacagaaaaggtctagaaacaatgaccacccacccagtagcagtgagcaccccggtgccaaaactgtgttatgtaaataccatttctcactgaaaggagagcggaatccttagagtaagaactgattgcagacctgaagcagtgcccagagttagccaaactgcaaaattagaggtcacagtccccaagactatccttacttcttattaccaaccacaagttcagagggttcccccaaactaccacgcttagcttcaataattcactggaagaactcacacaattaactgaaatctgttatacttgtggttacagcttattacagggacaagatacaaactaaaatcagccaaaataagacacaaagattaaagccactgttatcctctgctccgtgaagaggacatgctaccctcccagcatcagtgtgtgataataagcatggaatattgccaagcaaggaagctcatctgcggctcagcattcaaagtttttattgcggtttcattaaataggtttgaagtcatgatatgctaccctcccagcatcagtgtgtgataataggcatggaatattgccaagcaaggaagctcacctgagcctcagtgttcaaagtttttattgaggtttcattacataggtttgattgatggatggatggatggatggatggattacatgactgatctcagtttccaggttgactgataccacgtaacccaaagctctcaccctaagtcacatgttagtctctctggcatggccagctcccactctaagactcttaggtgtgaccagctccaccctaaacaaagacatttctatgacattactttctggaagctaaggcaaaggccagccctctctttgggccaaaccaaactcttgactacatgggcaggaaatgtataagagaagctggaaaatcttgtcacaccagaaagcaaagaaactgtcaaagaccaatgtactcatttcagaaagactcaggacccacttgaaaggtctcccactagtcaaagatgatataatttgatttaaaaaacaaataaatgattaaaacacctaaaatatgttaaaatctgtaaggtcataatgataatcataataacaaacctggtagtcccttttataggatgctagagcaccaaatcactattcacaaaactgataaataggaagaagtaagcatttaccctgttccctgtacaaattatacttcaaagtcaccaattaattgatgaaagaaaactttacagaagaattgtaactaatatattagaaggattatagaataatattatcatcatttgagtttcaacacattcattaacccttataccacagaaagatgcaagaagagcaaaccaccacctctggggcatccttgtcaaaaaattgaacctgaatctgatcaagtctctagttagaactactagtttgcaagaaatacagagggcagagaaacatgttaaatgacaccataaggctgcaatcacaaaaatccaaaatgtgagaaatgctacaggacaaagaacccagtttctttaacaaatgaattgcaaggagaaaagaaagaagagtatgctgtgaattaatagatttgaggaacatcaaataaaatgggtaccttgtttgtgtctttatccaaactaactgtaaaaagttattcaacaattgagggtatttgatgatattaaggaactgatgttgattttttaggtgtgatagtattgctgttattttaatttttaaaagccattatcttttagaaatgtattctgatatatttatggatgaaattatataatgaaataatccaatgtgagtcaacctgtatctatcaagtgtaatcatcttagcttcagtaaaatacctagtaaataatagatatattattttaaagtgaatactgaaaaaaatgctcagctttaattttgaatatttatattaatagatgtaacccacataaacaaaagctctttggggtgtccacaatcatttttaggagtgtgagtgtaaagtaccctaagaccacaaagtttgagaaccactattataagacaattgaaaaaaataagaatgccagcaggaattattgtcttatagactcatgggaaaagtgggaggatgatagtgaaaatctggtgagataatgtgtatgaaaacacccagcatggttcctggcatgtagcagttagttagtaaatattagttaaatctgctcttctttccagccctcctctgtgctttacagaaataaggtgcctctactattgtgagtcagattagtataaactatttaggcacagggtgctttggtttcggatataaggctgtaccttcatcaggctgtcagtaatcattggtccaatctaatacctattagaaagactcagcatagagttaaaatcatgcaatttacaagtgagtaagaaaatatcaattatagttcttgctctgtaaggagcgttcaaggggattggttgtttcttgccagctctccagatagacatcatttatcctgacaactttagtaccacctactggcttcataaaactttctgatagtaaaagaactagtgtatcagtgctagttctgctctccctggggaaagttaccatgtgcaccagactgtcttgagatttgtgtgggcattgatgtactctttaggaataacactggttaggttggtagttacacagagttactggggacccaggctccttccagttttccaaatctcccaatcatagggtatgactcttttctacatagtctaatatagtaacagacactgagtccacatttcagttagcagaaaggaaggcacacccctttcctttaagaaaacttgccatgactgggcgctgtggctcacgcctataatcccagcactttgggaggccgaggtgggcggatcacttgagtcaggagtttgagaccagcctcgccaacatggtgaaatcccatctctactaaaaatacaaaaattagccagatgtgctggcacacgtctgtaatcccagctactcaggctgaggcaggagaatcacttgaacctgcaagagggaggttacagtaagccgagatcacaccactgcactccagcctgggggacacagtgagactccatctcaaaaaaaaaaaaagaaaacttgccagaagttgcatttaccatttcttttttttttttttttttttttttttgagacggagtcttgctctgtcgctggatctcagctcactgcaacctctgcctccctggtgcaagcaattctctgcctcagcctcccgagtagctgggattacaggtgcccaccaccatgcctgactaatgtttgtatttttttttagtagagatcgggtttcaccatcttggccaggctggtctggaactcctgacctagtgatcgcctgccttggcctcccaaagtgctaggattgcaggcgtgagccaccgtgcccggcctgtatttaccatttcttcatgtaccccattggccagaatttagtctgatgtctacatctagctgcaaggacagaaatttcatcttttttttcataggcagttgcgtggcagataagtatctggggttctttgactacagaaaaaagaaagagcagatattgagggacaactagcagcttcttcccaggtatagggaaaaagcatgttgaaaagggagtaaataaaagatggcaggcaaagtaagatactccagattgtaagaggtggatcccgtgggagactaggatgtgaaattacactttcccatgagtctgaaagacacgaattcctgctgggattgttacttggttatctcaattgtcttggaacagtggttctcaaacatcttaggatacttgcactcttacgttattgagaaccccaaagagcttttgtttatgtgggttatatctatcaataccaatgtttaaaattaaagctgggcaatttttaagtatttattcatttttaaataataaatcaaatacattaagataaataacatttataagaaaaataactatatttgcaaaacaaaatgcattgagtacagtaattttggaaacctctttgatgtctggcttatagaagacacctgggttcttatatctgcttctgaattcgatctattgtaatgtgttattttggctgaagtatgtgaagaaaatactaccttacaaagatatgtattttcaaaaggaaatacatatcagaaagtttaacaaagccagtaggtgatactaaagttgtcaggataaatgatgtctatctggagagctggcaagaaacaaccaagccccttgaacgctccttacagagcaagaactatgattgatattttcttactcacttgtaaattgcgtgattttagctctatttcaataactttttcagaagactgtagatattcttctttgatactacatcagaactttgcaagtaacttcaagtagtaatttcgtaatattctttttaataatgtgtacttttcctatcctattacagtaaaagccctttatataatatccttgtaccttggctggatcttctacttattcttgattttgtaacatcatcattggtcatctggaaaatattggttcactgagttatgaagcttccaaatgttgacacgtgtcattatataatatttttaaaatcacatttgtaaatatcatcaccaatctcatcagatcagtcttttaagtgtcaagggaacctgtcaagttcacagtttgccaaaattctaattttctttcatctggaagctccagttatatattggcaatgaatactgggagttgttttcctagaagtgacaggcccacccacatctgaataaccagctagttcactttgccattcagtcacacaagtacttttccttgaggcctccatcataatctcaagtaccagagtgctttgtatgtatgtcccgtttatacacatacattattaaaaagactgatgctcaagggtaaaaatttaacaaaattaataatttgcactgcttcatcaaggacattctcaagtaaaactggccatttttaactggaagtgcatggtggtaaagagtacaatgaccactggtacagtttttcatcactgccttgtttcttgccactgttttacttgttgcttttgcaccatcagtgcaaatgtcaaccttctggagaaaagcaaattatatcaaaactatggaaatagctttgactttgtagattgcctcatgagtctggaggactctcagggttcacgggtcacatggtgagaactgctgctttagataggtgccagcaagcaaatacagcaaaacaaggaaaataactaggaggagaaaaaaggagacaaagggtcatttgttgaagataggatgtctacccatagtggtttagcacaagataaacattcaaaatcaattccttatacagtcaatagcccactagaaaatataatgagaaaaaaggacattgtttgattatctatgattgtgtggtatagtatatttacatgtaatacacaaacatataattcttggctgaaccatgtgaaaattaattgtaggcatcttgatacttcagccctaaattcttcagcatgcagatctcaaagacattctcatgcataaccacattgtaattaccatatcaatgaaattaatgtataatttcatatcatcatctaacatcccaaaaatgtcttttatagtggttgccttttgtttgggatgcagattcaggatccaggcaaaaatgttccacatactggatttgccttattatgttttcttgattagattcaggtcaaacttgtttgacaggaaggaatattacacaggtgatgtttttatacgtcttaattacaacagatcaggaggacttaatgtcaggttgcccttgataaagctggtgactaccagatctctccattataaaggtgcaatttttcagctaagatatttttgggaggaatgagatgagaatattgcatgctcaatataataatagtatgtaaatttatagtaattagtatgagattcgtgtaagactaaagacattagtgagagaatagagaatcaagaatagagactgggggaagaaagaggcaggaggaaggaagggagtggagaaggaaagaaaacaaaaaaaagaatggagaccgacatatgtgtatgaactaactgtgtggaaaaaggtcattgttcatactagtggagaaagggtggattatttagtaagtgatgctgatacagttgactattcatctgtaatactgaaaattaaaaactaaacatacaaaatatgaatcttataggagaaaatacaggataatatttttataatattggcaaggataaggtagaaacctccctcagccaggcacaaaacctagaagctatgaatgagacaatggcagattcaaccatgtcataataatagtaaacttctacatagaaaaagataccatacaaaaagttaacttgtgaaaagacaagtggtagactggttgaaattatttgccatatataacagacaaaggactaatactctaagtattgaaaaagcttctacaaatcagtttataaaaagaaaaccatatctgtgtgtgtctgtgtctgtgtatgtgtatgtgtatatatcaaaactacaaatggccagtaagtaaacatactaacacatttattgagtacttagcagagctaggctctgctattttgacactcatgtatctgtaaacagaatgacaaagattcctgctctcttggaatttataatctaatgggggtgggagtgcatgcataggtatttatattcctcttaaatagcacttaaatttcaccattagattggcagaaatgaaagaggcagtaatccagtggagatgaagggatgtggaaaggggtgcagtgttgtgcttcaggcagtggtgtggtttgctctgtgcagggccatgggcaaaatgttgagtcacagttctctgtgcccctttacccaggatctctgctcccagtaatccctctttcatagaacttaataaatgtgtgcagacctaagtacagaattattgtagcacattttgatagtaaaaaaagggaagcagtccaaatgtccatagataggaaaatgcttaaataaactgtggtacatcctactgttgaatattttacagtcactaaaaagaattggtcagcactatatgaatccttgtgagaaaatatctactatgtatgtgaaaacctgagttgtggatcaatgcatgtaatcctctattggccaggtcagggaaggccatgggaccccgtaacgcataaaggtctgtgagaagttaggcctcctaacagtgagcactaaggggagcatgagaagcagggaatgctatccattgtaaccctctaccaggggctctgttacagtaatatataacaaatatgtcttctatttatcactttttaacagagtttttttaattagaaaataatctggagaggtttttaaaaatacagatctccagccaggcgctgtggctcacaccagtaatcctagcactttgggaggccgaggcaggtggattgcccgagctcaggagttcaagagcagcctgggcaacacagtgaaaccccatctctactaaaatacaaaaaatcagctgggcatggtggcgcctgtgttcccagttactcaggaggctgaggcaggagaatcacttgaacctaggaggcggaggttgcagtgagccaagattgcgccactgcactccagcctgggcgacggagcaagactccatctcaaaaaaataaaaaatgaataaaaaataaaaatacacatctccttccctgcctcactctagggcattctgatagagaagtctaagatcggtcctacaggttttttgtttgtttgttagttttttaagcttactagaagatctcatcaatcaagtttgggaagcactgctctgaacaattgagcaagtcaatcccatagaagacttcacttcattaaaaataaaaagtttatctgcatttttctctatctctctcataatgttcacattttgattcttgatctgtgttgctctggaagcaggaatctctgggtacttgcttattccaggggcaactgttttttcctagccagagttcagtccagcagttcagcacacccaaacagatatgggctatgaaaggaggtctggacccatgacaaccgtggcttgcttctactcactagtgctgggacaaagggcacctgcccttcatctgctcgttctggaagatcacctggtttccatttatttaaataagtgtatgtgagaaacttttaaccactagtcattagttctcaaatttatctgcacatttggaatcacctggaaagcttcaaaaaatactgatgcctgtgccccactatcagtgattatgaacttggggtgtggcctgggctttggagttttaaagagctacccgggtgattctaaagtgaacacaaatttgaaaaacattttactagtcccttttgttttattaaaaagaatgataccagcctgctctgcagaatccagaacaatcctacacctcggccagaggcagacagctcctctgcactgaaatagcacttaggtagcctggccaggtgttcagccacaagagtcccaagacccatcgctgtggagtggacttcttggacagttcttaaaagagtagcaatctgttgttcactagtggccatggcctgtttttttctaagtatctagaagaccttttatttgctttaaaatttaaaatagaactagagtgagtggtattatttttttcattttggatattccataagaaatagatggttgagcagttgccagagagagattgctgatctaaagaaaatgcaagtgggatgccattttttattttataaagaaagagaccatttggtgctatattcttccttggatgtatttcagcaaaagaatctctttagaagctgttgttgacagatgctttaggagaagctgaaatattggctcatatgacttccttttagtcaacataaaggaatttataagcataaatttcagaaatttgcccagcttcattgtctacaaagctgttttaattctggtcacattcactttagcttatctactgcccaatataatttctgagtctagtgcctgtggaacttcagccttatacttggaaaagcttatattttggcaaaataaatcctaaaggttgaattgagagaaaatgattcttgagttctcttaacccaattgttttaaggggaatgacttttttttatgcttttctgtttggattgagagtcaatctagagatatggaaggaagtcacccatcttgttcttccagtttatgtcatcaactgttgattattggaaactaaataatttctccagtctttatccagacatgtgtttatttatttatataaatattcacagggcaccagcaggtatgttaagaggctgatcatggacagcagtaaagaagactcactttcctggccttaaagtttttaatcccctggtggatacagaaacaagcatcaagtgatcacagtgtggcatgccacactgactgtgttagaaccaatgaggaggggagcaagggctcacatctcagacgattcgtggaggaggctcttggcaatattttcaggccacagagatccaaagcctttatacgtatagaacatgaaacccaaagagttttcctaaagccctggctagcgaattgctgatgggactataactttgctttcctatctgtcacttaacactccttgtatggcatcacttctctctgtggattattgtctgataacatgctgaaatgccaatgcttactgcccctgcttcccacattcctttcatatccagttatgaaagtgaatgagagagccctgaatgtgttactgttagagcacatatctatgtaaatgatttgcgttgctgagggagctggaggccgaggattatagccttgcaaactgtctcagtgtgttactattcacgtatctgcttctgaactttgacttcccctaccttctgttcctcttggtagtctccaaagacagagacacataaacagatagcttggtatgtatctttgctacagtgcttagcataatgcgttgcatatctcaggtgtatatatatatatatatatacacacacatacacacacacacatacatatacagacaaacacatgtcaatgattttttattacttttaggtacaatgttggagacagtcattgaacacccactgtgagcctcaggactgttgtacacagtaattaagggttaacagcttactaatagggattataacaccataaaaagcatttttcaggtggccacatgctgaggcatttgattgccaaattataaactgtagcaccatgggtggttttggtagttgtggcagcattaaacaacaaaatgagttgtaatcaaccacagcatcaagataaaaaatattccccttgtttcatgcagagttgggagagttaggcctctgcttcagtctttctagatgcattattccagacctacatccatgagagtgcaaagacacgtacagaatggaagatacgctatttgctagtatgggaatggatttgtccatagaataaaagaacgcattgaagtgcactgcatggaaacttgcttccatgactccaaggtgtctattccctaaccataaaaataattcttatttcccactacctgttcgacttcacacatctcagagtcaggcatgtttaagggactctccacctttgtccttggctgtgttggtgactctcctgggctcctgagtggccagctgttctcagcagacctgtcactgtgtgtgcatctgctgcttcatgcctgtcctggatgaggagccttagccacagcgtgctgacaagcttttcacctgcggtttctttcttgactgctctgttaattggccatctggttggactgcagtgagtctttctctgctccactctctctgcccctttccagactccctgcttccagtctggctccgcatcttactagcttgggatgtggataggcgctgtaccttttttcttttctttcctttcggatgacggctgtggagatgaaatgaggcaacattggtaatggaatagcacaaggtaattgtgtcttcaacgtaccctgttggctggcgatcctgtgtcactctcagataggtcctattcaggaaatattttagaagcaaaaggtagcaggtctaaatctgtggaaagttagatactactacctctatccttcagcaagagagacaaaaaagatgaaaagcttataattctagccccagtgagtcttcatctctccagtggcagattcttgagcagtcagcctttcccatggcatgtggaacccttccatcacagcctctgagcccacaggtttcaaagtgaaggaaattgctttccttttaaagtttaacctggatagaatgccagatctcaaatctgacattgtgtcatgggtactttccaaagcagatttaaccagtctcatgatatttagggtttatatccatttatgttgttagcaccttaaatctggctcttaccatgtgagctagcataactttctagaaacaaaaataaactaaatataaaaataactagccagggtgagaaagtcgccccccaggtcagagctaagacaggaaatcagctgccctgtcctgtggcctcctccagtccttcccccagcacaccttttgggcatagacagtgacagacagtgcagacacagcaggcagccgtggcctatgatcttatgctcaatttcagggctcagatggttaccctaaagctgatacgagaaaagccaggaatggtggagtgtctaatgccagtttatcatgtcatctcaaatactgtggaagatcgggggaggcgggaaatggcagtaagaaataatttcctaatgtgatgaatgagaagagtgaacttttctaaagagttaatgtacagagcatgagcagaggatcctaaaactggaagggactctagagatcacccacctacttcaaccgttagttttacgtctgaggacagaggcctagagggtttgtggaacagttggaaatacaaatgataagctcaaaggtagtatgtagtagcctcttgatcccggtggcaatggagaattgagatagccgggaatctgaaacttctacaaatacaaatctaaccatgttaaaagtaccaaaacttttaaattttaaccctttttttggaaacttatgtaaaatgtctcattaacttttaatgatggcttacttttttcttaatcttttctttcatagagattctactctgttcttgattaacttattatcacaggtgatttgaggctttgggatatcttgagttgccatcttgcaaaaattccggatgtattagcctatttgagagctatgtgtactctttctcatgaagagagagtaaaataatatatgtccaccatcctttttctaaaacctttgtatccaaataagtctctaattttagatatttttacattttagaaaggtattacagcacagatagcatgtactagacaccccccccaccactactctgtacttgttcaacatggtatcatttcttcagcaaaacatgaatgtttatattaaatgggataaagactatataaatagcccaaagtcaggtcagatcaagttttgctgccaaacaaactttggtgtcataaaaataacttggttttaataggtttttaaattttggaattagggataagaaattgtggacctgtaggtaacatttgttgcagtttgctgtatgccagataccatgctaaatgccttatacattatctcattaaatcctcacaataactttataaggtagatacgtctgttattcccattttgcaagtgggggaaacgaatgcaaagaggagttaagtaacttgcttgtgatcacacagctaattaaatagtaggctgtgaaccaaaactgaaattaaccaaatgcctttatgtgtcaggcattgttctgagtactttacatgttctaattcatttgatctgcatgcaaccctttaagatagtcgccattattatccccacttaacagctaagaggcagcagggagattacataacatgcccaaagtccagtctgttagtgtgattccagagcatgtgtgcccagccactgtctcatgtagtgtgatttcttagcaatgaaacaaccaactgtgagattcagcaaaattaatttctaccttaaaggccagagaagctctccccactgattccctcagacattggttttgatgttgccgtccttagacttggatctattctgtgcagattttggaatttctttatataaaatgatttactatatgtaccttcacatctgcttgcaactactgtatctcattgccctgccctatttattagtagagtgtgaatgagcacttgtcatcacttctaaaatgtgtactggcatgcctgggagatgtctgactttcaaaccccacctccaccccaccccagtaaaccaagatctcctcaggccacccttggctatttacctagaatagaatcccaggcataaccaacattaaaaaactgcatctctgatgttaaaagagatgtaaatgccagttttcttgtggaattattctataaaaccatctcattctctggctaactctttgggtcactatgttgagtcagtgggttacactagcagttggaagataggtgcagtcccctctgcctcttggcgtgaatgctgcagttagtagcagggctttgctcacctcgaggaagcatttggttttaaagatgatctgacattgaaaacagcaaaatagagtggaattcaccagtagttaccaaaggttttgttctgagatcctggattaccatcacgtctgggaaaagtacccttccttgttgtttaatgcagagaagaactggccagtttaccaccactgagatggcccacttcagtgaaaagaccccagaattcttctgttgctggacatgtttcaccagctactcctagccctatatatccaagagacatatgtagttcatttgtctataaaaaagattttgctcttgtagtaagcaccaggccaccattgccaaagacaggccctctaagctttttactctctgtgatggagggtagtttttcctgtaggctgtctgtgttatgctgttttggaacatgccagtgtttaatactgttctgaatcattgctgagtttgcaactgcagtgggtcaagtgtcttcaccaaagcaacgcctgcattcagtagtaccctgtcagaccctgcaggagaactcggcttgcctctcatcacgtgcctgtcttcccgcacaggaatgtcctaatgccagcgtgcccccaggaggtagaaatgtctttaccttgagactactaaggcagcgtaatgctggtgtaccttttctggaagctctgtgaagctctatagttcgtacttgcagaactgttttttctttgtttttgcctttcttctttgcccttcgtctcattcactgtggcttctaaactccagagctgtcaccacctctgaatgttcccactatttctgttgcactccactgtccttttcttaaattttctaattttccactgtccttttctaagtttctccttgttctagttcattcctttgtcacttttctggcctgaccatttttctcagatattttctctgtccttgtaggctcaagagctacctatttgcagcaggaggtattttcttgtttttcttccttttacttccagattcagtgccattttggttttctgagatggtctgacctctgtgagtgaggctatgctaatgcctgactgcttatacttcacctgtacagtactagtccacacaattcctatgtggagtgttgttggcttgattttgaagtattgtttggggttctctgtaaatcaaagttttatagaaatgtggctattctacattcgtttttgtttaataccagccaccctgaataacatgattttgagaatcagcatactcctaaagtagcccatcatatggcagacacctcaaggctaagagaaatatgaacgttctcatttgtatagggtcatctttttgaaaatgaaagatttattaacacctgaaaaagataatacatagtatataagtagatctaagcacattaattagcaatttgattggttgcagcctctcctaggtaaacttgaatcatgaaggtactgaaatatatcctgcacagaaattcaccagggcaggagattgagtaaagtgctcctccacagagcatagcctggcatcctgaaatagaagtgtaagaatttttttaagtaaaagattattgcatatttatggattctttacacaatttttttattctatagtagatcctttagctcctgtatttaatatacagcagaatatactttttagtttccttggaaaggaacagttttcactgtctggtaataaaacgcaagatgcaataaatttaatccaaaataagttacagtaaaatagggcacttactagtttgaaagaaaatattaaatgattctgttagttcacagtgtggtcaatacctgtacatatgaacttcagtaggaaatttagtcccaggaaggaagaaaggtttaaagtgttccagccagtcttgtctcaagaattccaatcgtctttttttttcctccctggtactcagagtttacactaggtggcatgcaaggaaagctaacaaattcagaaactcgattctgtgggagcaggattctttggtactaatcacgatagtgggtccagctttggagttaaccatttgatttgtgatggtttttcttttctcctccccaccccaggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtc

SEQ ID NO: 38331 - DNA, 14645 bp, Homo sapiens
ggcgcttccgcaggaagaaggaagcggcgccgccatcgcctcccggcgctccctccccgactcctaagtccttcggccgccaccatgtccgcctcggctgtcttcattctggacgttaagggcaaggtgaggctgggcatgaggagttgggagacggacaggtgaggtctcgctcccagggattcaggggcgacccctccgcgcgggccaggaagaggtctgggaacaccccctccccctgcaatccctgggaatcccacctccagcatccactcgccttgtgcctgaggccaaggggttcgcctcctagggcctcagtttctctgtatgtaaaaatgggagcaacagaggtccccacccaatgagaattaatacaactcgctgcgtgtaaactacttagcatagtggcctttctggaaatattagggactcagcaaattgaaattatctccatcactgtcggcatccacagtgttaatacctggggaaggcaactggaacaggggcctctaactccccccatctgtggctgccttgcctcttcctgaagtccttttattcctcttgtctttttttattttggagacagggtctcttgctgtctcccaggcttgagtgcagtggtgcgatcatagctcactgcagcctggaattcctgggctcaagcgatcctcctgcctcagtctccggagtagctgtgactacacaggtgcaggccaccatgcctggctaattcttgacatttttttgtagagggatcccgctatgttgccaaagctgctctcaaactcctgaatatctggggctgcgggctgacccctccatgcccggctatttttaatttttttttttttttttttttaaatagagtcttgctctgtcacccaggctggagtgcagtggctccatcttggctcactgcaacctccacctcccgggttgaagcaattctcctgcctcagcctcccgagtagctgggactacaggtgcatgccaccatgcctggctaatttttgtattttttttttttttcaagacagagtctcgccttgtcacccaggctggagtgcaatggcatgatcttggctcactgcaacctccacctcccaggttcaagtgattctccttcctcagcctcctgagtagctgggattacaggcgcgcaccatcacgcccggctaattttttgtatctttagtagagatggggtttcaccatgttgggcaggatggtctcaatctcttgacctcgtgatccgcccacctcggcctcccaaagtgctgggattacagacatgagccactgcgcccggccgcacccggcctattttttatttttatttttttgtacagatggagtcttgctatgttgtccaggatggtcttgaactcctggtccccagctatccccctgcttcagcctcccaaagtgttcggatgacaggtgtgagccactgcagtcagcctgtcttgtcatttaatagccaaaataagagtggtggtgaaaataatattcccattaatattaatagtgagagctaagatgtttgagaacctgccatgggtcctccctgttcagacactggacaaaacaaccttaggaagtggttaactaattttttttttttttggagatggagtctcgctctgtcaccaggctggtgtgatctcagctcacagcaaccttcacctcctgggttcaagtgattctcatgccttagcctcctgagtagctgggattacggtcatgcgccagcacaccaagctaatttttgtatttttagtagagacggggtttcatcatgttggcctggatggtctcgaactcttgacctcatgatccacccgccttagcctcccaaagtgctgggattaaaggcgtgagccaccgtgtccagacagaagtgtttactattatgggtgtcttcctgactaccaggcacaatcatatgaactgtcatctttctttctttctttctttctttctttctttctttctttctttctttctttctttctttctttctttctttttttcttctttctttctttccttctttccttctttccttctttctttctttcttttcttctttctttttttgacagggtctcactctgttgctcgggctggagtgcagtagtatgaccacagctcactgtagtctcgacctcctaggctcaattgattcttctgccttagcctccagagtagctgtgactacagaggtgcaggccaccatgctcagctaattcttgaaattttttgtagagggatcccgctatgttgccaaagctggtctcaaactcctggcctcaagggatcctcctgccttggtcttcatgagtgagtcattgcacctggcctcttctttgttttttttttttgttgttgttgtttttttaaataatcccactttggtgcaaatgaagtctggggcaacagcagggattctggacccaggatgccttagatcaatccccagtttccatatgcttccagtggacatggtttctaacctcacttctcctgtgtgaaatggagatgatgataacatctaccccacagggttgtggcaagaactaataagttagtaaacatctactctttttttagtagccagcctgcctgcctaccttccttccttccttccttccttccctcctaccctccctccttcccttcctcccttccttctttactttctttctttctttctttctctctttcttcttttgagatggagtcttgctctgtcgccaggctggagtgcagtggcacgatctcggctcactgcaatctccgcctcccaggttcaagtgatcctcctgcctcagcaccccgagtagctgggactatagatacacgccatcacgcccggctaattttttgtatttttagtaaagacggggtttcaccatgttggccaggatggtctcgatctcttgacctcatgatccacccgcctcggcctcccaaaatgctgggatcacaggcgtgagccactgcgtccagccatcgcctaccctttaataaaacacagcctggcacttagtgagggccctagacccattagctgttgtcatcacactcccattttacagagcaggaaacaggcacaaggaggcagagccttgcccaagcccctcagctaggaagtagggtcagaaccgggcactgtgcctcctcagcgtggtaggttcttggatgctggtggtgaccaggtcctttccttccaccctcagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctactgtatccaccccacgtggtgtccctggaggtgggtgtgggggctgtcggcgatggtggcagctcaggccaagagagggtgggctgaggacaggagttgcaccgcacatctctgtggcttaggctggggggcaggggcaggtagagatgagggtggtggcaagggacagggtggaggttcggggtctgtattccatttacttctccataaatggcaccttttccttaaccttgctgccccagtggtggccaccacatcgaagaatgccaatgcctccctggtgtactccttcctgtataagacaatagaggtaggtactagcctcccattggctaactggtctatccgtctatccctcttgcccgcctctttcaagattcaagatccttttctgataggaagccttcccagatctccctgggtcttcccttttttttttttctggtagagatggggtcttgctatattgcccaggctggtctagaacttctggattgaagcaatcctactgccttggcctcccaaagcatgggagccaccacgctcaccccttccctggggccttgtttgagtctctgtgcatccgccatcaaagccccatcactctgcatctcatcagctgcttatgaagtcatctctccctaaaggacagggaccaagaatgtctcagagagcatacggctcagctaagcccaaggacttggcatccaatcccagcttccctgcttcctcactgtgtgaccttgagcaagtgacttcttgtctctgtgcttaaaaaaaaaaagaaaaaggccaggcacagtggctcatgcctgtaatcccagtactttgggaggctaaggtgggcggattgcttgaggccaggagttcgagaccaggctggccaacatgcagaaaccccttctctactaaaaatacaaaaattagccgggtatggtggcacctgcctgtaatcccagctacggggaaggttgaggcaggagaatcacctgaacctggaaggcagaggttgtggtgagccaagatctcgccactgcactccagcctgggcaacactgtgagacttagtctcaaaaaaaaaaaaagaagccaccatacctgcccttttttgcctaatttttcaagcattcagtacactttttcttttttcttttttgttttttcttttgagacagggtctcactttgttgcccaggctggagtgcagtggcacaatctcagctcactgcaacctctacctcctgggttcaagtgattctcctgcttcagcctccctagtagctgcaattacaggcaggtgccaccatgcctggctaatttttgtatttttagtatagacggggttttgccatgttggccagctggtctcaaactcctgacctcaagtgagctgcctcccttggcctcccattgttgggattacaggcatgagccaccatgcccggccttttttctttttgagacaggggcttattctgttacgcaggctggagtgcagtagcatcctcatggctcactgcagcctcgaactcctattaaaatttttgttgttgttgttagagataggggctcatggccgggcaccggtggctcatgccataatcccagcactttgggaagccaaagtgggcggattacgagatcaagagatcgagatcatcctggccaacattgtgaaaccccgtctctactaaaaatacaaatattagctggccctggtagtgcgtgcctgtagtcccagctactcagaaggctgaggcaggagaatcgcttgaaccccggaggcaggagttgcagtgagccgagatagtgccactgcactccagcctgggtgacagtgcgagactgtctcgaaaaaaaaaagaaaaaagaaaaaacgagataggggttcactatattgcccaggctggtcttgaactcatgaccttaagtgatcctcgtgccttggcctcccaaggtgctggggttacaggcatgagctactatgcccaacccatagccacacttttgtgggtctctctctcctccaacccccaggtattctgcgaatacttcaaggagctggaggaggagagcatccgggacaactttgtcatcgtctacgagttgctggacgagctcatggactttggcttcccgcagaccaccgacagcaagatcctgcaggagtgagtggacccctggaggcagccatgggctggactgtgggtgtaaggaactggaggaggtccacggaggtgtccctgggtccagctgcttgtccctgccgccctccctccaggtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtgagcctgcacacctccccggcaccccttccacggcctggctgcaggagacggagtttgatgcctgctaactatacccaacgtcctccctcaggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgtaagcatttaggggacctttcttctgagaaatgcacaggggagtcgcaaacccgccccacgtggggacttaagagaatcgcagcccgttttgaaataagcgctcgctcaccatctgctgatcacggccagtattgcagccattggctgactgcaaaggctgtttcatgattgagcgactattgggtgccaggtgcagttttaggctctgaggacacagcagtgaagaaaaagacaaacccgcgttcttacagagatgacatcctactgggaggaggagacagaatagcatcttatttatttatttattttgggatggggtctcgctctgtcacccaggctggagtgcagtggtgtgatcatagctcattgcagccttgacctccgaggctcaactgatcctcccacctcagcctctcgagtagctgggactacaggcatggaccacctactttttaaattttttatagagacgggggtctcgctatgttgcccagtctggtctaaactcctggcctcaagcaatcctcccaaagtgctaggattacaggtgtgaactactgtgcctggctcagcatcttatttattgactgattgattgatttaagatggagtctcgctccgtcacccggctggagtgcagtggcatgatctcagctcactgcaacctccgcctcctgggttcaagctattctcctgcctcagcctcctgagtagctgggactataggcaccagccaccacgcccagctaattttttttgtatttttagtggagacgaggtttcaccatgttggccaggatggtctcgatctctttaccttgtgatccgcccatctcagcctcccatagttcggggattacaggcgtgagccaccacgccaggcctcagcatcatatttaaaagccagacactgccgggtatacagtggctcacgcctgtaatcccagcactttgggaggccgaggagggaggatcacctgaggttgggaatttgagaccagcctgaccaacatggagaaaccccgtctctactaaaaatacaaaattagccgggggtggtagcacattcctgtaatcctatctactcagtaggctgaggcaggagaatggcttgaactcgggaggtggaggttgcggtgagccaagacgtgccatcgcactccagtctgggcaacaagagtgaaactctgtctcaaaaaaaaaaaaaaaaaaaaaaaaaccaagccagatcctgtacagatactaggttcagattccagctctactgtgccagtttttgctcattctctctgggccccagtttccccatatgtgaaataggtgacagtggtcggcaggaaaggtggggatagggatcctttcctggttcccagggtcactctccactctccactctgagtttcaggcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtgaggcagggtccagccccatctgggtggagtaggttggggtaggctgaagagcgaccctgggcccagcgcagtggctcacgcctgtaatcccaacaattttggaggctgagtcgggtggatcacttgaggacaggagttcgagaccagcctggccaacagggtgaagccctgtctctactaaaaatacaaaaattagctgggcatggtggcacatgctgtaatcccaggtactggggaggctgaggcaggagaattgctttatttgttttttttaatttttattattattatttttttgagacggagtctggctctttcacccaggctggagtgcagtagcgctatctcggctcactgcaagctccgcctcccaggttcacgccattctcctgcctcagcgtcccgagtagctgggactataggcgcatgccaccgtgtccagctaattttttgcatttttagtagagacggggtttcgccgtgttagccaggatggtctcgatctcctgacctcgtgatccgcccaccttggcctcccaaagtgctgggattacaggcgtgagccaccgctcccggccgagaattgctttagtccaggaggtgcaggttgcagtgagccaagatcacgccatggcacttcagcctgggcgaagaagcgagactctgtctcaaagaaagaaaaaaaaaaaaaaaaaaagaagagagtcaacatggagtctccaagaactctccccttcttcttcccacaggtcaagccactgatctggattgagtctgtcattgagaagttctcccacagccgcgtggagatcatggtcaaggtgggccttgggggaatgcttattaacaatgcatgatctcgggtgggtgcggtggctcacacctgtaatcccagcactttgggaggccggggtggttagatcacttaagcccaggactttgagaccagcctgggcaacagggcgaaaccctgtttctacaaaaaatacaaaaattagcctggtaaagtggtgagtgcctgtagtgccagttagttgggaggctgaggtgggaggattgcttgagtccaggaggaggaggttgtagtgagacaaggactctagcctggatgacagagctagaccccatctccaaaaagaaaaaagaaaaaaaaaatctgttatcaaataaaataataactctcctgtgatggactgaagggtttttttgtttgtttgttcgtttgttttttgagaaagagtctccctctgtcactcgggctggagtgcagtggtgtgatctcagctcaccgcaacctctgcctcctgggttcatgccattctcctacctcagcctcccgagcagctgggattacaggctcctgccgccacgcctgcctccatctccccaagtgctgggattacaggtgtggcccaccacccccggcttttttcaacaagcctttcatatgccctctcagcccaggcctccacaatcctaaggtggggacccttatcctgtccattttacagatgaggaaactgaggcacacagaagttaaggcatttgcctgcagatacacagccaacaactgttagaactcaggcccacacccatgaggctcgagaagccctgttcttggtgccttccatgtggacagcaccatacacctttgcctgattcaaaatgaccccttcaggctgggtgcagtggttcatacctgtaatcccagcatgttgggaggcggaggcagtaggatcacctgaggtcaggcgttccagaccagcctgaccaacatggagaaacgctgtctctactaaaaatacaaaattagcagggcgtggtggcacatgcctgtaatcccacctacttgggaggctgaggcaggagaattgcttgaacccaggaggcggaggttgccgtgagcggagattgtgccactgcactccagcctgggtgacagagagagactccgtctaaaaaaaaaaaaaaaaaaaaaggccaagcatggtggctcacgcctgtaatcccagcactttgagaggccggggtgggcggatcacgaggtcaggagatcgagaacatcctggctaacatgctgaaaccccgtctctactaagaatacaaaaaaaattagctgggcgtgctggcgggtgcctgtagtcccagctgctcaggaggctgaggtaggagaatggcgtgaacctgggaggcggagcttacagccagccgagatcgcgccactgcactccagcctgggcgacagagtgagactccgtctcaaaaaaaaaaaaaaaaaaaaaaaaaaaagggcttggtaaatatttgaaggatgagcaagcgaattcttcgtgccccatgctcgctcccctgacaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggtaagtaccagggactggcgggggatctgggggtggaggggactggagtagtgtgggggctgcccaggagccatgagaacaaggcagagaacaaatcagagacccagtcaggtgtgatggctcatgactggaatgccagtactttgagaggctgacacgggcagatcgcttgaacccaggagctggagaccagcctggggaacacagtgagaccctgcctctataaaaatattaagaggagctgggcgcagtggctcacgcctgaaatcccagcctggctaacatagagacggctaacatccgtctctagtaaaagtacaaaaattagctgggtgtggtggcgcatgcctgtaatcccagccactcgggacactgaggcaggagaattgcttgaacccgggaggcagaggttgcagtgagctgagattgtgccactgcacactccagcctgggcaacagaacgagactccgtctcaaaaaaaaaaaaaaaagattaaaaggccagacatggtggctcatacctgtaatcccagcactttgggaggctgaagcgggcagatcacctgaggtcagaagttcaagaccagcctggccaacatggtgaaaacccgtctctactaaaaatacaaaaattagggcagggcacggtggctcacgcctgtaatcccagcactttgggaggccgaggtgggcggatcacgaggtcaggagatcgagaccatcctggctaacatggtgaaaccccatctctactaaaaatacaaaaaattagccgggcgtggttgcaggcgcctgtagtcccagctatttgggaggctgaggcaggagaatggcctgaactcgggaggtggagcttgcagtgagcagagatcacgccactgcactccagcctgggtgacagagcgagactccatttcaaaaaaaaaaaaaaaaaaaaaattagccgggcatgggggtgtgcgcctgtagtaccagctactcaggaggctgaggcaggagaatcacttgaacccgggaggcggaggttgcagtgagttgagatcacgccaccgcactccagcctgggtgacagagtgaaactctgtctcaagaaaaaaaaaaaaacttagaaaaaagaaatacaaggccaggcgcagtggctcacgcctgtaattcccagcactttgggaggctgaggcgggcagattacgaggtcaggagatcgagaccatcctggctaacactgtgaaaccccgtctctactaaaaatacaaaaaaaaaaaaaattagctgggcgtggtggcgggcgcctgtagtcccagctaccgggaggctgaggcaggagaatggcgtgaacctgggaggcggagcttgcagtgagccaagaccgcaccactacactccagcctgggcgacagagtaagactccatctcaaaaaaaaaaaaaaagaaaaaaaaagaaaaaaaaagaaaaaagaaatacaagtaaatcagagaggtacgtatgtatgcaagtgatcaagcttgaaaccaggccagtctatttcacagacgtgtaaacttccatgacgggaagtgtgtggatttaaatatccccctgccaatgtcttgaggaaaccagccctgggttcaccttcctcactattgctttgctgagctgggtgggtttgggaaacccatttccacttaaggaggctcagtttgcctgtctgtgaaatgggcaggatgaggtgacccacatcccttggctactagaggttttggtttgtccccatgatcttgggagaggtggatcatcagtgcctgtaaaacaggacatggtagttaaaaaaagaaaaaaaccctgattgggttttgcagtcagaatcttccctggtgagtctctgtcacccaggttggggtgcagtggtgagatcatggctcactgcagcctcaaactcccagactcaagggatcttcctgcctcagcctcccaagtagctgaaactgcaggcatgttccaccgcacccagctaatttttaaactttttgtagacatggtatctcaatatgttgcccaggctaaggagcctttattttcctgtctgtgaaatgggctgtgagcagatctgactccaggggttgctgaaaggaaggtctcgggagggtaggcggaccctcgtgtacctgatgcccccatgttccctcaggggggcaaggagtacttgatgcgagcccactttggcctccccagtgtggaaaaggaagaggtggagggccggccccccatcggggtcaagtttgagatcccctacttcaccgtctctgggatccaggtgagagaagcaggcagggaggatcctccccttgacttcggtgggttcccctctctcctgtcccttggctcgagtcacctcagtcccctggcctgtgtcaacactcctctgaaggctgcctggtctttcccagagcaatgttacctttatctgcccacagcctgtgctccctctcccccggcctgtgccaccttgttccccaccggcttgttcacttctgtcccttctccacctccaaagccattcaccattccgttgcctgtgccacctcatccccctaagaccatgtgatatcccctcatcgatcccagcctgtgccacatagccgcttggcctaagccgtctctttctccctggccctggcctcctccctcctgcaatcctggaccacctcttttcattcccttccaggtccgatacatgaagatcattgagaaaagtggttaccaggccctgccctgggttcgctacatcacccagagtggcggtaaggcagcccagctcctggggacaatggggtgagggaaaggcagtgggtagggactcgaggctttcaccacattctggctcagaaaaccaacaagggtcaggtgtgatggttcaggtgtgtaatcctagcactttgggaggccaaggcgggtggatctcttgaggccgggagttcgagaccaacctggccaacatggtgaaaccctgtttctactaaaaatacaaaaattagccgggtgtggtggtgtatgcctataatccaagctactcaggaagctgaggcagaattgcttgaacccgggaggtggaggttgcagtgagctgagatcgtgccactgcactcctgcctggtcgacagaaaccctgtctcaaaaaatgaaaaagaaagcaaactgccccttcttgtcatggcaccctgggccttggtttgcacgtctttaaaatgggggcagttggctgggtgtggtggctcacatctgtaattccagcactttgggaggctgaggtgggaggaccgcttgagctcaggagttccagaccagccttggcaacacagcaaaaccccttcactacaaaaaatataaaaattagccaggtgtgatgtgcacacctgtagtcccagcaactcaggaggctgaggtgggaggatcgcctgagcccaggaggtcgaggctgtagtgagctgtgattgcaccactgcactccatcctgggcaagagtgagaccctggctcaaaaaaaaaaaaaaaaaaaaaggaaaaaaaagcagggacagttgtcagcgtcagttctagggtggtcgcgagtttggagaaggggctgaacatatagcacctccatctgctgcctggaaactgccttgtttctatggttacagtacctgtgtttagccccattcttagccttgttgatcatgagtgctgggataggggatgaattgaggggctgtgggaggctgtccctcttccttcacccctccccatttcttttcttttttgagatggaatctcactctgtcgcccaggctggagtgcagtggcgcaatctcagctcactgcaacctccacctcctgggttcaagcaattcttctgcctcagcctccctagtagctgggattacaggtgtgcaccatcatacccagctaatttttgtatttttaatagacatggggtttcaccatgttggccaggctggtctcgaacccctgacctcaagtgatccacctgcctcgacctcccaaagtgctgggattataagcgtgagtcaccgtgcccggcccccctctccccatttctgagatggcccctcctcattctttctctgcagattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 38332 - DNA, 3830 bp, Homo sapiens
agaaagtcgacgggcgtggcgggggaggggacgctgagggcccatgtgctgaaaatccgaagtgccgcggaaagtggaggtgagggccgcccgccctagaggtgcccgtccgagaggcaggtgcgggaagagcctatccttttccctggccatggctcagtcgcctccccagggtttatttgcaccggaagtttggagcgggtgggtgctgaagacagctaggccttggcgatgtctgggatgaggctggtgggggaagcctttggagccgtgacctgagagggcagaccttcgaccccactacattgcactgcgccttcagaacatgcagggaaaaccccactgcgggacgctcaccagcagcatctccagattgtgaagggaaagaagggaaggatctcgggggcatgcaagctgctctgggctggggtggttcagacctggattgactgaggtgaaggggctccttgcagcaatcacacagaaggctcgggtcttaagattggccctgctcctagtcaagctgtatgaaccagggtagtcactccggctttcagggccttgatttccttgtctgtaaaagggactttacgatgcatctggcaacctcaccttcctcactgggcaatgtgaagaccaaatgccggcaatgaaattcccagcattaggtttgtcatatagtagtcctctctaagcatttgttgaatactcacaggaacacttaggccagtcagcattaattgaaaataacaggtggggtttttttttgtttgtttttgtttctttttccgaaaataacatcaggcctttatactgagaagtataaagaagaaaaatgagccagtatctcactgttcagataaaccgttaatacatatttttaaatgcacatggttagaaaatgcaaacgttacgggaaggaacaaaatggaattaacagacctcccaaacagttcctctccccttaaacaagtactttggtttcttgtttcctttccataaatataactgtgctggaatatatatttgtatatttaccccacagggataataatacattattttgcaccttgctttgttaaaatatttaaaataatttaaatgacacccacaaccctgtaaatgtttatggatgatgaaactgaaattcaaaagttaaattgctggatgggcgtggtggctcacacctgtaatcccagtactctgggaggccaaggcagatggatcacctgaggtcaggagttcgagaccagcctggccaacatggtgaaaccctgtctctactaaaaatacaaaaaaaaaattagcgggtcatggtggcacatgcctgtaatcctagctattcaggaggctgaggcaggagaatcgcttgaacccaagacgcagaggtcgtggtgagctgagatcatgccactgcactccagcctgggcgacagaacaagactccgtctcagaaaaaaaaaaaaaaaaaagttaagttgcctagcgtcatacagtaagatgatggtggagcagggagtagaacccaggtggtctgacttccttgtccagggctctttatgccattgtagtatctttatttgtctttgaagttagggttcatttttatctataaaatgaggttaatcatgacttcttcatttggttgtccttaggcataaatgagatacaggaaagcacttagcatggcacgtggtaagttgcaagtattcagttaactgaagcacttaccatttatgccttcagttcattcaccacctcattaattgagaatcgagtggtttagagaacatacttagttgggaaatttaggactcagtaattctagagtctggccctgggtccttttcctttagaaaaggagctatcttagggaggagtggttatttcctatctgaggataggaattctaagtgggatagggacattttaaccccagtttttatttctgctacctatttgttcatttcactgatttacaactgcctaccttttggccgtatgccagcgttccatcctctgttttcttcctatcctgctgttcatacattgatttaataagtatttgttaagcacctactaggggccaagctctggattcaagagtgagatagataacatggcccttgtccttaatgaattttttggactttgaagtcagatatatgtgggtttgaatactgattctccaatgtagtagctttgtaatcataagcaagttacttgacctttctattttctcatctataaagatgataacctcttgtgaggattcaatgtgatgaggtccattgagcaatagagtaagtgctttaaaaaatgttccttcccttgcctctttgttcccgtttctatccatctgcccagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtgagagcctcatacagggggtagagtgatggggaacctcctgggcaaggatccccctccctaaccttcgtatcttcccacaggtggagatcctagaaggcaaggatgccgggaagcagggcaaagtggttcaagttatccggcagcgaaactgggtggtcgtgggagggctgaacacagtaagttgagagaggggatggggatgctcaggaagcctgtctcatctgtccctctccattcagagcagcacagggtggcaggagactggctgaggggatggcggcattactgaaccttctacttttcaacttgggctgaatgcgccgagtagcaagggcaaacccctttcacaccccgtgctttctgacactcccctctcttggacagcattaccgctacattggcaagaccatggattaccggggaaccatgatccctagtgaagcccccttgctccaccgccaggtcaaacttgtggatcctatggacaggcaagcaacggggctctgggcagagggtttctcaccctctgggtccaaaaagtgctgtccaatgggaatggtgggttggatgctctggaaattaagagggaccatctcatggacatgattccctgcgggtaaccccaacacagaggtggagaaacgcggtggtaacccttgtgttttgaaccactgactcttttgggttggagggtggcaggaagcctggctcgtaggccaggctcacctcttctatccaccaggaaacccactgagatcgagtggagatttactgaagcaggagagcgggtacgagtctccacacgatcagggagaattatccctaaacccgaatttcccagagctgatggcatcgtccctgaaacgtggattggtgagagtgaggggcaggaaggtcaggggtgggtgctaggagtgagagtaggggacattaatgaaagttggcaagccctcccacccatctaagtttcctctggcttaacagatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 38333 - DNA, 25999 bp, Homo sapiens
agagctcgcggtggactccgacccggcgcaacatggccgcagcctcgcctctgcgcgactgccaggtacacggaggctgcccccaaccaggtccccctcgggccccgggtcctgggggtggcccggtgctggcggaataacgggagacatggcccgggcgcggggcgtggggtgagccctgggcgcacgggcgcgtccgcggcaacgcctggaagggacccgaggcccttcttgtagagtccccaccgagggaaataagggacgcctgtcagggtactcgggagaccccaagacctcctaaaaaacgtagctcactgggcatggctggggacgcagggaagcccgcaaaggtaaggggctccttggaaccggcccaggactgggagcctgagcccattttacagatgaggaaggtggaggtcagaggggccaggagacgtgtgtgtgttgaagtttgaagggctcctggagagaaggcactgctattcccttcttgccgtctgtaggcctggaaggatgcgaggctcccgctctccaccacaagcaacgaagcctgcaagctgttcgatgccacgctgacccaggtatgcctgccgagagaggccgcggccccttctgtggaggtctaggggaaggttttttaattggggaaagctgtttttttgttttgttttgttttgttttgttttgtttttgaggcggagtctcgctctgtcgcccaggctggagtgcagtggcgctatttcggctcactgcaagctttgcctcccgggttcacgccattctcgtccctcagcctcccgagtagctgggactacaggcgcccgccactgccctcgactaattttttttgtattttttagtagagacggggtttcaccgtgttagccaggatggtctcgatctcctgacctcgtgatccgcccgcctcggcctcccaaagtgctgggattacaggcgtgagccaccgcgcccggccatggggaaagctttttaaattgcgccatgaccttagcaatagatggcagcacatctgtgcactttgtactggaggacgtgggagggtggggacatatctctgccccccccccacagcgtcctaaaagggcctctgcactctcccttcttccccaggactctgagtggtgggtggacagcggtgggtgcagtggggatgttttttgaggatgctggcctccccgggcctcccattgtggcctgctgagggtctgatgcagggctcggctgcttaggacgtgggatcctgtcctgggatgaatctgtgagtatactgccttcacctaggctgtgccaagaccttctgccacattaccagtcatttctctaccaatgaagggtcctatagttttagaactaggagaagtctcagaagtaagatccaactagcttccttgacaagtggggaaactgaggctcagagttgaacctacttgacttgaaggttgtccatgaattacaggcagaaccaggatgaacctgggcctaactgcactgatagaaacctaagctgaccttggcgtgggtggtgaggcccctgcatactgacttcatccacataacaggaggactcaggtagctcttagaagcctacgggctgaacaagagaggactgatggaatgctgtgagctgcgccatgggtgcctctcctgttcccagcctgccctgccaagggactctgctgtgggcatctgagttgtttgtttattttgtgtttgacctggctcacttgcccttcctgtatctcgccggcctctgtagagtactcgatttgttttttgtttgagacggagtcttgccctgtcacccaggctggagtgcaatggcgcagtcttgactcactgcaaactctgcctctcgggttcaagcgattgccctgcctcagcctccgaagtagctgggattataggcacgcaccatcatacccagctgattttttgtatctttagtagagacggggtttcaccatgttggtcaggatggtcacaaactcctgaccttgtgattcccctgccttggcctctcaaagtgctgggattacaggcgtgagccactgtgcccggcccctagtactcagtttgttacacaccacatccccaatcagtggcagctcatcctcccagcctgggtatattttgtcccgtgtattggtgtctctgtgctgtcctgtgttagaacttggcttctttaaatctctgtgccaaccctcctgtatcttgtcaaaatgcttgcgtagcttatagtctcagctatttgggaggctgaggcagggggattgcttgagcctgggcggttgagactgaagtgagctgtgattgtgccactgtactccatcctgggcaacagagcaaaccctgtcttaaaaaaaaaatacacgtactaattctgtgtagatgtaggttagacagctgaaagggcatattttaaaatctaatgtgtgattataggtctaggactttttttaaaacaggcatttgagtaaaggaccaggtacaaatacagcaaattgttaaaaatgatgatgcgctgggcgcggtgactcacgcctgtaatcccagcactttgggaggctgaggcaggtggatcatctgaggtcaggagttcaacaccagcctggccaacatggtgaaaccctgtctctactaaaaatataaaaaaattagccgggcatggtggcatgggcctgtaatcccagctactcgggaggctgaggcagaggaattcttgaaccagggaggtggaggttgtagtgagctgagatagtgccactgccttccagcctgggtgacagggcaagactccatctcaaaaaagaaaaaaaaaaaattagccgggcgcagtggtgcacacctgtaatcccagctactaaggagggattctcctaccaaggcaggagaattgcttgaaacctggaggcagaggttgcagtgagccaagatcgtgccattgcactccagcctgggtgacagggcaagattctgtctcaattaaaaaaaaaatgataaaatgagctttgggtaagttttatctttcagcttttgtgtctttctaactctctaaaataaatgttttctgtgaatatttttaaaacgaatgaataagaagcaggaatattcctatcgtgaccaacttcagggctcctcttagggcagaagaagccgatgtggagcaggtcacctgtcaggaggaacctgccttttctttcttttcttttttcttttttttcttttttgagacagagtctcactctgtcgcccaggctggagtgcagtggcgcctgggttcacgccattctcctgcctcagcctcccgagtagctgggattacaggcgcccaccaccacacccggctgattttttgtatctttagtagagacgggggtttcaccgtgttagccaggatggtctcgatctcctgacctcatgatccgcccacctcggcctcccaaagtgctgggcttacaggcatgagccaccacacctggcctttttttttccttttctctgtcacccaggctggggtgcagtggcacgatctcagctcactgcaacctctacctcccaggttcaggcgattctcctgtctcagccacccaagtctcagccgcccaagttgctaggactacagacatgtgccaccacgcctgactaatttttgtattatttgtagagacagagttttgccatgttggccaggctggtctcaaactcctgccctcaagtgatccacccgcctcagtcttccaaagtactgggattacaggcgtgagccatcgcgcccagccagaacctgccttttgatgtttcttttttggaaatgcagcatccctagccctagaaagtgtgccttgggtgatgtgtatttcatttcttcgtatgaagaaagttatcagccaggttatgccttctttgggttagagtccagaaaatactcagtgttctacaaagaaaaacaaatctggatttatttttattttttgttttttgagacagtctctctctgccatccaggctggagtgcagtggcacaatcttggctcattgcaacctcagcccccgggttcaagtgattctcatgcctctgcctaccaagtggctgggactacaggcatgcaccaccacgccccactaatttttctatttttagtagagatggggttttaccgtgttggtcaggctggtctcgaactcctgacctcagatgttctgcccgcctcggcctcccaaagtgtaaacctggatttagagccacctttgttagaatgatccaagggctccgtgaggacttgttttgcttttcccatttcagtatgtaaaatggaccaatgacaagagtctcggtggcatcgagggctgcctgtcaaagctcaaagcagcagatccaacctttggtgagtaacgccttccctgggtggaggagccccgcttcacacatccagcccctctctttcctttaccacagggacacagttgggatggggaaggcaggttgggtggcagcaaccagggtggcatttgcacagagggagagaagatgacagctgcctttgtgtctggaaaaacagtcactcccataaagatgccaggttctatcagaaggcatttttctcatcttttctttaattaccatcaattcgggaatgaagatgctgatctcatttctcagatgaggaaactgagggttggcaagagtaagactgtacttaaagccacccagctggtggttgacccctgggattagataaagcttcctgaatccaaggcccagacccctggaacatgagaggtggctgctgcagcctccgtcaggggaccagtgaggcctcatccagagtggccagggtgaggtggtgacagaggctggcatccaggcaagccatgtgtacagcgggcatggggaagccagcacagtgcattgcaggtgggtggtcccgtggtgcggcaaggttccgggcctgggagaaggtctgatgaggggacagggctcttgtcagtgcggcagggacacccttctcaccctgctgcagcctagtcagacttaaggcaggggacttgtactgccctggagaagacaaacaaggaaataactgggggagaacgggggagccaaacccagtcatggggagccaggagccaggggtgggctcggactctctgagcagaccttgagccctgatcagggggcttcgaccacctgaatcatcagctgggctgggctgggctcgaccatcggaatcaccagctgttttccagggtccacatgggtggtcctagcacactatggttgggtcctgggtcccaggcctgagccagtgaccaagttccaaatgccagtggacaccctggctctcccacagtggggcctgggggcctgcactcctgccagcaaggctgctgcgagggccacaaggcactcacccccaccctaacttttagcatgtgtgagcagcacagatgggatcatgacttctgtgctccggggcctccttggtccagccccttatgagcagcatccactgatgcctcccgggagccgtgtgctggctgtggcggtagtgtcagctgatgagcctgcaggcagcctctaagtggctcatccattgaagggggaaggtgctttagacactggcactcagcagaatgccctcactagaaaaatgttcaagggtgcctttaggcttgcagttccctccatgcttgacaagagccgaggctgagttctagacagtaggcagggccacagtgcccagcctgctgctgcctggctggcccctcctgggacgtggggtgtctctgtgacatgtggagtctgggctgggatgggctgagctggaccatctgaaccaccagccgttctctaacctcccaccagtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggtgaggggcctccctgggctgggagctggcaccctgaggctgagctgggggagtggcagggtatccctttcctgatgcccttgggacgggggcggggtgggagaatgcttctctccctgcctcctgagatgctctgatggaaaatcgcatcctgtctgcttccctattcttggtggagtgctgagtgaggaagcagttggtgaagattcccaacttagtgtccaaagtaacttgctttgtttcattaagtaaattatatattattttccttacaaaaataatagggtcacactacagaaattactaggttagggaagagagaagaaaacatgcttcttctagtgagaaataaacaatcaaatcaaatcttcacccataagttccttgctcttgcactgactttcacatcatccccccgctgttcctatgctggttccctcattctccgggacagcccccatgtctgctcaggcaggcgagatgccctgcagagttaggcgaccctagccgattgtgcagggactcagggattccgaaccctgagactggggaggtgcggcctggtcttcctggtaagtcagcccaggtgtgggttccacctcagagacttcctgtggctgtctcacggtctccactgggattatctttggcaatttgttaaaccagtttttttttttttttaaattgaactaaagagtaaaagttcccactgggttttcagtttgttttctgattcacaacctaacatagaaagtgatttttttacatttatttatttagagttttgctcttgtcgcccaggctggaatgcagtggcgcaatctcggctcactgcctccacctcccgggttcaagtgattctcctgcctcagcctcccgggtagctgggattacaggcacatatcaccacaccctgctcatttttgtatttttagtagagatggggtttcaccatcttggccaggctggtcttgaactcctgacctcgtgatccacctgccttggtctcccaaagtgctgggattacaggcataagccaccgcacccagtcagaaactgatttttaaaaaaacacatccatgtagaccatgacactggtgagaaacaatgcctcttacactccctgtgtgggtggactatgtgttcagcgttggtgagaaatctttctcggtttccaggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcaggtatgtgccagctggaaatcacattatttctgtttcttaatctctcttttctgccctaaaaatatggtgactctcttggccctgtcctaaaaataatgggaccactgttgctattctcctagttccttaaagttcaaaggcctcattttcttcacttgattttcatcccacctgtgaatgaggtagtaccattatgtatcagtcagcatgggattgtttttgctgcagtaataaacatcccctggttcttcttccccaaagcttattacagcaaaggtttatttttcactcatactacgtggctaccttagaagggctgagggctctgccaccatgtccttgtctccatctgggatcccagctgatgaagcaactgccctctggacatacctgtcactaagagggaaaagcaagctttccttggggggcttacaatggcaattaaaggtttagaatgaaaggataccctgccactcccaagtcattggccagaactgatcacatgacctcacccacccacaagagaccaggaagtacagttctaccgtgtgcttgggaagagaagaaggcctggaatgtgcatgaacagccccagtgaccaccacacaggactgacttcactgcagcttcattacagaatagttgtgaggttcggacaggttaataagctgtattatttagtcagcactctccagagaagcccagagagctctgagacagagagagagatggagatttattttaaggaattggctcatgtgagtgtgagggctggcaagttcaaaatctgtagggcagggcagcaagctggaaatcgctgcaggagtcagcattagtcttacatctggaggcagtctgcaggcagaatttcttcttctaggggcctccgtctttctcttaaggcctttaactgattggatgaggcccacccacatggagggtaatctgctttactcaaatcgcatctagaaataccttcacgagactgggcacagtggcttatgcctgtaatcccagctgtttgggaagctgaggcggtaggattgcttgagcccaggagtttgagataagcttggtcaacatggcaagactctgtctctacaaaaagaaaaaataaattaaaaaagttagccaggcatggtggcatgtgcctgtagttccggctactcaggaggctgtggcgggaggttcccttgagcccaggagtttgaggctgcagtgagctggcgatcatgccactgcactcagcctgggcagcagagcaagactctgtatctaaaagaatatatatattaaaaatatatatattaaaaaaatatatataaaatacatatattaaaaatatatattaaatatatattaaaatatatattaaaaattatatattaaaatatatatattaaatatatatatatatataaacatatatatatataaaaaatactttcaccgcaacacctagactggtgtttcgccaaacagctgagcaccacgggccagccaaattgacagataaaaattaaccgtcatgaaacctaatagtacctgacacacagcaaacatacaataaatagcttaagtgttgaggattaaatgaccccagtaaacaatacatatatatacatacacacacacacacacacacacacacacacacacacacatacattttaaagataactctggaagccagtgcttaagaacattgcttcaatgaataacaaaagctagaatcagtcttcttgcaaagtaatgaagctaacatcttagtctcaaacagaagccctattgccctattttgttttcacttaaccccgagaaaccacaggaaagaaaacttgtttcatgtgtgaccaccctagatactcgggtgcgcagttgcagatgagattggaagtgtgggcgggacgcaatggctcatgcctggaatcccagcactttgggaggccgaggcgggtggatcacctgaggtcaggagtttgaggccagcctggccaacatggtgaaaccccgtctctactaaaaataccaaaattagctgggcgaggtggcatgtgcctgtaatcccagctactcaggagactgaggaaggagaattgcttgaactcaggaggcggaggttgcagtgagctgagattgtgccactgcactccagcctgggcaacagagcgagactctgtctccaaaaaaaaaaaaaaaaaaaaaaaagagagagattggaagcgtgcaattattcagcagtgtcttctagcccatcctgggctgggcctgggctgaggctgagttggacagacaggtcccagcctgtgggagctccaggtctggggaggacccggccattcactgagtgcattccaggccgggcaggggactgtgtacagcactgcagaagtcaaggaggagctgttgacagcccacaggtcacggaggcttcccagggaggtgcccctgggtcatgcctctgggtggatgtcaccatgcagacaggagcgggaggagacccttgttactctcagtggagacccgtgttgattcttagaaggtgggatgctaattgaggagcagggccgctctccgtgctgggcttggggatgattgtgcggatgtaatgttcaccttgcccctcaccagtcagaagcatggaattgctgacaagcacagagcttggcgtggggttggaggttgcatcagtctcctgcggttgctgtagcgaagggctgcaaactgggtggtttggagcagcagacaggtactcacagctttgagggccaagagtcccatctaaggtgtcagcaagggcagtgccctcagagcctcaggggtgggtccttcctgcctcttccaatttctggtggtgcccagagttccttgaagtcccttggctcgcagctgtatcactctgccttggtctttacctgccgccttccctcggcatctgtgtcttcacacggccctcttgtaaggacaccagtcattgcgttagggcccaccctaatcccgtatgacctcctctaaacttattacctctgcaaagaccctatttccaaaaaaggtcacattcccagtgctggcagttaggacctcagtgtatctttgcggggacacagttcaacctgctacccatccatcattttgtattctgagatctttttttctgtttttagctatgtgaaaggcatctactcttttggcttgatggaaaccaacttctacgaccaggcagaaaaactcgccaaagaggtaagtgggtccttcctaaggtgcctgacccctcagggagtagccgttggctggaccagggcatatgaggggcaccattcgtgtgtgaccccggcgaaccccatccctggtctcacttcctcagagagactggggagctcatgttagtgtgagcagctgccgcccgccaggggctgtcattcacctgtggcccccccaaagtccccagagccacgttccttggctaacactggatccacgtctacagatgaggttgatggggtacggggagcctgtggtcagcctgctcacttagggttgcacagaatggcaggtctgggctcccaccagctctgcctggctccggagcccacactgccctgctgggacaggactttgtaggaggagaagtgtaaataagcgttggctcttccttcctgaacttcgcatttctaagcatcactcacggcaccagaggttcagggagctgagtgatgatcgccagtcatgatcattgctgggtgcccatgtgtacctgggcccagggctgggtggcaggctgcagctgtcaggcctggggcgcgaatggtctcacgctctgggggtccctctcctctactcctcttcttgcaggagtggaaactgaggcccatggaggggctgccatgcacaagggagtgacagctgctcctgtgcccggctctgtgtggcacttcatgtgtgtctgcttgcatccacacagctctgcccacgtgatgtccaactccttgttgcccagatgaggggcccaaggctcagaggccaaggctagagcctgcctaagaccacatggctcagagatggcagagccggattctacccaggctacctggcaatggctgtcctttcagctgcctgctccaggccctgcctcccaacatcctggctggggttcttcccccagtagttgccctagtcggcctgcagcatcctctctgggagacagcattggggcccaagggtcgctgcgctctctgaagactgctctgattacagaatccgagacttgaggcttgagtgatgtgttctttgctttaactctgagtcagggcaggtgggggacccgagtggctttctgacagtcttggttccatggcctgggtgaccagacagcaccatccaggggtcagctgtaggaaagtcccttggagaccatggtagctgggccctcctgtgggtggcatccatctgggcacctgagagctcctgggacatttggagaagctctggacaagggtagctgtggcaaaccagatgtggcaagtcccccgcactgagggtggccaaaaaaacatgcaagcccatgccttgcaaggagcaagaagtggtggatagggtcccctcccttctccattgctcccctttcgcctcctgtcccttgtgttgcaggcaccaactctttgtcttcaacaccagcaccccacagacaactactgggcaggaaaagcaggctgtgatggggccaggagtggtaacacatgggctctgtgtctgcagccccaggctggtgagggtaggaggagccagggcaggagcaggcaggcggcaggcacaggcacagccacagagcttggggacctggagctccatccaagtggctcaatgggtggaggcttagggaggaggcggcaagccagggctccaggagccagggctgtagaggggcaggtgaggactggattctgctgggccttgtagcctgggaatgcagtttggactccttcccacggaaccatgggagggctccaagagagggaagatgccagtcagctcatcagagctggtgacagccaccacccttcactcctgccattcgtgaaagcagcatgcttagcagggtcccgtctcggggccccacgcccgccctgcttagactgtgcccaagtgtcctgtactcagagcccctgcccaggggtgcccacggtcccctacagacacactttctttccctctgttcccacatggagtgggctgggcccacaaaagctgagtggtgggcagggaggcagggcttgctggggccgacctcctgccaaaagcctcacaggaggtgctgggccagggcagaagagcttggggcttctggacccctatgaaaggcgtggggagactgaggcagtggggctggcgggaactcatgatttggcatgggggacctgggcacaggccaggcaatggggcttctgtgagcctcagtttactgctccattttctaagctctgactgtggctgagtagatgcttagcaaacatgagctgaacacataaatagaagaaagaaacggctaggaggggaggatcattccatgagtcctgcctgcctcgctggtcgctgtcaagctcacaggtcatgggagcggctgttgtcatgaactgtgataacctcagagccagctgtttctgcacccagaaagccacgtgtcctcacatatatggtagtgggaagaggcagtcacagccactggaggacttgatagttcacaccacgttcacatgggcagtaaccacttctctaagagaaaggcagcatccgtggccttccaggcaggcggcagctgaggcccagagagggcgggtatgttttgcaagcacctcagctgtatgcagaatgctgtgggcttgggtctgagccctggctttagaaagatcctgctgctgtccagctgggtgaagtcgcatagcctccctaagactcagcttcctcatctgtgaactgggcagtgagacccatgagctggtgtgcccgggcaggcaggaagtggtgctaattgtcagtgttttgagtcagagccccgcccccccacttgctccaccccgttcagcccaggcccctcttgccccttagagacctgccgtcgcctgccccggcagcctgactgatctgctttatctggaatcctcttccccgcaccctgcgtaggctttatctattaacccgacagacgcatggtcggtgcacaccgtcgctcacatccacgagatgaaagcagagatcaaggatgggttggaattcatgcagcactcagagaccttctggaaggtatgatgcttgtcaatgggtcacctccctgggaaattcagtgcatccccttgagtcaggccaaggctttatggacaagagttacagggcatggcttaattctcggggttccctctcctcctccacctgcacctgcctcaggtgtttggctgctgagcagaatgcaatcaagattccagtccccaccccaggcccataccttgccctagggactccactgagggtccagcccagacttctctgtccttacagggcctggtcaggaggagcgagcagcctcttcaaagcacatgagctgcaccatgacggggaccctctgtgggatgtggaaacgcagaggaagcattaaactcaactgggcttggggggacagtggctagggaaggcatcctggagggggcaacctctgagttggctactgaaggatgagcaggtgtgtgccacacagagggggaagatggagggcatcctagcccgtcactagcttgagcaaggcctccaaggcctacagtggcctgtgagggagaggagagctgcttactttggtgtcctagagcccaggtacaaggcggacatgggctgtgcaggaggccttgtcagtccctctttccaggggaggcaaggtggtgtccaggcagaggcagaaacgcctgcagaggcctcagggaaggaaaggctagcaccatggtggaggtgggccctctggacagacggggctgcatcaggtgagcctattgggctcaagggagatggggcctcccctgggacagggacacagcgtcgctcactcagcgtttactgaatacctgctttgtatttggggcagcaagaaatcagggaagggtgtgcacttggctcccaagcaggggccatgcagtctgagccttgctgcggaggatcctcgggcctccagattcggctctgtcaagggggcagtggtcaggttcccttctcagggacactgaggtttgtttgaggtttctgagtgctgggcactctagcttgttgaggatcacgagtccagtctcctgagcttggaaataccctagcaggggccagctctgagcccagcacaggtcctactttaacactgcttcatactgagggcagcctaaggtagccacccacataccacccactcccctggctctcggggctttgccagcacctgttggagtgtggccctgggcctgttgatctctgcaggtttttgtttttgtttttttttgagacaagttctctctctgtcgcccaaggtggagtgcagtggcacaatcagggctcaccgcagcctcgaccgcctgggctcaagcgatccttccacctcggcctcccaaatagcagggactactggtgcgtgccaccacacctggctaattaaaaaaattttttttttttagagagacagggtctcttccctatgttgcccaggtgggtcttggactcttgggctcagttgatccttctgcctcggcctcccaaagtactgggattacaggcatgagccactgtgcccggctgatccttgcagttttatccaagtgccctgagctgtttaggcacccatgggcctcgcacctccctgtggagtggttctgttaatccttttctcaacttcacatgtgaggaaggcaaagctggagttgctgaagtaacttcctctgcaccggtcctggggctgctgctccccagctcaggcgagtaggttgggaacctcccctagcctcagtttcctccttggtaaatgcagcataatttcttcaccgcccttcggaatggaagaagattatgtggcctggaggcacctagtgcagaatattgtttcctgcactcaaagatgatggtttctgtggctaggcgcggtggctcatgcctgtaatcccagcactttgggaggctgaggcgggcggatcacctgaggtcagaagttcgagaccaccctggccaacatggtgaaaccctgtctctaccaaagatacaaaaattagccgggtgtggtggtgcacacttgtaatcccagctactcaggagactgaggcaggagaattgcttgaacccgggaggcagaggttgcagtgagccaagatcgtgtcactacactccagcctgagcaacagagccagacttagtctcaaaaaaaaaaaaaaaaaaaaaaaaaaagatgatggtttctgcattagcacaaaacaacatttgtttttttcccataggccttcagacttttcataaattctctttttttttttttctccaggactctgatatgttggcttgtcataactattggcactgggctttatatctgattgagaaggtaaggtgaccatctgtttgcactgtcttatcctataaagatgtctagagggagaaagatttttctagcttttgctatgtattcacatccgttggagccctgatgcaatggagcattaacatttccaaagagcactctaggcttcaacctttttagggattttttcactgtggaggcctggaaatcacatctgtggtgtataacttgcagagaccattcagagcgagtgcctgtggctggagtggagagccaagccccaactccgcagggtgtacctgcctgggccatgagatcttccaacgggagccaggctatggggcagctgctcaggacacccttgaccccagtgattccgccacagggttccatgtacaagactgtcacttgcagtgctccttatcgtgcacaaaagctagaagctccctgaatgtccataaagtgagaaatgctgagaacatgagggccttgtcatgacatgagaatgtgatgatacagtgtctggaagacagcacagaacccagctaaatgtacaggagaggaaacatatgcagaaaagaaaaaggcagctgggcacagtggctcatgcctgtaatcccagcactttgagaggccaaggcaggcaaataacttgaggtcaagagtttgagagcagcctgggcaacatggtaaaaccccatctctactaaaaatacaaaaattagccgggcatggtggcgcctccctgtagtcctgagcctgaggcatgagaatcgcttgaacctgggacgcggaggttacagtgagccgagattgtgccactgcactccagcctgggtgacagagtgagaccccatctcaaaaaaaaaaaaaaaaaaaaaagaaaaaggctagaaagaaatacatgaaaaagcttgcagcagttagtatgagcaatacctatattaactttccactaggagagagaatgcttccacagcaactgtttcttcagtggtggcggcacaggtgctgctgtgctttctacactggggaaccaaagccccggttggaagcgggttcaccttctcccatcccgaatgccaccaagacaccgtccgtccacctctgagaggaggtggaggccggagaccatgtgctcaggggtctttggcctggccgttctcagttcacgtgccagcattacactttgccttctccagggtttaataaggagaactttattcttccagggcgaatatgaggccgcgctgaccatctacgatacccacgtaagttgcattcacaccgtgtttggtttgttgcagcattttgcctttgagtctcaaagagaccagatttttgagttcatcaggattgtcccagccagaaaaacagctggagcaagaacacatttcttgtgtaaggcctcatggggttaattttgccaagagcaatgttgtaaccctgcctatgatggggacagtggttggccctgctcaactcgagggtgctgatagatttacacatctaagggcctcacctctgcaattgtggactctcctccagccctttcagatcacttttctttggtaagacaactggtctacccataggaattttttttttttttgagacagagtttcgctcttgttgcccaggctggagtgcaatggtgcgattggctggaattttttttctttgctgtgataaaataaaaataacataaaattacgtgtacaaggccgggtgtggtggctcacacctgtaatcccagtaatttgggagtccgaggcaggtggatcatttgaggtcaggagttcaagaccagcctggccaacatggtgaaacgctgtctctactaaaaatacaaaaaaattagctaggcgtggtggtgggcacctgtaatcccagctactcggggggctgaggcacgagaatcacttgaacccaggaggcagaggttacagtgagccaagatcacgctactgcactccagcctgggtgacagagtgagactctgtctcaaaaaaaaaaaaaaaaagtgtatagctctgtggcattaagtgcattcacattttgcaaccatcaccaccctccattttcagaacattcttcatctacccaaactgaaaccctatacccattaaacactaactccccattcctcctccccaggcccaggcattcttttgagagggggaaaaaaaaaagcctgaagcctgactcacagctcccaaggaccccagggatggcttcatcagaaaagcctgggaccacagaaatgcttgtgatctggggatctaaacatcagagaaaaacacacagtaaatttcccttgaagtaatcctttctacacggtcaggaagctgtagtaagaaatgaagggtgggccgggcacggtggctcacacatgtaatcccagcattttgggatgctgagacaggtagatcacctgaggtcaggagttcgagaccaacctggccaacgtggtgaaatcccatctctactaaaaatacaaaaactagctgcatgtggtggtgggcacctgtaatcccagctacttaggaggctgaggcaggataattgcttgaacccaggaggcggaggttgcagttagccaagcttgcgccatttgcactccagcctgggcgacagagggagaccctatctcaaaaaaaaaaaaaaaagaaagaaagaaatgaagggtgacatacaccgtgagctcgaggtgggctcctcagcaaagctgagtctagaaacgtgatcgggcagacagccctcccaccagtgtggtctgaggcccaggggtgggaggtggcagatgctttgggcctggcctgggccctgggtatgcaatgcagtgggctctttcttcaggtctacctggtgacccctctagtgcttggagcagtctacaccccaggcaagggtgatgggcctgtcagttgaggtgatggggacagtggcagagggcttgctctatgcaggccccaccccacctggacaggctgaccctggctgtgcctgcagccccatcatctgggccacccgctgagcccgccttggccgccctgtcttccagatccttcccagcctgcaggccaacgatgcaatgctggacgtggtggacagctgctccatgctctaccgcctgcagatggaaggtagccatccctgcagccccactggcttctgcctcttcctcccacatcatgaggagagggtgctgtggcctaggcccagggttgggcaagagctcatgggtgagccgctccagacccctctgcaggcctggccactgccttgggtaccgttctgcagctgcctcccagctggcccaaagctggagagggtgtccaggccacactactctttcttccagttcccaccgctcctcgatgtggacgcctccagctctgcacccagggcggcacctgctgtgctgttcccatggctggcctgcctgccaaaccttcggggcactggtagcacctggccacctgtctcgatgccacctcctttcctaaaacatgagagagtttctcaactccctgggattgtagacaggtttctcaaccttgtcatgctctgcaggtagcctggagggaccaaccacagctctgggggctcttgagggctctagccaaccactggggtgccagatggttctccccttgtctcaggctcagcagagtcaccctggaaccacagaggcctgggctaggccctgggtcagcagtacgatgagggctgagcaattcagggacctgagggagggcatggcaggctgtttctagagattcagaaggcttcctagtggaggtgaaatgtgagctactgaagcatatgtggggcttgctgggcagagacaagggaaagagttactctcagagaaagcagaccatccaaagctaccgggacatagaagccagcagcctgctgcgggacaaggggctggagggcaggcttgatgtggtcagatgggccaacagcaggctgaggggcacaggagccagggagcccacctgtgggaagggcaggctgaggctggagacccagagaaaagtggggagcctgggggatccttggggaggtcgggggatccattgggaagccaagggttgtgtgggaaggccgggggatccaagaggcctagggtttgtcaaagcggccagaggctttgtttaataacctttgacactttttaaaatgtgcttcctacttacgcgtctatggcctctataattagacagtcctgatagaggcctaagcacaaggccagacgctgcccgtggccctgcccacctccccggcctctcacctgggacagggtcatcaaggcctccaagggaagcgccgtgagggaggcccttgcacgggacatgccccagagcctcactccaggccctgggtctcctccccatgtcctcaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgagtatgcagaggggccttctcggggtgggggtcctcaccctgccgagagggtgagggggtgctagggccatgctgagacctgttcagtgcctgccccgcctgtgagtgcagcaggggggatgcccatggaggcagctcccaggtgtgcacccctatagatgtgcatcccctggtgcagacccccaaggtgtgtacacccacagctgtacaactggttgccccaagacacagagctgcctccatccccagggtgggtatgagatccgcagggtcacagggctgcctcccgtggagaggacacagtgaagccctgaagccagagacacctgctgcttacaggccctgaggtcctggacgaggtgcttctgtgctctgaacctcagtttccccatctaaatcagggcgatgcctggcaagagctggtgagggctgacctggaggacctgggctgccctgcccattcccttccgggggtgatgattgccttggcttgcagtgccaggcctttgcctgtattatcagcaatcctgacggttctgttagattggcactgttatgcctgcttacagatgagcaaactgaggctggaaggtgggggaccaggtagctggaagtgggcgaactccaacccagctctgagctcagtaccctgtcctgtcccctcgatgggctgccccgcctgtcacctcacctcatcagtgtggcatgtgtcaggcactggaccagggacacctcgctgaggaagaaatggctctgcccttcccggatgttctgtgatgggcaggcagctgagggcaccgtcttgggttcgcagatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccaggtgagccgatggccgccagctggggtgcctagggcctgggccagggagtctgggcgccccgcagcccccaagtttctcccatggtgttggtgccaacaatgtgggtgtgaacgtgtctctcacactcccgccgtgtaagttcgtcgttgagggtgtggcatcaacaccactgtctccctggagagcaggcagcccgcggtgggcgggggctcgcctcccccatcctgaggtacaggagactcacatgcccgattgacatttcagagagacgtcttcaaccagctgctgattcacgcggccttaaactgcacctccagcgtccataagaacgtagcccggtgagctcctggcccctgcccagcactcccgaccttcacaggctctccctgcagacctcaggagtgcctggaagccccaccacccttggcccgagatgctcctgcttctgaggctgtgaggtcgggaggctgtggggaatttggttctcctttgttagcaggctcagtgtgaccaagtggagccagccccaccccaggcccaacctcccacccttcccagcccactcccttttagccttgctaagctacctgggtacgtaaacacgtcctgctctttcaggctcctgggcctttgcacgcttggaacaccctttctccttttttgcacctggccgacacctaatgctcagttagacctcagctcatttcacctgcctgcctgtgctgggtaccgagagggagcagtgagcaggcacaccagtcactggctaccaggagcccatctgtagtcgggggagcgacagggagcaatcagtcccacagacacgtaaactcgcactgagggagcagcagctgagggcagacccgaaaccacagtgggtttagccaggccaggcatggggctggtaggagggtggcgtggctggagggtgagtgttagggtggcatggctggagggtgagtgtgttagggcagcgtggctggagggtgttaggagggtggtgtggctggagggtgagtgttaggagggtggcgtggctggagggtgagtgttaggagggtggcgtggctggaaggtgtgttagggtggcgtggctggagggtgagtgttaggagggtggtgtggctggcaggcgagtgtcaggagggtggcatagctggcagatgagagtgctgggggaactccaaagagccctcaccattgccagcagccttggtgcttccatggcccagcttgcctccctccacttaggctgctgagctcttggccagcagctgcgtagcccgtgtgcctgagcggcgagtttgacacctctccttgcccatgtccctgccaccctcagacataagtgaaaggaagaatagaggagtcatggggtgcctggtggggaaggtgtgctgtgagagcaggtggcagcccgggtccacaggaggcccttggctggtgacaagcccagtggtttaggcgcaggtgcaccagcgcagctccctccaggcagggttacccaaactgagctgtacaggttctgtggtactcatgaaacaggtctggctggcagcactggaaccgcctagaactgtaaaatgtcttggacgcatgctccccgctttccccttccatggctgtagacaaaaccatgcgtgtttctttggtggtcaagccccctggggagctcaggctgtggtgtgggtgggagttggtgcctctggcagcagcggtggggaaagtggctgtgtggacaggagggctgaggatggagctggggtgacatctgtggggcagtgcggcagtgccgatgtggccttctgcggggcccagtgggggagggcagggggagagcaggctgcacagggagccgactgcattaggagacgtggagggggccttctctccaagtcctgtcctgctaccaggcagcatccatggggccatcagcacagctcaccagcccccaaggtgggaaaccttccacccacagccatggtgccccccacaatgagttcccggccccagccccttcacaccacccacgccctctagaaccactgttttcaggtgtttgggggctgtcttagtcagtttgggttgttattttaaaagtgccacagacaggccgggcacggtggctcatgcctgtaatcccagcactttcggaggccaaggcgggtggatcacctgaggtcaggagttcaagaccagcctggctaatatggtgaaactccgcctctactaaaaatacaaaaaattagccgggcgtggtggtgggtacctgtaatcccggctagtcgggagcctgaggcaggagaatcgcttgaacctgggaggtggaggttgcagtgagccgagatcgcgtcattgcactccagcctgagtgaccgagggagattctatctcaaaaaattaaaaaataaaagtgccacagtctgggcggcttgcacagtaggcatgcactgtctcacagttctggaggctggaatgtccaggaacaaggcctggctgggttcagtttctgctgaggcctctcttcctggcttgtggacagccactttcttgctgtgtcctcacatgacctttcctttgagtgctaattctttcacgtctcttctttcttctttctttttaaatttttttatatttttagaggcaaggtctcactcggtcatccaggttggaatgcagtggtgtgatcacagttcactgtaaactcaaactcctgggctcaaggaatcttcctgcctcatccttccatcgtgcagggattacaggggtgagccaccacacctatctcttcttataagggcactaatcccattcacaagggccccaccctcatgacttaatcacctccaagaggccctgttcttaataccatcaccttgggcatttgggcttcaacatatacatttagcctggacacagacattcagtccacagcagggtctttacctcaaaccgtacctgggtcttctctcttcaaacctgggttttccccactgccacctgttgtgccccatctcgggtgtggcttcctgcactggaggtctgtgccctcccatcctcacctctccccaaactgaggccaggcctcctgcccctgggccttggcccttgctgttccctcagtgccgcagtctagcctgcctgtgttctgccttgggaccaagggaccaccaggccccacatccctctagaaggttctgtaacaggacctctgtgtctgtttccacaggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctcc

SEQ ID NO: 38334 - DNA, 8705 bp, Homo sapiens
cgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgaggccggggcccgggacgcggggcggatgggaccctggcgccgccgagacgcctgcaaaggcagcagcccggccccacgcacccggggatcgccgcgcccggggctccctcctggagagcgcgaggaggcccccgacgcccggatggccgatcccgggtggccctccagtggtggccgccgagctcgaggcctgcagggcgcagccgcgctccccagcttcccagccggcttcccagttctcggcaggtggcgatccagccccagctctacactttaatacctggtgaccttgggggagtcacttggcctctctgagccacccacccccatacattcaagaacgctccttccgcctagttagaagttgtggggggagttctgtgaggtgcacaggtgttggcatctagagacgtgctggctgtagcatacccagggtgtgggccaagccgccccccacccaggggtgtttagcacaccgccggacgtgtccctgggcaagtggggtgacccgatgccccggctttgggctgcttccttcggagagctgcgtgggcactggaagcgatgttaggaccagcacacccccaggagagatgccaggagaccctgcacgcgtgtggtcctggccctatgaaagcgggcgtttctcagcacgagaagcagccaccgtttttttactttttttttttttttaatgcttatggggcaaaataagacagagctctccttgtttcccagggacagccaaggggcgttgttttctgaccgtgtcttgccacagagaacaaagaagaaagggcctgaggctttgcacagtctgcccagcaggccctgccctgtgaacctggctgtggtcactgggcagccgcctgtctaggggacctttattttagcagcctgtccaggggacttgtattccagcagcctttgaggggactggctttactaatgagcaacaatgctggtcgctgcgtgaaggccaggtgagcagatgtgggcgtcttggggcacctgagacctcactggtcctgggagaggccttcagagctcccaggccacaggcagccacggccagtgagatgcagccacagcgacaggaaggcgctggcatgggcagaagaagcgagcccctccttggcatcgggctcttcctttcctcctgggcgccgcacaggtgcccctcccccagggcctctcccacgttcatctgggtgttgaaggcgggacctgcgtgctgctgtcccttgtccggggtctgagccccactgccccttggccctccccaaccaggcgctctctggctgcagaacaccgcctgggggaggcgggactgccctctggcctgggagggcgggaggagccagctgctggcagcatatggcgctgtggtcagggtgtgctcctgaggactgctcaccaggcctctctgcctggccgtcggaaagatcttttaaagcttcttgagcactttgtcccatgtccctacagtccctaccgtcgcatctggccgggacgggggctgctacctgtgtggcccagtccctctgttctgctgggctcgcacaatgggaggcccctctctgtccccacccatctttgccgacccctgggcgtgcgttacggggccgcgcacgtgcaggtcacactgagcggcggaaggacttctttggggtcagtgctgggggtgggacccaggagctgggatcctgggccaggtgctggccttcctgtctggccctggccaatccccctactgccgggagctctcagctggccaggcgaggaggcagaggtcctgtgagtggtggaggccaacagaatgggaggttgtcgggctgacagcccccgagtgcctgcccacagctcctaggtgctttgcagaggaggccgctatgccctgccgccagccacaccgtccccttgtctgctgctgagctcctgctgcctttcaaggccttctatggctacctcctcagtctcccatggtcctgcaggctccctcgccgtttctgagcggccataaacgtttgtccctcttgagacgtggtgtggtggataaaaagtagggctctggggtctcctcgctgggcccaaatcctgatggcaccagcgggtgcgttacctctccatgcctcagtttcctcatctgcagaaggagaatggcgagcccctgcggccagtgcagccaatactcaggtggtacgcggggcgctcgcggggctcgcggacactctcagctccatgtccactggtgtggttgctgttggaaagcagtggtgtgagctggttccaggcacgggtgtggagtccccgggcagggccgtgggaggccttatcactgcctcctgcctcagtttccccctctctggatgaacctggcaccgatccctcggggtcgctgtggggtctgagagcactcactcccgcaggtgcatctgcagacgcagcaggaggtgaagctgcgcatgacgggcatggcgctgcgggtggtgcgtaccgacggcatcctggcactctacagcggcctgagcgcctcgctgtgcagacaggtgcgtggtgtgtgccagccttgggctcccagactggggctgagtcctgcagtggcatccaagctacttccgtccccttttcaagactttgtgcaaggaaggacccaccaggccgagagctggtgaccccagggtgcgcctcccatgggcacccacccagtttgcagggctgggcctgagaccgccacttactggtggggaagctgaggcccagggagtgagaaagcagggtgcagctctagatttgtgaactggctcagccgcatgctggcacagtggccttgggaaggcccctcagggtccctgtggcccctcgggctgagggggatccctggctgggccgggtggcgaggctgaggggtgtggggcgtgcccgtccctccaagccaggcccttctcccccagatgacctactccctgactcggttcgccatctacgagactgtgcgggaccgtgtggccaagggcagccaggggcctctccccttccacgagaaggtgttgctgggctccgtcagcggtgagctgccgggcgggagggggaggggcgcggggtggtcaggtcggccgaggacgccgtgtgtcagcacggctcatctctggggtttgtgtcaccgcaggtttagctggaggcttcgtggggacgcccgcagacttggtcaacgtcaggttggtgttcccccaccccacctgcaaggccaggggctttcttgtccccagacatgccagggcctgccagggctgcttgcagggtggggtcagcctggaataagccactgagaccctggtgtcctgggcataggagggtgggtgtccctgagccccggcgtgccctgtcctgtgggccccgctgaccagcgtgagctcccctgtgctgccagggctgcccatgcccctcggcccgcccgcccctcccgccacctgcttctgtttcaggatgcagaacgacgtgaagctgccccagggtcagcggcgcaagtgagtcatgggcggccttctcggggtggttgaggtgcaggaggctcgggcgggagcggacccctggctgctctgccgtgacccagctgaggctccagcaggccgaggtgcctgcacggtccatggagggtcctgacggctgttctggactcgggggtgtcactctgcgcccccaggacctttgggttcttcctgtggggagagccttgttggattgggggctgggcctgtttgcaccccagggtggtgagtgcggaggcgaacgccccaggcatggagagagcgcatgcaacagaaacgcccgaaggaggcgctgcctccctgcccagctcagggcagctgtgccctcctgccacggcctggggtctttccagggcccggggtccgctccaactgcagtgtgagccacttcccccgccccttccaaggacccctggggagttctggcttctagctgtgcacacagactgtgttcccccaggaccccgggggctggcgggcaggaggcctgcatgctaggagcggtgcccagccagggactctgttggaaacgatggaacctcctccctgagggccgggcggggcgggcgaggtggctgtgggacgtcaggaccagcttcatgttcccagggagagatcttcaggcccatgaggcctctgcttcctcgagaacccccggcctgcctcggggcctgggaggaccctctgtgggagccggtggtcagggggagtctcatgtggtcattctgtgtccccggcagctacgcccatgcgctggatggcctgtaccgcgtagctcgtgaaggtgaggggcaggtgctgtgcacaggcagggttctggggggcaggcagggtgggcagcgctgtagaagactgggcgctgagggatttgggccaggtgcctggcctcaccccttgcctcaccccttgcctcaccccttccttgtgcagagggtctcaggagactgttctcgggtgcaaccatggcatccagccgaggggccttagtcactgtgggccaggtaggcctcctgcgtggggtgggtgtgggcagtgcctgtgaccactgacctccatcttcagaggggccatagaacaaggcactgggcgccaaaaccctcctggggagccaccagctgtgaccttgtggggcagggtggggggcacgggtgggtcagggctgcagcctgtgaaggacctcgggcaggtgcctcccctgtctgggcctcacggacggacagacggagcaggtgcttggccattgccaggtggtgtcgcctggggccctgtgtgctttccccaagctggggtcccccctacagccctgaccgcccttgtgcccctgcagctgtcctgctacgaccaggccaagcagctggtccttagcaccgggtacctctctgacaacatcttcactcactttgtcgccagctttattgcagtaagtggccggcatggctagggtgggcgtccctgggccggccttgggcgctgagggcacccaggatggggcgagggctgggggaggcgggggccttgggcatctggcagtgccccctggggctcataagtggggtgccagggctttgggagctcatgggtcagcctggtgcccccgccagcatgttcctggcccgccctaggagtcaggtggaggttctggcacgtgggtgggattcggcgatggtgcctggcgtacctgacaggccgctggtgacgagccccctcctcagggtggatgtgccacgttcctgtgccagcccctggatgtgctgaagactcgcctgatgaactccaagggggagtatcaggtgagtggggccctgcctgtgcagttgggctgcacagcccagcgagtcccctcacctctccggggggtggacactcgcactggggacccggggaagggtgtccctcccttctagttgcctgtctctgcacagcacttgccttgggagagggttgtgcctttgaatgcctttgccttgtttttgtttttagagaagacttcttggcccggcgcagtggctcatgcctgtaaccccagcactttgggagcctgaggcaggcagactgcttgagtctaggagttcaagaccagcctgggcaacatactgaaaccctgtctctaccaaaattacaaaaattaggggccaggtgcggtggctcatgcctatcatcccagcactttgggaggtcgaggcaagcagatcacctgaggtcaggagttcaagaccagcctggccaacatggtgaaaccccctctctactaaaaatacaaaaaattggctgggtgtggtggcgtgcgcctgtaatcccagctactcgggaggctgaggcaggagaatcgcttgaacctgggaggcggaggttgcagtgagccgagatcacaccattgcaccccagcctgggccacaagagtgaaactgtctcaaaaaaacaaaacaaaacaaaattggtcaggcttggtggtgcatgcctgtagttccagctacacaggaggctgaggtgggataatcccttgagcccaggatgtccaggccacagtgagccgagattgcaccactgcattccagcctgggtgacagagtgagactgtcttaaaacatttcttttcggccaggcacggtggctcacgcctgtaatcccaacactttgggaggccaaggcgggcagatcacaagtcaggagttggagaccagcctgaccaacatggtgaaaccccgtctctactaaaaatgcaaaaaaattagctgggcctggtggcgcacgcctgtaatcccagctactcaggaggctgaggcaggagaattgcttgaattcaggaggcggaggttgcagtgagccgagattgcaccactgcactccagcctggatgacagagcgagactctgtcttaaaaaaacaaaaaacaaaaaaaaacacatttcttttctttcttttttttttcccctcattgcaacctccacctcctgggatcaagcgattctcctgcctcagcctcccaagtagctgggattacaggcgcccgccaccatgcccggctaatttttcatatttttagtagagacagggtttcaccatgtcggccaggctggtcttgaactcctgacctcaggtgatccgcttgcctcggcctcccaaagtgctgggattacaggcacgtgccaccactcctggctaatttttgtatttttagtagagacaaggtttcgccatgttcgccaggctggtcttgaactcctggcctgaagtgatctgccgcctcagcctcccaaagtgctgggattacaggtgtgagtcactgtgcccggccaaaaacatttctttcacagattaacagaggtggtgccgttcatggcagtctgtgcctcataggtgctctgggtctcctgtcttgggcccccgccaactccatggggcttccacgtttgcagagcccatagctctgtcccttttcttctccctgacgctgccgtgctgcatccctgattctcatggttctgttcacagccccctctgcccactggaccccgggctgcaccctcgggccctggttgtaccgcatgagcaggcagggtggccgttgacctggctggtgcctgcagacctgtggtcacctgttaccagccagcagccgccgctcacacccacacccacacccacaccccacattgagaatgcccaggccaccgtgcctggctggtgcctgggaggggattttcgttgccttttgggtgagaagcagcctttttgattgtttcactgcgttttctgcagggcgttttccactgcgccgtggagacagcgaagctcgggcctctggccttttacaaggtgcagtggtggcggcagtggcggcttgggcaatggggagcgggccccttcgggctctgtgtctctcattttccctgtctccctccagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcc

SEQ ID NO: 38335 - DNA, 534 bp, Homo sapiens; identical to SEQ ID NO: 37995

SEQ ID NO: 38336 - DNA, 534 bp, Homo sapiens; identical to SEQ ID NO: 37995

SEQ ID NO: 38337 - DNA, 4191 bp, Homo sapiens
gccctgtaggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcgggtgagcatccacgcgggcgggcgggcgggcggagagaagtcgggatcccgaggggctgcggggtgcgagaagcatcctgtagtgagcggcctcccagctgactgtgaagggtgctgagcagccggggtgcggggtgagatgggcacgaaatcagcacaggcgccggggcaggaccccggcatggggttcggtcccccgccgtccagacgtcacactgcactaaccctttctctccttttttttttttttttgagacggagtcccgctctgtcgcccaggctggagtgcagtggtgcatcttggctcactgaaaccaccgcttcctggcttcaagcgagtctcctgcctcagcctcctgagtagctgggattacaggagcgcgacgccactcccggctaatttttgtatttttagtatggggtttccccatgttggccaggctagtctcgaactcctgacctcgtgatccgcctagatcggcctcccaaagggccggggttacaggcgtgagccactgcgcccggcctgcactgaccctttctttctctgatctttcagctccttgaggagaatgaccagctgatccgctgtattgtggagtatcagaacaagggccgcgggaacgagtgcgtgcagtaagtacccccacccccgcgcccctgacctgtgggtagaggggaagcctgtgtgatgcggtgctttctcgaactaagagtcttgggtgattgatcgcagttaagcccctctttgaactgaggaaagagaggctcaaagagtttgccaacctgcccaagaccatacaacgagtacactgcggagcctggagtcagacgtggctctttcttcaaaatgtgaattattctcactgcaaagcctccttcactcaaagctatgccggctgatgacaacagggatgggggtgagagcacacagaaaactaagctcaggagattagagccatggcccctttctcatcttggatccctgcctcatcctttctctgttaagtgaaggggtcaggccatttgactgctaagcttcctctcatttctaacttcccgtcagtctgttagtgacacacacacaaagacaaacaaaggatttacaagttaagtcaaaggtaaattgtgcataataatttaatgcactccctaagtagataccaaaatgagagaaaatagagtctgagtctcttttccgaatctagtccaggtattacgcccatttttttcttttctttttttttttctttttgagacagtctccctctgtcacccaggctggagtgcagtggtgcaatctcggctcactgcaacctccacctctgaggttcaagcaattctcgtgcctcagcctctgagtagctgggactacaggcgtgtgccaccacgccctgctaatttttatatttgtagtagagacagggtttcaccatgttggccagactggtctcaaactcctgacctcagatgatccacccacctcgacctcccaaagtgttggaattacaggcatgagccaccacggccgaccttatgcccatttcttatagaaaaatatattatttcattgttactgaagaaatgtttcacaatccctaccccctagaaaaattacctacagtccctcactgaataccttaatagaatagtagagatatcagtttttgggtaaatctttacatctgactctggcatttggtaatttgatttttaaaagtttatggtaaataccttctcctttttctatatgaaaaatggttgcaaaacattccatttggtacagtaattctcaacccaagggtaagaaagttatcaaaatctcctagtggggtttttcaattgcacaggccatgctttctgagcccttgtctgatttatttttttgggtgaagaactctaccccccccaccgtaaacttatgttgatcatgaaaatgttttgtcccttcttgaagttgttgaacagatattttataagtacagttggtcctctgtatccatgggttctgcattgcatttcaaaaatattggggagcacaaaacaatgaaaaatagcaacacaacaataaaaaaaatacagtataacaactatttatatggcatttaagttgtattagttattataagtaatctagagattatttaaactgtgagccaggtgtggtggctcatccctgtaatcccagtactgtggcattacagtgggaggctgaggcgggcagatcatctgaggtcaggagttcaataccagcctggccaacatggcaaaaccccatctctactaaaaactaaaaatacaaaaattagccaggcgtggtgtgtgcctgtaatcccagctacttgggaggccgaggcaggagaattgcttgaacccaggaggtggaggttgcagtgagccaagatcacgccactgcactctagcctgggtgacagagcaagactccgtctcaataaataaataaattaaagtatatgatatggaaggctgtgtgtaggttatatacaaatactatgccattttttataagggacttgagctcgagcatcctcagattttgatatctaaggggaggagggaggtgtcctggaaccaatcctctgtggataccaagggacaattgtactcctggtaccaggcactgtttcagactctgggaaatccatagtaaaacagataccagctctgcactcacagagctgacattctagactctagaatctataaggaaatgtataattaggcacataataataagtgctttgaataagaataaagcagagtaagtggggggaggagtgctattttatacatggtatgtctgataaggtgatatttgagtagagacctggggtaagggagccagctatgcagtagtaaggcatagtgagataagtaagacagagaaagcatcaggtggaaaagccccctagtaggagtgtgccggatatcttcaagtcacagaaggaggccactgtggccagtattcagtgaacaaaggtatagccataagaggtgagatcagagggggactggaggcccccatcatgtagggccttattaggacacaagaacagctcacctttacctgaatgagatgggagcctttggaaggttttgaatagacatataacatgattttgatttaaattgtacagtaatctctcaggctgttatgtggagaataaagtaggtgcgcaaagatagatctgggagactaggtgtctactgcaatagttcaagcaagaaatgatagtagctatgaaagtaatcagtaagaatgggtgagaatctgactatattttccttaaatatgttaaacaagaaggttgataacactgaatcatccagtcagtggatgagccattccactagagtgggtaaattattttccagttttttgttcatggtcggtaaaaacaagcctctgatttttgcctgtttttttgcccataggtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctat

SEQ ID NO: 38338 - DNA, 20428 bp, Homo sapiens
cttgcttccagacaaaggttgtctcaagtttgttgctcaaaccgagttctggagaacgccatcagctcgctgcttaaagtaagatttcctaatacttttgaaatgaaactttagaacggaaagaggggaggtttaatttttagatgttgtttttttctgcacgttgcctgtttcaaaattaatctgagcagttagatcagtgtaaagatgggtttttaaagagcctgaaactctgtggtatgtatgttttataaagtagcccaagaaaaaaggattcttacggtatcctaagtgaagagttttcttcctggctcttgaaaacaatggcttcctgaatatgctgtttgtgtctctgctaatcaaaaatcaacattttgattctaacttttggactaaggaagccaacatgtatggttttcacattggatatattgagaggtgccttgttttaccatttcaggccgtgtttgctctcattttctcaaagaaatctgttttagtttgagattacagtttatcaaatgttaaggctttgaccccaaaatctggtcccagaaagacaggaaggccagctaagaggaggttttcagagtgcatagaaaggctgctctgtgcttcggcatttgttctggaagtgcttcttcggttggcaaagattcctagcaaaacctttgactggaggctttacagggccatacacccaatatcactaatgacagtgttgtaaaatagcttttgtgcaccatgcttaggattcaaggaggataaagtatatctttctaaagttatactttagaaactgtcattccatgttgaaatgataaacattccatgtttatcttttgtgtaagaagtaaaaaagcaaaaattcattgcatcaaagtaggtcaggcactgttaaagccaagcttccccatcgcctaaaaaatgtggacaaactcagaggaagtcagtgattataagctgatccctggagccagttcttacataattgtgttagtctgctcctccaagaagcagactccaagatagaattaaatatgcatggattttattaggggaaatgctgttgtgagagagaatgaggagagaactaggtaaggctgtgagagccatcagacctcgatgcaagtccacccgcgagggaggaaaagaaggaaaccaggttgagtggaagcatcccagacagctgtgcagtctaagagaacttcagcaaggtaataaggagcttctctagccagtcatccgttggggaggaggtctatgtctcccagaaatgagtctgccttagtaagcatgcatgctcaggcactggcttgtaacggccccgagaaggtggcctcagcacaaacccagagaggcagcagcagctgcgcctcattgtccattacttcctggggtcagcggtctgcgaggcacaggctcctggtgccacagtggggatttagagaggcccgcagggctttgagtaccatgagacaatgccatgagatcttcccttggacctgcaacaagaaggcctaggtttgaattcatagctgcaaaacactgggcaaataacatttctttgaaattagccacgttggtgatcaggtcctacctatctcatctctgaaacacttctccaatccacctatctctccatccctgctattttctccagccctgctatttcaccagcgcccccactagataaccctagcagcctcctaatggcaccccatgctcctgcccaggtatgttctccacagcagtccttccaaaatacgaatctgatcatttcacaccctttccataaatccttcagtggctgttgcctataggagtaacttgcccttcaccatgtggaccttggaccaagtgtggaggtttgaaatggaagagcatattgggtataaaaaaaaaaaagtttggctaaagagagaactgaaataagttcaaagagaaaggactaggtaatataagccctttaggcaaggctatcaacctgtacaaaatcaggcagataatggaacagagtgattgtgtaggctagtttgcatgtactgtaagttggttcatcaacaccatccaactcactttctcctattcttcactttatcaaagctggaaacaaaagtctcaacttccaacctctttgcagctaggagtggccaagtagcatagatctggtgaatgaactgcaggtgggaatttctgagaaggtttccttcttaaatagaaaggtgagacctctctgaaagccttttggcttttgctcctccctttctttttgcctgaaatgtggatatgatgccttggacaaagcagccactttgtgagttcgtatgaggtcagaggcacacattaatgacagagcccagcaagacttggagcctgtgtccttgaagacagcctcatttgatggtcatttggctcttctccacccccagcctcactactagctctttctctcactttgtgatctataatccaagcactggtgaaatatctcatgcacatgagccccggtgtcagtgtttctcaatcatttagaaattactgattatgcctgttaatgtgttactactgcatgcttaaactttataagaggatcggcagcattgtgggctggactgttcacatagcaagagtctggaagtctaagtttagttctggctttcccattgactggctctatgacattgggcatgtttcagcagtttcctcatctgtaaaatgggagtattggatgtgatttgatttttccatccttttttttttcgatgaatatctgagaccaactatgaaatcttttcaagagaaaaaaaatcataagcaattgatagtgcaaacctcaacaaaagtttatggaagagaaatcaagaagcagccctgagtagtaaggacacaaataatgtcatagcaatgtgtgcaggggtcatggagagagtgatggtggtagtgaggaaactcagcaccagaggctgtcctctccaggtactgaaggaaggataaggtaggttaaagtgcaatatctgggctgggcacagtggctcaggcctgtaatctcagcactttggaaggctgaggcaggtggattgcctgaggtcaggagtttgagaccagtctggccaacatggtgaaagcccgtctctacaaaaaatacagaaattggctgggcgtggtggcaggcacctgtaatcccagctactcaggaggctgcggcaggagaattgcttgaacctaaaaggcggaggttgcagtgagccgagatcactccattacactccagcctgggtgacaagagtgaaactccatctcataaaaaaaaaaaaaaaaaaaaaaaatggccaatgtctgtcaccagtcattacttcagtgggttatggtaaatgtgtttgatatacaaagctaggtatgcagagtaagcattctaggagaattcagatgatgggactacttgcacagaggtgctgtcttcaagttcctgaaggagctcactaaattattcttaaaagagcacactgaactattcattctagatgttactgcctgctcaagatcatgttctacagtataacccattaaacacacatgtctttagattaaaccacaggttccattatgggtcgacttgatgggaaagtcatcatcctgacggccgctgctcaggggattggccaagcagctgccttagtaagttataagttactatctttgttgtttgcctactaactcttgacatattgaattatgtggactgatgccatggttgtttacttctgctctgcttttttatttttttacttttgtgcttctgttgtcttaagttataaaaataaacaaataaataaataggtccctactcctgaccccaggcagatgaaggaatgaatacctcatatttagtacatgacatcactgataaccattgactctgagaaacttctctacttcagtttctctgcatcatgatatattcgctacagagggcaaacagggttacacagctttctgaaattgtgtcagtttagatatatgactccagagttataagacaggttaccttgttctcctgatttatatcaatttctgttacattatgtaccccacttaagctaatatcggcaccttaagtataacagtaccttaagtataatggcagggtatggtttgacatttatgaaagcactagcatactcttagtaggaaaagtgttgaaacaaccaatttttctcttattatttggagtttagtaactcaaactcagaaatgatatatagtctcattacagaagagcagtattttgagagtattgaaaacagctgtcatttttttaagaacgttattttgtttgatattacttaaagggactaagtcagatgacaagcacaatgtatgtcacattgttctaattaatgataaaaataataacaatggagaaggggtaagactagatagtttaaaattctagctatcttatagggaaaagaacaatgaaaataagataaaggagaaaaagaccacatgatgttccattcatgagcacagtttattcaagtaaacaaaggatttatttgtactttgtgtctactaggcttttgcaagagaaggtgccaaagtcatagccacagacattaatgagtccaaacttcaggaactggaaaagtacccgggtaagcaactcagcagcttgaatttgggattcagtgtctgcaaggtattataaagcatggcgctcacatgttgaaagaaaattccctagctactgagctccactgccgtgctttttagattctctctctgatatgaaatctatattttgtgaacctatagacaaaaatctgtgacttacatgcatagaaaaatttgaggacgaatacttaaaatcctttatttagctaacacatttgagggattcagttcctaattacaaacttacatgtgaaaatttactagttgttaggttaacttttcatgacagcttttcacttctgtgccctcctcctctaggatagccctgtccaatagtaacatgttgtgagctgcctgtgtaattttaaattttctagtatccacattaaaaaagtaaaaagaatcaagtgaaaattaatttaataatatattttcttttatccaatatatctaaaatataatctcaacatgcactcaagttaaaaaattaatattttaattttttcttactaaattttttatttaaattattagaagtttcttacaaacttcaaacattaattttctcctctttgcagcttttctcttaattttctcttctttgaggtataattgagaaataaaaattgcatatattcaagatgttcaacatgatgttttcatatatgttgtaaaataccttgtgaaatgattatcacagtcaagctaattaacatatccattacctcatttagttacctctgtgtgtatgtatgtgtgtgctaagaatacctaggatctaccctcttagcaaatttcaagtatacaatacattattaataactatagtcactgtactgtatattaagtcttataactgcaagagtgtaccctttgaccaacgtctcaatattttcatactaaatctttaaaattcatgtgtattttacacttgcagcacatttcatttcagactagctgcatttcaggtgctcagtagccacatgtggctggagacagcttagctctaaaatcacacatcatcatgagaaaccctaagagagtacccagattattaggtgtgtaccaccacttcttcaccccactgaaccaaactccaacaccaaaggattttaattgcagtttacccaaagaaatcagaacagagaacctatatgaaaggtaacccttacagcaaaatagaacaggttacataatcaaacagcaattagttccttgaattagttaattgaattggaatatgttgaattataattcaaacaagtcaaagtaaagctgctgcactggggaagcacaaagataaggaaatgtttctgaaacaaaatttcaagtcttccctttctttatgaatcttttatttctatattcccccaaaataaaccatatacatattatttataatatattataaattataaaatataatacacattatagataattatatattatatgtattatacatatattattatatattatacatatacatattaatacattgtatatattataaattatattactatatattatatgtattattcatatattattatatattatatgtatacatattaatacattgtatatattataaattatattactatatgttataatatatattatgcacattataaataatatgtgtatatatttataatgatgactgctgcttttgttagacactgtttggagtttctcagcaactagtgcagtgtgtatctctcaggtgcccgccatgccagatctctcatgtctagccttcaagggtgtcatcccttcttctgaccctctcatttcttctccttgcagtttagtccagaaatacatgtatttgactggatacccttgactaacagagtcatttctaataaataatggaaatgacataaaggggaagctcacaaatagaaacagtctcttattccagaacacttgctcttctccacccctcactcagacaaaattctgattactgtataggtaccagcaacccagtctctggcaggggaaggataggggaaggacatcttgaatatatgcaatttttatttctcaattatacctcaaagaagagaaaattaagagaaaagctgcaaagaggagaaaattaatgtttgaagtttgtaagaacttcaaatgagcccattttcagttattactgctggcttactgagaaacatctaatgtacaccagtcattctttactataaagccattgctcagaaaggacccttattattcaacttggaaaatggacagagaggaaggaagagggacggatgggttattggaggagtcaagatggactttaagtttactaatgagactctgaagattcttaagaccctagtaagaaggtcagcaatctatgaagcctagctggatagatgttgcaatcttcacacttcacacttcaaaacagctaaaccttcaaggctaaacatttttaggaatagtgcctcttgttttatttttcaggtattcaaactcgtgtccttgatgtcacaaagaagaaacaaattgatcagtttgccaatgaagttgagagacttgatgttctctttaatgttgctgggtaattcataactttttagtttcactttccttacagaaagttttctatgactttcattcaaagaattttcataatgtggcaaaatcattcattgtgaaccatgacatattccttgggaaatatggctagattttacacagcattttcattacacataaaattcagcaggtaagacagccttagagtttgacatgatctggggcaaatgaggtctactcaagacagatggtactgatacaaagctgtattatgtgttacaatgtatggaagttaaattaaagcaataatttctgatcatctattttataaatagtcttccatcctcatgtaagaatacacccagaaacatgaaacaaatagttagcaaagttagtttctgagcatctattaaattttcagccatgtaggggatgtagaaataatcatgtggttcctgctgtcatgaaactgacattctgactgaaatagcagagctttggtacatggaagtcacagccaacaatattttataatgaattacataatttgggtccagaggaccaaatcagtaagggttccagtgttttggaagcttccctcagaaaacgtaacttgaaaaatagtgaaagctactttacgggtttgttttgttctgccttaacgtctctcttacaacaaactaacatctctcagtatgttagaacactagcagtatcactttgctgctctgagatgttcagacacttgttttccttgcaattttgatttcccttgagaattctaaatctgtgccacctgagggcactgttgctcttgaaataggaatcacataggcaaatagggcagatgttttttctctctctcttttttttttctgaaacagggtttgtcttggttccccaggctagagggcagtggaatgatcatagctcactgcatcctaaaactcctgggctcaagtggtcctcttgcctcagccttcaaagtagctgaggctgcaggtgtgtgctaccatgcctagccctgttcgcctttatttgttgtttgtttttaatggcattgatgtttccagcacaattaatataaagcttcttatgttcggtgaccatacttttgtttggaaaacaaggatcttgttttcagatgacatttctagcttaagttgttgggattcttactaatataatatactaagtgatactatgaattgtttaaagtcttgataagggaaagagacagtggtctaagtcactaagtgacaataaaaataatcagcagatggaatagaaaaattttaatggcagttattcttccattgtttaatcactcttctagttttgtccatcatggaactgtcctggattgtgaggagaaagactgggacttctcgatgaatctcaatgtgcgcagcatgtacctgatgatcaaggcattccttcctaaagtaagaccaccaccaccaccaccaggataagcaccacattaggtctctgtactgggcacacagaagggattcccacatgtgctgaagagtgataataactaacacaatgattaacttgcattgaacatttatatcaaggcatttcacataaattaatctatttaaccttccagctcatccactcaaggaatatttattaagcactttccacatgccaggctccattctaggcacagaagacacataagtgaactaaacaaagtgccttctataaggcaggttccattattgggggtgagatgggacaattagtaatcaaatagacatagaatatgtggcgtggttttaaatataatgaagagaaagaagctaggatatcaatgcggcccctctggactccaccgcaaaggtgaaactggcatagcagtccaagaagtgagacagctgatcattcaggtaccttgggagatgattccaggcagaggtaacagcagggaggcacacgagactggaatgatcgtatgaggtagatactattatctcatccattgttcagaagatgaaactgagagttcagacaacttgctcaaggtcacccaactagcacatggttagaaccaagatttgaagcctggacgttgagccccttcgtgaatttcagtctaggctcacactctcaagagggatgtaccccattgcttttctctgccctgaagcttctcccttcgctcttgttttgatctgaaccacagtggtactgggcaggtgagagacagtgtgtgctcaagacagcattcctccttgaattctcaagccttcacacaacgcatcaatgtttaaaattttattttataaactagcattaagtacctcttggtataaatcactatataaagtgttctaggggagtataaacatgagcagcgtacatccctgatttcaaatgagcttataaaccagtagtagcagacagtgcaggctgagacaatgaaaggggttgactgggtacagagccagctcaactcaaggttgtaaattgaacctagtgaaatgcagaagaacaacttttcccttccatcccagctggatttgatgtcctgtccatgtctgggcaggagaagagctttgttaatggcacagcagggctgatattctactctgaatattcaacctaatgttaagaaggttccagatgaacattaacaggaaaattagagaaactgacttagtaatgaagggactttgaaaaatctacttgtttagtgcttagaagggatttttgggtgggtccacagaatgttgaactagcaaatttttataacaaattgttttttttaatgtaagttgattttttagcctatttggagtttatgagaaactatagtatttggaacacgaatgtatttttgaagacagatcctttgcataggttacaggggtagagcagagactgtggtataggaggaaagcttaggtcatcgtgggtaagactgttgcacatgcatgagactcatttgcaaaaccaggctctaaaatgctttacaaattttagtaaaggaagtaggtgtggagtacagtggagctgaaatgtaaacttgtgttaatttttaaaatatacaaacattaacttgcaaactagtgagtttgcttgtgatttacaatatcttaacaattatccatgtgggccaaaaacacagatttgtttaaaaaaaaatcccaagagatgttaatggcaggaatatggtattagtgcctcttgtttaaagtgaccttgacaaaatcgaatcctggtcttggactctatcatcagaagtccttaggtgcagtctgcgccctgcccctaattggccatgtgccatagagatggcacttgtaccctctcagtacatatttcttttagctaaaaaatgaggatgataggttacacaatcacttccagccataattatctatgatcctctgtatcattaactatgacacacatatcccatgttagaactttccaggggaagctaggatttggagtctaggcagctctggaaggtcagctggtcagaacataggaacactcataggaaatttttattcatggatagatacacaggaaagcattccaagactggaagatcagtcaaaaggcagagaacaagttgaaaatactttaagaagaggtcaatgcagaatccaggctccaccagaagagaagatccattagggcaaagatttggggatatctttgttatttgggttggtttgtttgcttgcttttttcccccaccttgctgtgtcttagaagagtcttcagcgtatagaggtgctccacaaacatttgtcaaataaataaatgaatcaaggttgttagtccagcaggaaccactggagacccaagtggccaggttccaccagggttaggggctgagctctggccaatggagacagaagggctgggtcagagtaagactaactagatacagctccagggactcttaaggggtatttctagcccctacctaagcttctgggaggtcaatcctagatagcagtactatgtaccaggcacttgactttatagtcatgcctgccagagaaggctattgcatggggagccagggagagcctgacaccatgacgacagctcctgacctggactgggaaggcagcatgggaacaggtactgactaggggctctagaagcagcagagggacctcggttgaacttggttgaatggatagtgcaagtgttagggggcagcactaatgtaatgtctcttaggtggctttattctaaggttttgcctgagataatattgcatttctagagaggactagagattgaacctacataataacccatctttatgtattaaattggggtatatgtattctatatgtattttaaatggggaatgctatttgctaaattggataagaaagaacaattttaaggcttacttttcaacaccattacacttgaccaacattcttgacactttttatgagaaccccatttcattatgatcctctttattatataaaacacacaattaagttaaacattattttttcccctgctgtcttccttagcttggttgggttacagtcagcctctccttgtatccacttactccattcagcatagtgccttggggttagtttagattctgtttttaggggcaattagtagctaaatctcagaacaaagtcagaagaatatcctaagaaatcaatcatcttggccacaccaatcctggatccattcaattatttactttttcctttcctacacctctttttctaaaagctgctaaagaaactcgtcccaacagaagtcattttttttctctggccctttacactgcctattgagacttctatgtacatgttataattagtaaagtttgaaaacatttttaaattcatagcagttttctttattatatatttatttagctataggacagggcccagcaatctgtgttttaaactagcacctcaggagattctgattcatcaacatttattgactgcctactgtgtacactgtctaggaggacaaaacagccaaagaccctcatcttaataaattcacactttagtgggggaattctgaagaaggtgttcttaggaaacactgccctaaattggtgaggcccaccatccctgcagcaaccatctacaaggtcctgcccatcctgcctcagccctctcctcctcagctacccatagacatttctgcagctccacctttatcactctttcctgaagcctgcatcagcttccactagtctctgggcaccacagtaatccttgcaatccccaagtctgaacatgccacttctctgctttaaacccttcagtgtcactgcatcaccttcagggtaaaacccaggttctaaattcagcccttgttgacctctgcagcctcattgcttccacaccctgcattccagccagacccagcccctcctcccagttcccgatggaacctttatacctgtgtacccactcctcaaaacatccttttcttttatttttctgactaatactctagtgttcaaaattcagcccatatccttccttctcaggaggtcccctctgagtgtcgcccagcctgaattgctccctttctgccctcaccctgctgttagatctctgtggaggtctctgctgtggctggatgtggattatgtgagccactctaaccagactggttgcctcctgtaggcagtaatctcctggacctagcacaatacctggcctcagtaggtattcaaaaattatgtgttgaatggagtaagtttcccaacatcagtaacacacaataacaacatttattcacatttcatttaagtcagcattcactcgtagtcttgctgacattcttgtaccatgggaaggtggtaatccccctgggaaatgccagtgagtgcagtcacattgccatcatttcccagcaatagttgatgaggtgttttgggttcactgttaagactgcttaatagtgcttaatgtgactagctaatacagtaattaaattcattctgcaaaccctaagaaaatgcaaatctttttaaaaggtagtattttagcccacaaagtggatttttttttttttgtatttgttttgttttggcagatgcttgctcagaaatctggcaatattatcaacatgtcttctgtggcttccagcgtcaaaggtgggtctgtctccttccgaggactgcgatgctcatacacgcacatcattaagagctctgcgtttgggaacaggcatagcagagattataatttcaagtattgaaatgatttcaaaactgcttttttcaaaattggtattaagttccttaaccacagatcttttgctctcgatgtgagccagtggtaaaattaaattaaaatgtggggtatttttgccctcccttttattctttctaatggacatggaaatgaacatcaaactgggagaaagaaccatttaacatttaattaatttaaaatagtgtattgagcaccggtatgtgctctggccataaaagaattcacagtccaaaactaggagcaaggcagcaaacatcatcttctccagtgtgatgatatataacagaggtttgtacaaagcgctgtcaaaatacagggaaataactgcctgtgagtttgtggaatgcttcacaaagacagttgatctgagccatcagcaagaagtcaagttgaaggacaaggacagcagtacaaaatgtggattatgtcacaatctggcatagttggatctgtgagtttaaaatgaaatagttactgctgagataccatttcttctctttgcaaggatacacatattcaacatacacaagagaggaatgtaaagaagtgcctaggcctcctgttttattgttttgttttgttattaatcttcattttcttttggaatctgcctaagagttatggcaactgatgatgagaaactaagactaccaatgttaagtaagttcagcatttcaattaagtctcaattaagttgtgcctatactgatattatttccctagatccagaaactgactctattgaaggaaaaaaatctgatatcaatctttttaaaaggggaggaatgtgggagaaagcatgaaaatggctactgggaaaacttatttgtgttacctttctgaaggaaaatacattttttattccttcaattgttgaacctttcctccaccctcaggagttgtgaacagatgtgtgtacagcacaaccaaggcagccgtgattggcctcacaaaatctgtggctgcagatttcatccagcagggcatcaggtgcaactgtgtgtgcccaggtgagtaaggcacacctgttttgtaagcaaagttttactgaaacacttccacacccaatttgcttatgttattgcctatggctgttttcatgctacaaaggcagagtttagtataatagttgcaacagataaaatgactctcaaagccataaatattttttgtctgcctctttaccaagaaaggtgtgccgatccctcatacaaagcaaagaagaaaagcagaactttccttttcttaataactataggggtgtgtctcattttcacaataaccgtagatgtgtttattaaattgatatgtacttttacctggttctaccaatctaaaaggaacttaaggtatctaataaggattataatattctttaaaaagaaatgattgcatatccaggatcaaggtttcccttggtagtgcacaattgataatggggggtggtgtgtgaaagggaaacatttcaatatgacctggggacctttcaaacctgaagggcatgccagaatttagggaaggagttcatggagagaattgtgtggtttagaaagacccacaagagattctgattgaatcttcagttgaaacccactgacttaaagaggggaaactaaacatcccccaagctacagaatttcagcgattgagatgttctgttttatttttcttggaacagaaatgtaaacgtaggtaacgctaagaaaaagaagaatgcatgagaggtcatttcattgggttttaatgtacatcctggcgatacttgagtctagctattcttggtgccatttacccagtggaataagtggtaaaatgatttggaaaatgtggttgtttcagcgactggacttatcaggagattggaaaatatgttatcaaactctttggaacaaggaactagctgtgactcagtgaaccaatcacagaagaaaacttgaggaggactgagtatgtctgagatgctgctgatggttgtatagtcacaaatctccagccagacttgtgtagaccctggcatagtatgtctgtgccatggacacagctgaacccagtgacattggaatactctaaaggcatgggcttgctctacagttcttatttaatagccattagtaccagtcatatgtaagatatgatgttcatttacctcagagggagaaagctattaaagctgtaagattctgaaggagtgttagtgaaagcttgaggtgcacactgttggtaaaactgtggactttaaggaggctattgaggaaagtgaggaaaatattattgaaaattagaaaaaagagtgtctttgtcatacagtttcagaaagtacatcaacactgttgcctgtagtgtgaaggtagaagatgttcctaatgaactgggtgatctaattaaggtgatttctacccagagtcttgaaagtgctggctgcttatagtaaaatgtgacaagagacagataaccaacctaaagagggggttccaaaatggagtcaggctttctgattttgaagatttccagcttcatcagaaaaaaatagcaaatgatgctaaaattaagaaatgttttctgaataaagatcaaatctatggcactctcaggaacatgatctaagggtgaagtatgactgtaaaaccatttgttacaacctcagaaagatcacattatttgccagagtactctttagtctgaaaaagggccctctaaagagaatgaacagtttatgtccgttaacaaaaaagtctgggtaacgtgctctaggagaccataaactaagtggaattttaaaatgttagcgttgttcttatttttcttttttaaagtaaaataactttaaattagattaaattatatttttgattaaaaacttgaaactgtggttaaaagtaggcatttgaaacaatgaaaataggcaaggtgataagaaaaatttagcgccacctgaattaccaaggactatggtagccatgggattgtccccaaagatgccacagtgaacttgacagcaaagaatggttttgagatcattgaggcaaactggctccttaagctggcaaagtgcttgtacgattttatctacatctcagggttattgtgaggattagctgagatcatatgcataaatgtatttaaaatccataaagcatcatataaatgcaatgtgactaaaatatatgtccttgagaatgctgggtgattcatccagagtccctacatagtgtcacgaagaatcatagtctgtgtttttaaaatcatagaaatgttattgaagaaattataagcctattaaataagaggcctcaggcaggcagctgtaaagttgtcattttaagtcaaggagaagaatctcactgattgtcatatggaaaggaagtttagttatcgatttctttttcagtgaaagtgagtaaccaagctgaatatccccctttgatttaggaacagttgatacgccatctctacaagaaagaatacaagccagaggaaatcctgaagaggtacatctagcatttaaaatgtatttaaaccttttgttaataaatgccctcttccatacctatagcagacaaattcatagagacagaaagtgaaatggtagttgccaggggcttggaaggagggaaaagagtagttaatgcttaatgagtagagaggttccattttgtaagatgaaaagagttctgcttgggaagctgaggctgggggatcgcttgagcccaggagtttgaggtacaacagtgagctatgatcacaacactgcactccagcctgggcaacagagcaagactctgtctctaagaaaaaataataataataaaaataagagttctggagatggacagtggtgatggtggcacaacagtgtgaatgtacctaacactattgaactgtacacttaaaatggttaagatagtaaattttatattctgtatactttaccacaacttttgaagatgaaaaaataatgccctcatcctttaacattagctttctgatgtgtcacaatatctgtgggttttagtataacacaaacaatttgagtaactttggcaaaagaatcaccataaccctagttgattattcatcaaggcagcaagccagtggattctcttgcctttaactccttgaacaagatgcaggtgagcacatacagctgcttccatcactaatgtctggtatggtctctggtcacaggcacggaatgatttcctgaagagacaaaagacgggaagattcgcaactgcagaagaaatagccatgctctgcgtgtatttggcttctgatgaagtaagcactattcttcccaaggagttcattaccctcaatcacatttggccacaatttgctcatcaaaataatatcattttagagagtttgtggcatatatgtgctaagatgctacatttataagatagggataagttctcatttaatttgctcaaagaaagaccacttcgatctgagccactaattcttccttattcagctttacataaaatcttgtagcaaacaaaatggaggactaaaaaagttaaagtgctcaattttctgagagacagttcctttcaaaaattataattggggaaaccctgattaaatgcaagtcaaaaaattgaacctccaggattataagagctctaagtgaaatggggagaggattaagcagatttgtgttcagtggacacagaattcgcatgtggtgttttagttttacttgtgacttgtttgggagaattccactggctcttttttctctattaattcttacttgtggccgggcatggtggctcatgcctgtaatcccagcactttgggaggtcgaggcaggcggatcacctgagttcaggagtttgagaccagcctgaccaacatggtgaaacctcgtctctactaaaaacagaaaatagctgagcgtggtggcgggcgcctgtagtcccagctactcgggaggctgaggcaggagaatcgcttgaaccagggaggcggaggttgcagtgagccgggattgcgccactgcactccagcctgggtgacagagtgagactccgtctcaaaataaataaatatttttaaaaattcttacttgttcatcatcgtgtatggaaattcctaatttaatctcttccactttgcatctgtttaacagttttttccttaataactattgtttacttttaaatggcttaagatgaaagcaaaaatgatgcttataaggtatagagcacaagaaggtcctcctctgttttatgtctctgaatactacaggaacaaggaactgtaatgtgtgagaagagggaaggaaaggggactaggcgggagcgaggagggaacaactgatagctcctcttcccagtaacttggtgcacaccagatagttggtgaatgtgacaaatacagggattgaaatgtttccgtgacagcgcagtttcttctcagaacttctcccaactattaacaacaattgttaatagctggggaaattaatagacaaatgtttaatgaagaagcacatgagcctttgtgatttctctgaatccgtatcttcagaatagctcatttgatttgggtactgctgataagctaaattacccttagttagccagagcttaggttacaagatatttggaagtgttgtggcttgaaatgtgctacaaaagtacctttggctttttagaggtttccagaggagttcatatgtgtaacagagcttgtcttttaaaagaacttgggggagttggaggtatttctttggtgaagtgactaataactccctagttcacctactgtatattatcagcttttatctattgaactcttaaaatttctctattcattatgatatccttacttcctcttccattgtttcaggcttcagatgaatttagactgtttgagtctttattatccattttaagttaaaagatttttaaacttctaccaaaaagatcacttcagccttatttagaaaatgaaaaatttatgggaataaaccagtaattattttttaaattccttagttttataaagatttggatatctgaaactaatatagaatatttttatagcttaatggattatagttattatcattcatgtaaatttttaaaacacatttagtgtgcttcagctcctacaattatccacttataattgatcaactaaatatatgctgtcttttttaaaaaactggtcattaatatgaccattttatgactgatacacttatgttcaaaagtttattagtggcataaaacttagctagttttgaatagttctgagtttcaaaatgaaaatgtgcttttagcctatatcctaatttggggaatggctatacatcactgttccttaatttggggattctgagaccaaatacctaacagtgacaggtgcttagacaccagccagaggccatttagttccagatcacaggacactcagcagttctaaatcaaccaaatgttaatttggatttccctgaattaagtgtttaagtgaggtttcctgttaggacaagggtaaattgtttagttatcctagtcacaggaaaatttcaaaatacagcctgtatcaaacctggttaattgttctgtctccttgtgtttatcactgcagtctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagcatc

SEQ ID NO: 38339 - DNA, 17476 bp, Homo sapiens
ttgatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacaggtaacctgcgtcgccggtcggaggcaggcgcgggggacgaggtcaggctccgtgaggtcagaagtgaggcgcttcccacgtcccgctcatggggacgcccgccacccttttcttggtctgcgaatcctgttcccaaatgggcaaggccacatcttagtactgatcggaagatattctttctcttttttaaaaacctccagtgagtcagccatatggtgctgctcctgtgcctgctgaggacgtgtgtccagtttcctatcacccttgcctcttaattagtccgcctcgctgtgtataagactgatagtaagaactttcagaagatgagatcaaatattaaacctgctaaggtaaactttgagtttcattaaaggcttatcaatgcatcttaaatggggtcggggcgggggagagcggggttagctctattctgagatattcgggtgctccttaacatctcaaaccattcgacattaccaagactgcccaggcctctcttttcttctttcctaacaaagcttatcaattcagcagatggaatatagtgcaatggttaagggtaaggactctaccgccagactgattgcaattcaaatctaactactctcttcgtaactgcctaacctttggcaagttgtgaaactttccgcttcagcttctcacctgtacaatgaagataatagtaatatctatctctgtcatagttgtggggattgaaaaaatcagtatgtataaaggtcttagagtagcgcttgtacatggcaagccttatacaagattttattgctaggtgcatttagtagcaagcagttattgagctttcactgtgtaagcactttacatgcattgtctcctcccaccaaaaccctatgagattgctactattttacccccattatataagtgagaaaattgaggcttagagagccacctcaggttcatgccttggtagtaaataataaggcctgtcttgcattagatttgtcttaatgtaaaattctcatgaaccgtctccccagtaaaaacaattaagtcgtgtagctaaaaattgtatagtgttaaagtagataaggaagattttattgttgcttttttcctttaaagagcataacagttttgatttttaaaaaaggttttagtttgtgatatataaagccgcagtagaagtcttagggtgcactgttttaactgtgttgccaaatatgaacggttaatggtccagaatttttagagattaaataagcatgaactgacatctctaatcagaataagtggaaactatttgacatttttaaaacattttaaaattttacaaatgaagactttgaaattttccctccagaatgaaaagcagaggaatatgggtcatgaatttaagttgtctttcagacattatttaatatgagatgatcccttgacattgtaattataacaaaactttcagaactcaagtctaaatatgtagtattttctatctgatttgcaccattgactttattaaaattgctatacaggagatggcagtttgatacccaaagctgttcactgatatatggaattttaataaagttcagctttaattttttgaattgttcatacagcaaatatttactgagtacatttttgtctccagtcctccttgacaatattatttactttgtattgagtacttattgtgtgcagacactgtgaatataaagtagacatggtcttttccctctagagcttaccagatgagtgtgagataaatagaaaagtaaacatgccattgcagtacaggtgataagaattatgataaagtacagtgttattattgataaagtacaggttattgaattatgataaagtacaaaaggttataggaaagggatatgtatgtgttcaacaccattttaattgcttcaagagatacaaaagaaatataaagcacctgacttttgcttcagtttgagagactacatggaggtgggatattaaaaaacacaagtaaccgtaaaattatgtgttatggaatatagttataagcatgtggaaaaattggagaggctttgagattagaaaacctggtatcaaatcctggctcagaaacccagctcagaataccacttgccagttagctgattttgggcagttgattaacccaaaccgtttccctcatctgtaaaagggggttgccatccatgcttctcagattatttaaagattgaagggagcatcaaggtaaggatagcaaattcctgtgatggatctgccatcactttctacccaacctcactaaagtgacagtaaaggaattttttaaaagaaactcccattgaaaatataaagggttcgtattaataactgatagggaggggtgggtccctgtacttgattatagtaacaatttggaaactagagaagggatgggtgaaggtaactgatttaatagattcagagaagtttaatcttaagctcgcaacccagtttattgcaagaatcccccaaaaggctcaggaataggcacaggtacttgcagaacttcaggtagggctaaaaaaaactttcagttgaaaatctgttgaagaaacaaaagccccagatcccctactccactgtgggtaactgggcaaacactccttccctaccagaagaggagagtagagatttcttcattagaaagagtaaaatagaagatttccaagaataattggggcaggtctttgtacctgaaggaaggggtaaactgattgtttacatgctgaatgctgtgactgaatgtaaactaaatgcttacatactgagtgtcgagactcccagccttgcttcttcacttccaacagctgatcgtggggttggaactccaactcaggttggagtttgaaagattattctctagggaatctgatagagccaagaggaaagactgaaagacactgacattgtgggtttctcaactaaatagtctggccagatgaccctacagtgaagtccaaagtcaaacagttattgcctatattgttacctttattagtgtcccacacttaaatatgaacagaacaaaggatgaaagaaacttctaacatgaaagaaataaaaatagcaacttggatagactatgtaagataaacacatccccctaaattatcattagtatccttagatgagagaagatatggtacaaatgatacaggaacaaggtgcaaagtatttagatgatcaggaattcttgcaaatggagatggtaatagaaatgaaaatcttaatagaagtgttggaaaataaagttgaaagaaatcatccagagaatagagcagaaaactaaaatagtagataactggagaaagaagataaaggacaaatccagatggttcaacttccaaataataggagttccagatagtccaggaaaaacaaaccaaacaaggaagtaaccagattcttcaaggacatttcccagaactgaaaatgtgagttttcattttgaaagagtccactaaaaactcagcacaagggatgagaacagattcacattaaggcacactgtgaaattttacaagctaggagacactggagcaataccttaaaatgttgaaagacaattctaactttagacttctttaccaagttaaactatcgattaagagtatatgtgtagcttcccacaattatatgccctttgctttgtcatttttataaagaatataattttgataaggaacattttcagaaatgaaagttctcaaaatttacctttgccgtaccctttgcaaaactactggaagatgttcttctaaccacagcaagagagtaagtttaaaaataattgatgacagtgttttaaactgtcatgtgcatcagaattactggagggcttgttaaagcaaattgttggactccacattcaagatttctgattcagtgggtgattatagggtagggcctaagaaattgcatttctattaaattctcaggtggtcctgttgttgatccatagacactttagaactagtgagctatagcatacaggaaacagtggattaatacagaataaagaaattaagagactttgtagtataatgatgaaggaagagcctaggaagggagctgtatgtgcagtaagtctagagacaatcatgtcagattctaggagatacatctttaagaagatgaaattgatagaatacctcatgaatatgaatgtatctagaggaactttagataactagtggaaagttggcggttgaatttgtgaaaatacataggaaattaagcatcaggagaaacatacttattaacttcagggttgggagttagaggaaagggtaagttttaatatattgcatggcccagttgtgaagagttaacatctaaccaagatgactatctaacaatattgggaagttggtgggatggaagatgtctgcgtgcagtggggatgaatgctaagagcaaaatctgattcacgtaattgactaaaactgaaaagaaataacaatgttagcatgttgtttaggaatatgatggtaatggacttaaaagtgagggagaggaaaatgggggtggaggctgaatttcctaacaagcctggtggaactatttgactccttaaagtgaagatgaatgggaattaaccatagacttaaactgcagattaccagtaactagttaaagcacctcttagagtctttggcatacagtaggtgcttactaaaagtatacatcatctattgtgggcagaggcaacaagagaatggaattccagccatgaatttactctgatgatggagatctgagtgttaaaacattaaatatttacatattctaccaaagcatagaaaaatgttgaaatttaactttgacccttaacatttaagtagtagtcgcaatcttggctgcaaatcagaatacatagcttttaaaaaccaatcttgtttcatatgctacacttgggagagtttttttaaacggtgcctgggtaatttagtttcatctggtaaaaaccagcctgtaagcatcctcctctttgaaacgattagtaatgattatattttggtgtttattttctgtgatgatgtatgtctatttgtattactaatacctaaaagactgtaagctttaaaacatatttttctttgttttaagccgcttgatggcattgaaacgaatgggaattgtaagcgactatgaggtatgataaaccctttccaagtttttgtaagattaattcagtaaattaaaataacttctggtgacatatttgatgaagagctattaaccaacatatactattttatatttcacagaaaatccgtacctttgccgtagcaatagtaggtgttggtggagtaggtagtgtgactgctgaaatgctgacaagatgtggcattggtaaggtaaaaacatttctctttgcctgtcatatagggaactactcactcctggagtaaatcaggtacaagttaggattttttttctttaccagtggcttattgacttgcagtgtattaatctagattgttctttctactcgggttgagacatatccccacccaaacaaaaggtgatattagacaaagattgtctaattgtgtttagaaacgtttttgtttgaagtaatatgcaaacaatttggacttaggtgttttagatatagaaacttaggaaacaaggctgttaatttgataaagtgtgtgaaacactgaaacatctaacaaatattttattaaacatataccaggcagaatagaaaacatgtacctttcctactcttgattttgaactagagaatgctctggatggatttttaaaaattggtactcttttacttttttctaaaattcatttagattatgggttagaaagaagtaactttcttgtaccagaattcagtctaccaatcttagatttataaagccagagtctatgatgttagatacataatggttgaatgaataagctttccacaattatatatcctttaatttgttgttctggtaaaggaagcattctcccacagtttaccaatgctttctaatatgttggtctaccccaaattcttaaaagaaggtgatttcaaaattggcactcacttatcaatatagaaataacaccaccaaaatactaaaaatatttattgaaattttaatacctttcaaaagatttacaaaacctggacaaaaattgcttatagctgacttaagcaccctgactgcttgaccagggataatagagattattgagattagtggctctcaagtttgagtatgttatcacaattagttggaagccttattaaagcacagattaacagatcctactctggtggttttgatttttataggtgtcaggtggacttcataattgacattgctaacaagctcccaggtgatcctgatgctgatgttgctaggattacaccagtaagaaccactggatccttgctctactccaagtctagtccctgaagtagtaacatcagtatcagctctcaatacctacctcagacatactgaatcagaatgtgtattttaacacaatccccaaatgattcatttgcatattaaagttggagaagtgctcttgcatctctaacaagcttcaggtgatgctaatgcagctagaccacgccattttgagtagcaaagaggtagaacagtagttatatattgctgtagttagaatcacctgggaagttttaaaaaattctggtgtccagactgcaccccataataagtgtctctggggatgaggcacaaacatctgtatttttaaaaattctccaagtgattccagtgtgccctcaagtttgtaaactgagaatctacacaggtaagtttcaggaagtctttctttaatttgtaaaacagataaatacgaagtgaattaatgaggttaaataggaaagtagaagatgttaggaaacccagagtccatttcttatccctgaaagcctttggatctctttaaagtatctggggtgccttggatcaccagatctatattcgctgctttattttagagatgaagatacaggcctaaaaagtgaaagtgatttacccacaatcagagctaattagtggcagagttacagctcagaccttctgttcccaagtttaatgtttcccgcaacttatgtataaacaagctatgaggcagaaactcatttaatacttggcctgacctaataaatattgatgagcttaaagaaactatgttttggagactcttacgtaggattagaaaattttggagagtgtgagatcttttctagtattaagggctatctaggtgttatgggttaggttaattttttttctttttagttttttattgaaaagaaaatcccatttttgtttttattgtttagtgtgctgagaattgtattaaagagtcacagaatttcatatgaagaagggacaggaagtccttggctctagcctgttcttactgataagaaatgtgatctaatggccattttagtgtgtgtgtgtgtgtgtgtgtgtgtgtgtgtgtgtgtgacaaatgctttttgaaacaggcttaagtgtatagcaggaaacaacaattaactggtttgtaattctatttggaataatgttttagccatgtcactggtatatattttgtcatatacacaaaaggagtcaggttatactatattttaagttacagcacttgttttcatcttatttaaagatttcatttatccaatggattcctggcttttagcaaaaaaatggaaatgaagtaggattttgccacagatttaaaaaatggaatgaaagggaattaatcttaatttctgagtaaattatttagagaggcagcacagcattgtggttgaggtgcagatgctggattgagaatgcttgaatttgaatcccattttcacttcatattagatgagtggcctttggacaagtgttgtagttgcctcattttaaaaataaggataatagtacctacatgcctcacatgagcattcaatgaattaatatatggcacctagtgttgtagagttagctaatattattatcaaactgctaaactaattaaatgtaaagctctctaatttattttttgatatgtttagttttttggtatgtttttcatcagaataccactattttcattttagttgctactctttgattatgacaaggtggaactagccaatatgaatagacttttcttccaacctcatcaagcaggattaagtaaagttcaagcagcagaacatactctgaggtaaatggaatagcaatcaagtaccatattcagtgaaatcttactttatgtatttgatatgagttaatataaatgaatcttaatttttctctataaaatgcagttttcacttgtacaaagaattctcttacctgttggacatgggttggcaaactttttatgtataggttagataataaatattttagtctttgagggccagatattctgttggaactgttagttgcagtttgatagcagctgtaggcaaaacaaacatgaatgagcatgtctgtgctccaagaaaattctatttttggactctgaaatttgaatttcatacaatttttaatttttttaattaaaaaataaaatttttttgagacagtctcactctgtcacccagattggagtgtagtgacacaatctcggctcactgcacctccgcctcccgggctcaagctatcttcgcatctcagcctcctgagtagctaggactacaggcacgtgccaccatgcctggctaatgttttgcatttttagcagagatggggttttgccacattgcccaggctggtctcaaactcttgggactcaagccatctgcccacctagccctcccaaagtgctagcattgcaggcatgagtcactgttcctggctgataaaatttttatagtcataaatgttcttttgatttcttttcccaaccacttaaaaatgaaaaaaaattcttagtctgaaggctgcacaaaaacaggtggtgggccagatttggcccatgggccacagttcaccaatccctgctttaggaatttcctttgtggccccaaatttgttaactgagtaaggaagtgaggctgagttgtaggtagttactggacatggttaagtcttaattcccaacacttagattgattggggtgggaacagttttgtaatctttatgacaaaaatgaacctagtccttgaagtgtgagataaaagagacagaaaaggactttgggttttctttgaatagcttgaattcgcttctctaaggtatgttaaatgccctttagctctttcatctcttttcctcacagttttttcttactacagctactagtagtagtctttttaaaaacatttttttagagacagggtctcactctgtcccccaggttggggtgcagtgggtgcgatgatagctcgctgtagccttgaactcctggactcaagtaatcctcccaccacagcctcttgaaatgctaggattacaggcttataatcattccctttttccttcttaggaacattaatcctgatgttctttttgaagtacacaactataatataaccacagtggaaaactttcaacatttcatggatagaataaggtaaaattttaatttatgaatattttgtataatgtccagctcaagtattagaaaattattagaaaaatctatggattaatccaatgaatggaagattgatatatatttttccatttttttagtacagcaatttttgtgtaatttttatgtattagaatatcatttaaaggtatatattgtccaaaaacaattaaaaataaaaagcaaacaagcaaaaaacccctgtaagttacaatataagaagagaatgtcaactttaagttctgtgttctagattatatttctgtctgaaaatggttttcttcagagactgtcagaccaccactgaaataatgagttgcattcaattagcttttattacatttgtaatgaagcatgaataaaaatgtgaaagctggtagtgaaaaaataactgttgtgaacatactttatacttccttcacccttgtagttcttgtaaaataagtaatactacaatgatactgtagtatcattgatgttatattcataagttactcaatacttgatatatatgatatctttaatattacatatttattatgtaataattatagtcaaacatttaatgaaagaataagtgttggactgaacaagtaagtataatgtattagagtgtattttgtgtcctgatgtttttcaaacttattttctttgactagtaatggtgggttagaagaaggaaaacctgttgatctagttcttagctgtgtggacaattttgaagctcgaatgacaataaatacagtgagtattcctgctgtgcaagatatattcatggatttatctgttttcctgtatattctatcagtatataatccccatcctaaaaacagttctgaatgtaaacccttttctgtgttttatttgtaatgttctcttagcctactcttaaaatctattctaatagctgtgggacctagactgtctagccttgctgctgtgacatgtgttacagtatcctactctttttgctggtaaactataaaacagcaaatacctctgatgtataattcttaaattagtatcttataatcttggtcagcattagttttagcttttgttattttataaatgtataaatatgtataaattgcctgaaaacctggtttctcaaaaaaaaattattttccttttgaatattgtttttaacttttcagatgatattttggcattttttttgttcctgcaatgattttagaaaagtgaaatttcacattaatttgacaagaaatccaataaactttgattcaatttaataatatttactgactgcgtcttgaatactgtcactctactctttaaatagagtatggtaattaccaaggaattccattatcttacaacttgcctcatttgttctgaaaattaattttaaaagaccttggtaatccattcagttaaaagaatttattgtaaattacttcttgctcttttattttttttccttatgttttcacccatttctactaaggcttgtaatgaacttggacaaacatggatggaatctggggtcagtgaaaatgcagtttcagggcatatacagcttataattcctggagaatctgcttgttttgcggtatgcattattctttttggaatattcttcactgttagatacttgagttcttaggggcattgaaaatgtattacaattcaaagaaaaagcaaacttggatggaatactatttggaacatctcatactttttctctttttttttgaaatgtgttttatttttcatgtagtgtgctccaccacttgtagttgctgcaaatattgatgaaaagactctgaaacgagaaggtgtttgtgcagccagtcttcctaccactatgggtgtggttgctgggatcttagtacaaaacgtgttaaagtaagtcagggctaatttttctgaatagtcttgtatgctttcagtaaacataaatatatttcacaaagcatttcagaaactgaaattacaagctaagtatataatttagttactttaaacttaaatgtagttttaaatgttttatatatgtatatgtgcaaattctattttatatatgtatgtctacttttcatatatattgctatattaaatattacatataatacatgtgtgcatattcatacgtgaatatatgtgaatgtcagttactccctgcatttggaatagcttttattaaatgatacaatggtagtggcatatttatttatgaaacattaactgaatgatttaaatctttgcaagtctgtccagtggatggagacttaaacacacttgtttctactatcttgatttaagtcttaccaaaaataaaccaatgtgactaaacagtaattattgttaatgtaattaaacattagtgttactgtaaattttacatttacataaaatgttaacatttatattagtgttaatataaaacacattaacagtacttaaaaaagattcttgaaatctgcttttagatacctctgctatccaaaaacaaatatccagcaactgtactatctaaactgtagctaaaaagaaggaaaaagatttctttgctgctgaaatttatgtcacagtttatgaatcaactcatactttattaaaagcagagcccctttaggtgttctctaattcaggctatttattttccctcattttacaactttaataagcttagttgtattccctaagcctccaatataataagaacaaactgcaacaagacacaaggaggtaccaatcaataagaagtgtcagttgcgagcaaagaaattgaaaaaagcatacatataaactctcaaagtaatggtctagggctatttcatataagagcaaatagcctgtttagacagtagtaggccctgtctaaacaaaacattttatagtatgatacaaaaaaggagaaaagaatcatggctaacaaagtattcccttaaggatgtgtcctatttagctagcccctctattgatggtcatttaggctacttaattcttttcttttttattaacaatgctataggctacatcttgtatatatctttgaatactagattgatcactcttctttttgtttttttggagacaaggtctcactgtgttgcccaagctgaagttcagtggctcagtcatggctcactgcagcctcaacctcctgagctcaagtgatcctcccacctcagccttccaagtagttggaagtacgagtgtatgccacaatgcctggctaatttttgtattttttgtagagacaaggtttcaccatgttgctcaggctgttcttgaactcctgagctcaagtaatctgcccacctcagcctcccaaagtgttgggattacaggcgtgagccactgtgcccagcctagagttttctatagtacttttttttttttttttaaacagggtttcactctgtcacccaggctggagtgcagaggcacaaaggcacaatctcggctaactgcagtcttccaggttcaagtgatcctcctacctcagcctcccaggtagctgtgactacaagcacccaccaccacgcccagctaatgtttttgtattttttgtagaaacaaagtctccttgttttccaggctggtcttgaactcctgggctcgagcagtctgcccatatcgaccttctaaagtgctaggagttacaggcatgagccactgcacacggcctatagtacacattttttaaagtagaatttctgaatttacgaaatatttactaaatttctcctgcaaaaggattatacatttgtatcatagtttaggagtacctggttcacccatacctttgataactttgagtatcatcaaactctgtaatctgtcattctggtgggtaaaaaacaggcatttaatttttctttttatttgtgaaaaaggttgaacacttacattcttctgtgaattatctgctaatagttgttgctcttttttgtcttgtatattaagaatgtgtatttgcaaatatttttgtcatttatcttttttatgtgattttctctgtatagaagcttttattatgttagtgcaaaggtaattgtggattttgccattacttttaacaaaaactgcaattacttttgcgccaacctaataaaagacatcagattggccgggtgcagtggctcacgcctgtaatcccaacaatttgggaggccaaggcaggcggattgcttgagcccaggaatttgagaccagcttgggcaacatggcaaagccccatctttacaaaaaaaaaatacaaaaattagccaagcgtggtggtgcttgcctgtagtcgcagctacttgggaggctgagatgggattgcttgagcctgggagggcgaggctacagtgagccatgatcacgccaccttactccagcctgggcaacagagtaaaaagtatcagatttgactgggaagagggcaggagggagctggaggcacatgggatgctgaaaatgttctgtatcttgatctggtgatggttacatgaaaggctcatacaaaattttattgagctatacatttaagattgtgcattttatagtaagttacatacaaaatgttaaaattaagtagctttcttaattatctcagggatttaaaaaatacacttctcccacattttagcttctctgaaatcagcatgcttcttgaagttgttgacgtgtaattgtttagctgccagcattttatctttattagaggttcaaaaaaatagtgtgttctacagttgatgaaatggagtaatcttttctttccttcattcaataaacactgaagtatctactatgagccaggcactgtaaataagataaaatttctgttttctggatgcagatttctgttttctggttaaaaaaaatatataattacctatttcaacgttatttttaaaaaatttaggtgttctagtatttttcatgttttaaatttctttatttaagtctattttgatttttctaggtttctgttaaattttggtactgttagtttttaccttggatacaatgcaatgcaggatttttttcctactatgtccatgaagccaaatcctcagtgtgatgacagaaattgcaggaagcagcaggaggaatataaggtatatgacaatctgttagaatgcatgagggatcatattgaataggacaatacataaacagatttggaatacaagataaatggttaatttattcaccatacttcaaaaatgaatgttctttcttgcttttggtaagataaaaagcctgtctgaattcttgattaatgctttagagaactgagaatgagtaagaacactttgatgctgtttgatttctacagaaaaaggtagcagcactgcctaaacaagaggttatacaagaagaggaagagataatccatgaagataatgaatggggtaggtattcttttataaattgaaatggcagtataaaacaaaaccttttatggtagcaaatctaataagattatacaaattgaataattattgcttattaaattccttaaaaactgacataggatcaaatttacaggtattgagctggtatctgaggtttcagaagaggaactgaaaaatttttcaggtccagttccagacttacctgaaggaattacagtggcatacacaattccaaaaaaggtacttcaaaaatatgatttacccatatgtaaatatcatataaaatatttatcatcttcattctaatttgtaatgccaatgaagtatttcctgttttagatattttatgctataggcattaagatgtgagagagaggtatgcagtgttaatatgcaaatatttatagcttaaacttttaaaacatagaataaaatggttttgttcactcattaatgaaccaagtatagtagattttgattaaatgaagatctcatttttgtttatcggtagttttagctacgatgtcgtttaaaaagctagagctgtcaagaatattgaaattactgccttgtaaatcaaaagactggtgaggaatgtaaaagactctgtctttcttctaaaaattagaagatagttgttaaagaaaatttactttataaccttgttgagcatggtcaaaacttgctgattatatattcctaagcatcaagaattctatatggttcttttttcactgtatttcccttatttgtcaatagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttc

SEQ ID NO: 38340 - DNA, 320582 bp, Homo sapiens
gcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggtgagtcccagcactcggtcccctgctccccagccctcctgtcgctcccgtccccggcgccgaagcggttaacgctggacgccccgcgcgcgccgtgcgtgcccctcctgtcacttcgggcggcttggggaaagggtagagggacagggcccgagctgggctggcggagccggggctcaatctctctctctgcccgcgtgcagccagggctggggctccgcctggggcgggggctgggcggctgcagactagagggggcgccgggcgcggcgggtgggcggctgggcgtagcccggtatccagccgggtgcgggtgcggggggcggtgcgttgtgttgttttgctgaaaagggacggtgtggactgcgctccggggaggtggagcccgcgctcggctgctggagacggagagaggggaggggagggaggagaggggaggggcggtgggtggggaaagcagcggggcgggggttggggggagctgtgtagctgcgtcttccaatgcaccccctccgctccagtttctctccgggcgtttctgggcctggagcgggggtctcctctgccgccgttcccttcccccgccccgggagtgtactttgggtctctgtggtatttgggggctcggagctccctaatccgtgcaggctgcattgaacttcagccccgtccgcgccagccgcccgggaggacattggcgactcggatctgcctgcggcttcactttgtccagccagaggggcggcgggccgcgtagtggttctcttttcggaaggcgccccggtagcccgcggccactgttcctcgcctccacgtagcggggtagggcggtgggaggtgtggcccactgggtcacaccctccgcctcagccaaccaagtaaatgtttgtgtacacacacacacacacacacacacacacacacacacacacacacacacacaccagagtgctccgtagagaaagttattttgctctcccggggcagggtgggagtgcgcagtgaatgggctgtccggacccctcattaaagctaatccttcccgacagggtcaggcgcagctggcatggccgaggcaggccactcacttcccactgtgaatcccagggcgcactgccccgtgtttgctgagccacccttcttttagacgccccgctaaggtcctcctgtgtaaactccggcccacacgtgcctaacgcttgggtgaagagggtggagtccaggggcgggtctccagacacctgatgccaagtagccccacaggggccctgggccagccctccctggctggaaagctctggggctggaaacttggacccctggctgctgtgtggcccccacggtggtgactcgattatgcaggaataagtgttctatttgaaaatgaaacattcttgtttacatctctcatgtaagacatttaaaaccatgttcgtgagttaaaagttagatgttgctgccacaaacctcttaaacagtgatcacttgagctaaccgtgtaactactgtttctcccatttgtcaaatgcaggaaataatacccatttttcctgctttatacggatattgaaataaagtaattcatgggaaaactcttttttattgttttttttgttttgagtcagggtgtcactctgctccccaggtgggaatgcagtggtgcaatcatggctcactgcagcctcaacctccccaggctcaagtgatcctcccacctcagcctcctgagtaactgggactacaggcatgtgccaccacacccatctaatttatttattttttttgtagacatgaggttttaccatgttgcccaaagctggtccacatgagctgggctcgagtgacccgcccaccttgacctctcaaagtgctgggattacaggcgtgagccatcacacccatcccgggaaaactcttgacaagtgtaaagtgtcctataaatgtatggcttatacatatacatatacatatacatatacatcatatacatatacatatacatcatatacatatacatcatatacatatacatcatatacatatacatatacatcatatacatatacatatacatcatatacatatacatatacatcatatacatatacatatacatcatatacatatacatcatatacatatacatatacatcatatacatatacatatacatcatatacatatacatcatatacatatacatatacatcatatacatatacatatatatcatatacatatacatatacatcatatacatatacatatacatcatatacatatacatcatatacatatacatatacatcatatacatatacatatacatatacatcatatacatatacatcatatacatatacatatatacatatacatcatatacatatacatatacatcatatacatatacatcatatacatatacatatacatcatatacatatacatatacatacatatacatcatatacatatacatcatatacatatacttatacatatacatcatatacatatacatatacatcatatacatatacatatacatcagacacctagttttttaaaaaaatatatagagagaaacaagaacatgccattgtccagtggttgggccattttgtgtggcagccacatgctgaggctggttccaaatgcagggtgtgagtgatgtgtgggcgtgcccgtggggtggtgccagcgatagtgtgagacaaaatccagaaccagaaaaaggactgtgaggccaggccgtgaacgttgaaaaaccatgttatagttggggtcctcggaccacccttcttgctgccagtggtgactttggcagcttttcataacgttcttggcatgagccagcccaccgcgaaagtagtattcattcagttattccacagtggctgagggtgaccacgtgcccaggctctggttagggtgagatctggggaagatctgcccaagtcctcacagggcttgcagttgctttgggtaccagggaggtcccctcatctgcctaatggtcattacctatggatcattgtgccaggctaggtggcagttataacctcgctgggaaaatgaggctttcagacaaaggctagcaaatgatccagggtcatacgatggccagtgcagaccacacctgtttctagaggcagaaggagcgatgacagtggcctgatgtgtttagagagactttacacccagagatggcaggcaggagtcacgtagaagtgggggtgatactcccactaaggaaccagtgggagcaccccacagaatcgggcgggaggggatggctgcttccaggtgaagagccacgcctcctggcgaaagggtttgagagctagagtcataggaaatgctttgagactggatcaggaaggacctggacatagggttgccagctgtagtaactaaaaatacaagatgcctagttgaatctagatttcaggtagacaatgaatcatgttttagcataggtatgcgccatacaatatttgggaaatactaaaaagtatccattgttgatgtgaaatcccagattaatgggggcgtcctgtatttgatctggcaatgctgccttgaagaccaggcctaaggcgtgaggaccccctcctgaaggcgtgaagaagctgcggtggacgctgtggatagcctcctcctggtgcctggggcccagcccaccctcacctgcagccttggtggactgcctcttactcgtgtctccctccccacctgaaggaatcctctcagaccctggcagcttgctcagcctagtgcaggaacccctggaagtgctgggattatgccctgaggggcaaccctcaacccaggaggggtccagttggtggccaatggcccagccgccctgctgctcagtgggaagttctgacctgggttctgcaggatgcctcaggggatccctagcagggtggggatccacagtgtaacccactcgttaatgcaccttactggcccttctggccagttcctgcctcagtttccccattcccttgtctgcactccctgggataaactcctgaacctaagttcctgtctgagtgtcttttctggggggacctgaactaagaagccattaaaggtaaagaaaacagcattccatgggaatcagcctggaaaagtgtacagagtggagtgatgggaaacgggctggtgtcaaggaaaccaactcaagtactttggcaaaagcccccccccagggtaagggtccgagggcctgaactgcagctgtgatgagagaatgcagaagggcagacgtgggacgtgagaaggccagcctagtggatggcaaggggttgaggtggcaggaactgatgtggaggtatttgggataaggggccggttcttgggggaaatgatgagtctggtcatagcccgggtgtgtctcagcagagggcagcacgtccatggggaatcacatttgcttcctcaccccagcctcagaggactgtggtgtgcagggactgccactgccaaggacatcttggattctgaggagtaataactcttgaaagacactgtggccctggctggcctgtgactggggtcatttggtggcctcctcggacccctagtgcccaagcagcttgtctcttcattgaattggattgagtcgttttggggacctcagcctccagcccatatcataaacagaaccgtggcctagggtgttggaggcaattgttgcaaacctcctctctcgggctctgatgattttgaatgtccccactgcccgcttcctgtcaacagcccatctaggctttgggacaccaggaaggaagaatccattttaggggacagcctagggccagtgggtagtggacggtggtggagacctagaactactaagtaatttatcaattgaattcggttgatggctgtgtactggggaagggaacgtggcccttggacctaacgaaggtgtcgccttgcttggcttcagcctttcttgggcattttgggtcacctttatgggcacagctccagggtcttggaggaggagggggaggatgcaatggagaggaaggggaaggactgacggcacattctatcctgaggccatgctggcctttcaaagtagcaaagggccgtagaggtcagagtcctggcctgttggcatcccgccttggctccctgctctgagcctccatgcctcttgtaaggcatggctgattatgaaggtgatgggaatggttttaggaagtaactcactggaagcgtagctgtgcgtggtgttctgccgagactttggtagcaagcgtgctctttctcccttatgtcggtctaagaaaaagcagcttccctattagtgctaaagttcatagaccccatagacatgctttaatcaaggctggctgccatgtcgtgtgtctctggaactgtttcaagccaatgacagagctggagacccagggagagggaagacgtcagagagatggacccaaggcagaagtctttggggacactgaggcaggctggaggagttcagatggttgctgctgagtggggcatttctgtcagaatgtacatgtcgctggccctctggggagaggtgctccagaaagcctgcacagtcgctggagacaaactaaaagtagagccagggagctgggcagtcacaacgtttgcagagatggggctgggcttgggcgggcctgttgccagcggtgcctccccccgccgcgtggcctcaagggaagccccgcgctgcgagaaggccacgcaccctccgagctggtgatggcctgggacctttgcacccagctcctgccccatagcctctatccggctggaatgagccagtttgggaactccaggatgagggtgggaaggggagccccgtcctgccccggggctggaggatcgaaccgtgacagtgctttgtgcccctcacaccactgaaacgctccggatggaagcctccgcaaagggaagggggatgctgtgtggcacagtggacgtgtcagctttgaccttggccagtttgtaccatcctgagcaagatttgctggattagggtttagggcaatgtttaacaaagtgtggttcatggactagcttatgtagaagctcccagtgtttgtttagaatataaaattctgcttcgtagcccagacttactgaatcagaatgcctgagggtgggacccatgagtttgcatttttcttaagttctccggtgattcttgtacctactggggcttaaaaacaactgggtactattaatagcttccctggtgtaatactgttccatttcttctgcccccatgagttattcctctgtctgcctgcctgcctgcctgcctgcctgcctgcctgcctgcctgcctatctatctatctatctatctatctatctatctatctatctatcatctgcaccttttcagctgtcattgagaagagatatccttgacttttgactattcaacaaaggcaattcaacatttggcttccaaataaagatgaatgcccaaaccagcctgtagccagagctgcctgtgtgggccagcccgttaggccacgctgcaagctttcttgactcagcccttcagtggcttcatgcatcttagatgccctgccgtaagctccaatagggcccagagtatgctatgggaaccttcagtagtcaagcttcttggtgatggggtcctcagactggcctgtggctccagggtttttgatgaagcttggttgccgctctgcagcacgctgggtgtgagagggctgatcagcgagggtcgtcctcagtggggcacggcacattggcccaatgccgcttgagcacggcccagtgctggtcctggagggaacgggcagctagacagtgatgcgtgatcacttcctcaaagactctaccacacagagggcgcagggacacccacagagcagctcacatgggggaatagtgcggagcctgcacaaacccatgggcctgcagagtcacatgctcagtgccttgcgggagtcaccttggagctgcctcgtcctcttatccctacttcacaaatgcccagctgagaaaaagcctgttcatcattacatggtagatgacagggttaattacagtggaggtgaaatatgcatctctgccctcatctagcccccgctgccctattcgcgcttggtcctggtacctctttgtggagggttccaagattcttatataaacgaggctctacatactgcagaggagcagcctactgatgaatgcaaagagttaaatcctggatcatgatttcccagctcgagtactgaattaacataaacagaagcagcagccagcagagttggtgggttcaatcgatattgcatcttttcacatgtcacaaacttgttaggagtctcagtgcattgctagtgtcttttcctgcctcttttctttgaactgccccccccaataaaacctctcagaacaatattgctagtttgcactcagggtttgcaatttggactgtgctgaacactagactggcgaaagaaatcatttggaagcactttttatttgccaacgcctcttcatctactcagacttcgcttacgtaatttgtaaatcagtttgtatcttctaaaaccttcaggcaaatacatgtgctcttaaatattcctgtttcttggctgtttattttcttttgctctccctgttttcctataagagctgattttggtgtattcagctcatggccagtgtctttctgtttctaggcacctttttacatttatgggggctgctaaggttaccgagtagagccacagacactgacaggagccgagtgagaatgtggctcacccgttctcctccctccgccctcccttcggccaaaatgggaccaatgaacgtgatcaccgatgaagcaccagctgtctgccgtcctttcaggacggtgaaccagcccatcctgataaccccacagttctgtcaacgtcgtttaaaatgcgcaacaaacaaaggccgatgggcagctgagctgtgacgttgaaacagagtggtgactttgcttggttctttaaccgtgactcgctctgagatgagcagaggggccacctgagagttcagctgcgtccttcgggcttaaccatacggagttcttagaagcccccactgttactcattgcatggcttatgcccccagaccagaggaaggggttagctattaacgagctgagcttccccagtagaagaaggtgatttggtggaactgtattttagccctgccttggaatggttaattggaatctcactcatctctttcttccactacctactttgaaaataatttaatccctgtcctttacttcctgttgacaggaagccctctctgccaacccatggctggtcacggaccaatcggctatcaccaggctttggggcgtctgccagggcctctgtgttttgatatactctgacctggcagtgaagctgctgatgaatgcacgacaaagaccagtttgctccgtaaccccaggctcccagcgtcttttccatgagccaaaggcctggtcctggaggggggtgccctgcagctctgctggccttcttccaggggagttcattgctgggggtggccctgcagtgacctccactgtgctggggaggggaagaagaaggatgcaacagggtgaggggagaatttgagaaaataggatgcaaattctccacttgtgaataaagaaatagagagccattgctaagaactatgtttacgcagggttagtgctgggaccagaaaccagtcaactcgtttctgtgtgctttccagggactgggctgggtgtcgaggacacaaagatgaacagtgcgatggaattggattctccaaaaaaaaggtcgaagtcccacaccctctgcaccccatacctgtgaatgggaccttctttgagatggggtttttgcagatgtgattaacatatagattaggatgaggccattaggaccggccctcatccactatgcctggagtccttctaagaagagggaagttgcatccagaggcacaggcaagaaggcctgtgagggcggaggcagagattgcagagctgctgccacgagcctcggaatatgggccgctgaagggtggaagaggcaaggaaggatcctcccggaggtttcggagggcgtgtggctctcacagcaccttgatttcagacctctggcctctagagcaatgagagaatccattctgttttaaagcccccagtatgtggtgccgcattatcacagcccaggaacctaatccaacagggccctgccctcaaagcacagcgcagccacagcctccgtccgatagagctgtagggcaggggcttgcactgaggggctccatggcatggcctggagaggtggccaaggccccaggaaggggtcccagcgtcccactgcccacagcactttgacactcccttccaaggtctgggtctttccttgcgtcccctcctcccactgctggaagttctagtgtggaggggctgtgagaaaaccaacgtaacgtgacagaggctggtgtggcagctctgggacccaggcctgctccctctgtccagagcacttcctctttgcctgctctcccctcctgggtggccaccaagacttagcctcctggggccaggggtgcagaggtgtgtgcgaggggtgggggtgggaggacagctctgtcacctgctcaacttccagaagacgggcaggcaggcaggctccacacagccatttgcctattgggctaatgtggaaaccatttactcagctccaccctgctcaccacctcagccatgccagcagccatggggtggtgggcttgaagcatacatcacctgggccccatcctcatctatagcatatgttgtaataagcaccccagagagccttcttcctccatgcaacctagatacgcttgatggggagttgcattcatggtgctgatgaccgatcaatattcttgattgtatcagataccatctggggtggcatggttttcaacagattgagctaatattgctgaagcacttgttatatgccagacgtgtgcttttatatgagccgtctctctttatctctaaagtaatatgtgaaatattagtattgttattagtcttattatccttaatgtagaaaagacagtgtaaggttcacaaccattctagcccaacctgctgagaaaagtctctgttgtgtcttgtcaggtttttgatatctctgcttggctatggcccagatgccccacgagcagccaaggcctccctggggtaggggatgaggctggacggtcaggctgaggctggacggtgggcccagagagggcggcgtctgctgcctcccttcggtttgccctgtgtgtgtcaggtctccatacgcttcacttggcccctttctagatgaaggtcattgaaggttattctttacccttcttatctcaaaaataaataacctgtcttctccactttcttttctttttcttttttttttttttttgagacagagtcttgctctgtcacccaagctggagtgcagtggtgcgatctccgctcactgcaagctccgcctcccaggttcacaccattctcctgcctcagcctcccgagtagctgggtctacgggcgcccgccaccacacccagctaattttttgtattttttaatagagacggggtttcaccgtgttagccaggatggtctcaatctcctgacctcatgatccgcccgccttggcctcccaaagtgctgggattacaggcgtgagccactgcgcccggcctcttctccactttcataggttccagtctctggttcttctttctcagtttgttgtttttgcttcttaaataatggagattagaatgaacactacactcggaatcaggaagccctgcctggcgcctctgtcacctgtctaggggcttcttctcactgagtcatccagtattgaccgcagcctgttgtgtgccaggcacaggggtctcactgtgatccacatgggcccctctctcccctcacaaggcttaacctggggcatgccgtcaccctgtcagttcacgtctgctgctaccaaaacaccaaaaacatagggactgaaagccacagaatttattctttctcactgttctctctgtcagctgggaagttctcgtggttggggctggcttggccgatctctggggtcagccagcagctgggccccaggacagcctcgcctgcatgtctgcccatcgcccagtcggctccatgccagccgagccgcggggacaactgggccgtgtgtccagcaggccgtctaggcagcagcaagagggccagcctgaagctcaggggctcctcaggccccttggccatggcaagtcacacggctgagactcaagggatggagggacagactctgcctgtggatggaaagcaaggtcatgtgcacaggggccagaaggatttgagcggaaccagtcacttaacctgtctagatctgtttacatatataatacattcatatattatataattagtattatataaaattgttatctaatcatatgctatttaaagtatatcctatatgtaatatgtgtaatatgtaatatacatatatacactttgaaaaagagggctggagcctaagtctccgtttggctcaagcaccacggctgtatggaaactgctttgtcctggggacaagtggctttaaggggctgtgggtgaggggcgtgcagagcagtgatggggcctgggtccttccaaagctggacttttaagagtgtcacctgagccctcccatttgcaccactgaagatgagtgagtgtccgaggagatatttcacccctggggagctgccagcgccaggagaacagagaggtcgcttgtctcctcaccactctgctttgcatgttaggtgtattttgagatttctgacatgaccttggggcataggtaatagagtattttcaaagacagagggaaatgctgggcagcgataccaacctggtctggggaaggaactgggccaggagacctcccctctagggttgcagggtacctgccaggtgtggaagtggcgcagaggatgcatggtagcccctgggagaagggaaacaggaagctgcaccctggaccgccgtataatgaggaaacagccccaagaggttaagtgacctgccacgtcgcatggctggccagtggcgaagcaaggattgaacctgggcctttgcactggaggcgtgttgggaggagaggagtcccaccctggctggtcagctgctgtggctacggtcagggaagggcttctgggagccagcattgccatctgccggccctgtggctttctgcctgagatgcctgctcttgaggctggaggtcaggaagccagttcacagcagtgcttgtttcgtgctatttcaagacaagggctgtgggctccagactccattctctatcacctccctcctctctcctctcctctagatgtggcaatatcagttctcaggaaaggctcaaagcgatgttctgtaggagaggcatgcaggcatagagtttactactgtgataaaatacagcataaaggcaggtggacatatttggttcttggttccttttttttttttttgagacagggttttgctctgtagtccaggctggagtgcggtggtgcgaacactgctgcctggaactcctgagctcaagcgatcctcttacctcagcctgctcagtagccgggaccgcaggtgccaccaagcccggctaattttttgatttttcatagagaaggggcttcatcatcttgccaggctgctcttacactcctgggctcaagcagtcctcctgcggtggccttccaaagtgctaagattgcaggcgtgagccaccgtgctggcctcatatttggttctattccttgttaaatgatggtctgccctccagtggcctttgtcaccttcacctgaaggttatgctcagctggtgagtctgtgcctctagctttggccactcagtggtgaaagagggaagcaagctggactgagcagaggggaagggcgatgaagcattcacaccaaaggcctcagctgaccccttggagcattctggaactgggatgacccttcagagttgtcccagattgaggcaaagggctcccacactgtccctgggaaggggatgtgaacttgggtgaggcggatcccgtcgggtgagggcaagtctcagccaggcactcagctgagtaccagtggctaccagtgctccctgtacccggggacttaccagtgccccctgtacctggggatttaccagtgctgcctctacccggggacctaccagcaccccctgcacccggggatctaccagcgccccctgtaccctggggtctaccagtgccccctgtacccggggacctaccagtggtccctgcacccggggacctaccagcgccccctgcacccagggatctaccagcgccccctgcaccccaggacctacaagtgccccctgcacctggggtctaccagcaccccctgcaccccaggacctaccagtgccccctgcacccggagatctaccagtgctccctgcacccagaggcctaccagtgccctctgaacccagggatctaccagtgctccctgcacccagagacctaccagtgccctctgaacccagggatctaccagtgctccctgcactcagggacctaacagtgctccctgtacccagggacctaccagtgccccctgcacttggggacctaccagtgctccctgcgcctggggatccgggagccacaccacggcatccacggcaccgcgtccctttctcataaaatctcacgatttttctttcgaagtatccagcctgtctccttaattaaaccataagctcctttaaagatggcatgcgtctacactttgtcatgtcccagccctgaggaagccacctctcacacagccgacctgaatgttgacaatgatgatgatgatggtgaggacatgcagaagcttaactaacagagggggaaagaaagaaaatgggggccgtctttgagaatggaaatgcttagttaactcgacgacccaatttagaaaaatctgagtgaacccgttttttacaaatcttgtgggagccacatacctcaaagagaacattttcagacaaatcatgtcttgttggtttcaaaaagaggcatttttttttccatccaatctactggccagaaaaaaaaggggcagattttaggcacattactgtgttatttgtttttttccttcacctcccacttgggaaagttacttgggctttggctcaggctgattgactagtacagcatcctgtgtctggcaggaggcatctgccatggcgggatggtcctctgcctggagacgggccgggcgcctagaccttcatgcaatgcagagcccgggggccagatgccagtgcctcgggcctcatccccttcagggacctctctatttcctggtgccattggaggagggagcatccgtccactgaggggacgggcatggacctagccgtccctcatactagattctcaagaacagagtcctgtgtgtgagcaggaagatgggatggtttttatcttgccaatggaagagtggctgctagggagggagcatgagtttgggtgccagaggccaaggtcgcaaccccggtgtcaatgattgccccctgtgtcctattgggcagttcactggcacaatctaagcctcagtttcctcaccggtaaaatacagaatataatccccacctcacaggacttgggggagcatgactgagatgccacagtaaagagcaggatgtctgtgtctagaagggttgcctccctctccctaacaagccgcccatgggaggaccgaccctaagaatgtagctgtggccaccatcccatcccaggttttctggggatgtccccagcttcagataattttattcttttcaatggaggtgattcttttttttttttttttttttggagacagagtcttattctgtcacccaggctggaatgcagtgacaccatcttggctcactgcaacctcagcctcccgggttcaaccaattcttatgtgtcagcctccccagtagctgggattacaagcatgcaccaccatgaccggccaggttttgtatttttagtagagatgaagttttgccatgttcaggctggtcttgaactcctggcctcaagtgatgcacccgcctcagcctcccaaagtgctgggattacaggcatgagctaccatgcccgtcctgcaggtgattctttgattgtaatttgaacgagatttcctttttaatccctcattaggctttggctgaataatttgcaaatttgttcaataggtctccttattcacactgagacaggccaaggtcctgaccccagagtgaagccagcttgagcccccagggctgaaggtactgagcccttaactgagagtgagaaggcttagaaatgggcttggccttggtccacgtgccaggaacttgaaggcaaagtcttggggtggggctgcagagagttgaggtggcgggcagaaatctaacctggcaagctctacctagaagcagaatactgggactttagggtccttggagtctcgtctgcctgcacctccctctaccacaagcctaacgtgaccccagtagggtcatggcatggaagacaggtgggcagacaaggggagacagtgttccctgggcgagaacagtgccctctaggagaggtagggcacagcaggcatccttgggaatcagttcatcaggttaatatgctttttgtcctcttctccttggggcatttgctgtctaatggggaactcatggggactttgcaccttgactccagaaaataaatatggggcttttagagaacactcaggctcccaagtcatctccttccagtctgcagtgggcctcgggtggggtgggtgagctgggggccgtgctctctctctctgtcttgtggttggttcattcccaatgggagatgaaacccacacccccttccacaggcgaggccttgggcaccacagatggcacccatcagtgcgtgtctctgattgtccaccagtacaggcgtggatgccagggaggagagggggtgggcaaggacaagcaatgtagagatgcaggtggccgtgtgtggtattggaggagtgagatgtttgcaagaagttctggttctctctgctgcaaatggcgcaaagcatgcccagcctgtggtcttgcctgtccgagggcctgtcctggtgccccctttctgccctgcctccagcaggaggggctccacggaggctggagaaggggcagtggctgggcatatcatagctgctggttaatgtgcttaatggaaggtggatgaaagcatccgataggcagatggagccctgttagtgactggaagggcccctccgggtccagcattctaggcttctgtgatacctgctacagctccaggtgcccggccacctccgtcagcccagcccacagtcccacctgcaggtggcggagagggaatcttggactacatcagaagatgggcactcgtgtcctgcaaccctgcgtccctccagcggcatggactcaggtgactcccatggccttggatttccagctgataccctgagatgactactgcctaaatgggagtgagggacagctgtttaccagatcattcaactgcttggcactggacagagatggagatacatcctcggtgccttaacctgcagctctcactgggacaagaggatggctggcaagtggctgatgagagcagaaggggagctgaaggtatccaaggccactcagcttctgatggcgccaagggacagctctggcactgtgggctgtggctggcagcagacccagccgggcttgggcacacagcctcaggcagctgccgccagattactcacctccactctcacagtcctcgcccctgggaagtcttccctattcgctaatcccatggccctttaagtgtgtgtcttagctgtgtctcagtgaacacggagagatgtgctgggcgctgccctcactctgaagaccatgattcctggccagcacctttgtcttctttggagaatcatacctttccacggggctggcagtcgcatcccaccctctccacccacagacctcacagagatggtgggaaggtgttgccgcagctttccgccttcgctaccgtgtgcagcagggactggcttgcgggcctcacctcgccccgccccgtctgacgccgttccccgcggagtgttctctggtgccacagctgtgcagcaccctcgaagcccattccctgggcatcacaggacgatgcacacagatgtggtatcggctgtttgctggaggccccagcgacctgtttttcctgaatctgttctgtgacagactccagagacacctggccagggtctggcttctcctcaggagacactggattttctgagctttccttgatctgagaagtttctgaaaactccccttgagtcactgaggccagggatggggctggacctgctgtcgatgccagccttgcagaggagcaggaagaggggcctcctaggggcgagacaaggcctagggtgcccgtcagctccatcaagactcctgggggcagaattcgtgttccgttcatctttatggtccctccaagtgctccacactgtgcattctgcatagcaggtgcttgctgaatacctcctagctaccagcaaagcatctttggattgggggctcaaaccaaacccatctcagcactggaaaactttcaaatcacaggaagccgagaaacggccgaagtgaatgacgatgtcaccccttcttccagcagcaatggtgtcaggcatggccatggtccaggaccattgaggaggcaggacttccctttccctgtgactctctcttcctgtagcacaggggtggtgtgtgtgtgtgggcaggtgaatagtggaggggaataatggggtgtgggagatatgggtatttaactatccactgaggcttacctagtccaatccctgacacgtatctttatgacacctggataccgaaagtgacacaaggtatgcataaacaaaaataaaaataatctccatactgcttaaagctccaaggagccagtagcttcagtcaccttcccaccaagtggtacagattgggctcttcaatgggccagctggggacagctgtggccgaggctggcagggtgctgctgagtactggggaggagaggggagtgtaagggaggggaggggaggggtaggcacggtgcaggagaggctgggctgccccacagtctcagctagggcctcagcccacccttctgagccttgctgggtagcagcaggggctggggacaatcattggtggatgtagctgactgtggaagaggctggggccttgggaaggtggctcctccagcctgggctgtccccataaggggctggcagccgaggggccacagcaccaccagcagtgggggaaaggagcgcttcattcccaaagagagatgggagaggcaagtcccagcaccctgtaccccttagggagcagccaaaggagtaaaacccgcaattctttgtctcctatgccccattccttcctagtgacaggaaatcaccgtttgggattgtatagaaggtgttagaaattgtatgcccgccttctgatgctccagcgaggtggcacctggttcagatgacttttcagttcagacctgaagggaaaagaagagcaacagtgaccacaaagagagcgagcgctcccaagccagcaggtcctcagcatgcgtgggtggcagctgacttcatccccacacagctgtgtgctggtgctgctattgtccccattctacagatgggaaaatctgcacagcagaggccgttggcagggggtggcacagccgggcatcaagccggagccgtctggcgcctgagcccacacacaaccgctgtgctgaacagacagatggtgccggaaggcagcatgcaacccgagaaaatgcgtggagaggagtgggctgttgctttccaaccatttttataggctgactatagatgcatttatatgaagtctttttttttttttttttggtacttccagttgctgatgggtccaccttgggcacagccccctctcacaggcggacctgggcatcggcctcattcctcatttgtgcagaactctgtagggctcagtgatctgggagctgggagctggcaggagcagaaaggtcctgaatgtcacccagcaaaaagcactgaccttttctggctctcatctcccacaccgtcttccgcaggatgctgcgcgttctgtgcccatcccttatactccctgtgggctttttttttttttttttccagcaatgatcagcccttgcctaattgcaaatagatgggtcttaggattgtttttttgttttaatgttgcctgcaaaaattacactggttagtgtctctggagccctaaaagataccaccttttacacaaagctgaaagcagtagactttgggctgcagtccagtagtttcttttgtcaccgttttctgtttctttcctctttctctgctccgttttctctccgcccttcttgttgtcttctgcctgctgtcctgtatcttctcctcctttatcttgtttccttagagctgggtttcaccagacttgaaacacctgccttgcgatccagttctcttccctgtggcggccacgtggctgatgaggcacaggtgaccgtgctccggtggggacgccgtgaccgtgtgtgtggctggtcttgtttttcagatgcgggcattcactgagttatattcggtgtgggtgccagacttaacgtctttcacatattttgccatttaactcatcagcaactctgcctgttcctagtattcacccggtttttacagttggagaaacggaggctcagatagaatgagttgtttgcctaagggccacggcgaggccaattgaacccggtgtggctgtctccaaaatccacgcccttccctgcaggacgtcttttcgtctccccctacatcctaatttggggcaatgaagaaggcaaaataccttccagggagctgcaagcctccgcaggggcccgcctcggggccactccagcgtgctcgtggcacctgtgcttgcgtcctcggctgcgcgggccttggaaagatcgccacggggagccaggactttggggacctggtttccctcctgccacacctctcattggctgtgtgaccttggacaggctccctgatggccctgaacctaagttgctttgttagtgaaacagcaataagaatacctgcctgcaggtggccatgagaattaaatgataccctatgtaggtttgccatgatatgccatgtagcaaacttgagtatgctataatttttaagaaatcttctttcttcatttgctggagaaaccccaagggcagaatgtgtggcctgtgtctggcgagtgtgtaggacttacgggtttttgtgtcttaacctctctccagagaccgccttactttatcttcctgtggctactgtttttcctcctttcaaggtattttatgtaactgcattgcaagcatccttttggaaatggagacagggtgcacatagcatcatggagctcagctttcgcctaagcgaggacacagactcatctgtgaggtccatatggtctggagcaggtgtggctctgagcctctacccatccctgtggttcctgccgcccccacccctctgcctgcccccacccacccacttttcccctatggcacagcccatgcctctctgcctgcagcctctctgcttggcaaaaacatcccagtgtctgcagtggtatgtgtggaaggtggtgtgtggagtgtggtgtgtgtggagggtggcgtgtgtggagggtggtgtgtgtgtagggtggtgtgtggagggtggcgtgtgtgtaaagtggtgtgtgtggagggcggtgtgtggagggcggtgtgtgtggagggtggtgtgtggagggtggtgtgtggagcatggtgtgtgtggaggatggtgtgtgtggagggcggtgtgtgtggagcatggtgtatgtggagggtggtgtgtggatggtgtgtgtggagggcggtgtgtgtggagggcggtgtgtgtggagcatggtgtgtgtggagggcggtgtgtgggagggtggtgtgtgtggagggtggtgtgtggagggtggtgtgtgtggagggtggtgtgtgtggagggtggtgtgtgtggagggcggtgtgtgtggagcgtggtgtgtgtggagggtggtgtgtgtggagggtggtgtgtgtggagggtggtgtgtgtggaggatggtgtgtgtgtagggtggtgtgtgtggaggatggtgtgtgtgtagggtggtgtgtgtggaggatggtgtgtgtggaggatggtgtgtgtggaggatggtgtgtgtggagggcggtgtgtgtggagcatggtgtgtgtggagggtggtgtgtgtggagcatggtgtgtgtggagcatggtgtgtgtggagggtggtatgtggagagtggtggagggtggtgtgtgtgtaaagtggtgtgtgtgctttccccagctccagccctggagtatggagccctcagccatcctggaactgggctgcgaggccatccctctgctcagatgtgtcctttctttgactgagccctccttccgtgactcccccgctgcctcccttcttgaggccgttgtgtgagaatcacaggaggcgcgccctaaggaccaggcaccctgattctgtggccgtactcatgccctgagctcaaggagtgggagccaggaaggctgagctccagtctcagcccaattgtgcaaactgaggtgatgtcactcaagcctgtggcagtgctgtccgtagccattagcattccatgaggccctcgagtttggcggctggattcccgctgcctggcccttgccagggatgtcacacagccctatcctcgggcgctccaaatgcctccctgtgcctgtgatgtgtgggggaaggctgcgtcctggccagaggctcttgggggcaggtctcagacagcagccctgatggcgtggaggagctgtccaccctcaggccccacaagcatccagctggtccgtgtgctgctaagtccagaagggttatgtgtgcacacgtgtgtgtgcatgtgcacgtgtgttcgtgtgtgtgcatgtgtgtggggggaagggaggcatgcatgtagatagagatgcatagatactctgcattttagaaagttccaggttcaagtcaagctccttggaggctcatttctaatgtgattttttagagaaataaacaacagcagtcggggtggaggcttcttctctctggcccgtgatgggcactgcctgctggcactgcagagcaagggctggctggggtgacaggagtgggctttgcctttgggctgctggtgaatgacccagctgtccccagcgggtggacaggcctgacctcaacaccaaggttatccttgtctgtagaataaagggggcctggattctatttgtttttggtttttcggtgggaagcagcatgatttcataggaggagcctcggtttggggtcagaaggtcttattttgagcccaaatcatcctttctcagcctgtgcccaggttcctcagcagtgaagagcaggtgataatattaggttaaactgcgtggaatagccaatatttgactttttttttttttttttttgagacggagtctcactgtgttgcccaggctggactgcagtggcatgatctcagctcactgcaagctccacctcccgggttcacgccattctcctgcctcagcctccggagtagctgggactacaggcacccgccaccacgcctggctaattttcttgtattttttagtagagctggcatttcactgtgttagccaagatggtctcaatctcctgacctcgtgatccacccaccttggcctcccaaattgctgggattacaggcgtgagccatatttgactattttctaacctcaaaaatgatcatctcacagagttcaacgtaatatctgacccatcaaccatataaaattgtcaaaattgtcatctgaaaaacatatacgtaaattatttttaagcagctgagttttcagaatgtaagttatttttctgacaaacctgtcattttgacttttttccccttttctgaaaccgactttctcctctcttttctggaatcttgctgtgtcgacccagctgcagcccctcctcctcctccagggtgctgcgcctatgggacagcacactcacgcatccagtccttgttggccttgtcacaatcgtcacctacttttaaaaagtttaagagcaagtgttgtagcatctcctgggtcccgagctctccgagggacacagtaaaaagtgacttagggctgagtccagagacactaggtttacccttggaatccttggaatccattcaaggcagccgcccctacctttggagggtgaaattaaatttagtccaagctgcaacagccagtcctggggttgcccgttgagctgcggccctgccaggtgggtcacatatgaaagagcaggtattcttccctcctgaccccttatggggccgtgcaggctgtgagataggagagaggcggggccccagggagggaggaggaggtcaagatctaagctaattctcgtggagtgcagggctctgggcagaagctccgtgcacacccctggcctctccggtctctctgtaggatgggagcacttccaggtcattgtgttcctataggaccctcaggcgtgtggggttggcatctctgtggtcctggggcggttcttcatatggtctcagcctgtcctgtggcttctcagggccccattaacaatggggtgcttaccacatgcccccctacaggtctgtggtctacactgaggatgtagcagtggagggcacatgaggctgctgccctcgtagggtttactttctttttttgagatggagtctcactctgtcgcccaggctggagtgcagtggtgcgatcttgactcactgcaacctccaccccctgggttcaagcaattctcctgcctcagcctcccgagtatctgggattacatgcgtgtgctaccatgcccggttaatttttgtattttcagtaaagacggggtttcgccatgttggccaggctggtcttgaactcctgacctcaggtgatctgcccacctcccaaagtgctgggattacaggcacgagtttctgtgccccgccagggcttacattcttgagggttctgtcccccctagccccagggacccccgaccagtgcctcggtctgagctggcaccttacacagggcacaggcttgcgtaggagcctgggttcctgtgcgtccgtcctgtcactcagtaagcagcactgttgagggtttgctttgaggctggcattcttccagacatgggacggagcaggcacgggacaggcgagagcttgccacccgttttcagtcttgctcctcccctcactgccccctgccctccagctgagagggagtggagggaagcccttcaccagagcaggaagccccggctccctctcctgtgaactcccctggggaagttgagtctgagcagtgttttagcagtgatgggagtgaggacgtgcacatttcatagacgatgatgatacagagtaaggcattttggacgtgagctgtggagggggacccatgaggagggaggcttcccatccttccttccagaagcatccacttctaagacattcgagctcaccagcatgcagagtggggccccaggagcgctctcccctaggtgccaggggttagtggttaatggtttgacaatgataatgaaaccaaaagcctgtgattttggctgaacaggggcatatggaaatttccatctgtagccgactctggagagacgtgcgtggccaacttcacaagagctgcttgcccacactggccattgcgactccacgtctcagatccccgcaccagcctgggccagccaggagtagctgttgctggcagagttgcccacagcgaggtggggatcgggcagtttccagaaaaagggaagctgcttggcaaaagcagaagtgatttttttttttcttttttttttttgccagaggccccaaactcgccagtctcaaactgggaaaacccgttcttagcaaaatgctccagtgagctctcatggcaggaaagctcactccagttccggaaagttgtggttttggcctctcccagcaagaggcaccaatgtaatgtcagagccacgctgaactctggcatgggcgacgtttcttttttctttgagttgtgtgtgtttgttttgtgatatttccctaccaggccattaagaaaagttagatggcagcaagggtgtgagtggctcgatcccagataaagagggccaggcacagagacggcgggatcgctggaggaatttgagagtccctcaggtctcaccacccatttgcgggttggggagcaggggtacccctgtgggccgtgccttggagctcaagtgactggcctaaggtcacattgcggcggctcatcgaggacttcttattccgtgttgtcagactcggctttcagtgacaccatcagtgactgtggggggagggactagatcttcagcatcaaagtagacactgaattaaaactcactgagctgaactgatttgcacaactgcgaggcagcgctcagagcaccagactctcacctctgactcctccctctggcagaagccggtggggcgggtggatgctggtggggcacaagggccatgttcctggacacaggacgatggaggtggggcaggcgggaaggagtgtagaacttgaggattttggaattggtccatctgggttccaatccaggctcggggctccttggctgagtgtgagcttgggctgctttgatgagcatggccaatgccatctctgaacctcggtttgcccacctccacaatggcagggctgcccaccagatgacgtgtgcttcgaggcagagcatgggacaggttgcccttctgcctcctgttcatttcttcctttctaagatgaggaaataacctattagctgagcagggttacttcggagcttagacagatttgatccctccttccaggagaaaccttctggacaggcgtctttccattaaacactcaagaagcgttctaggtgaggggactgtacctccaggtttctcctgggcccacccggttcacacccactgtccctgtgtaatcatttgatgtgcccactatgggtaattggtgctacggttcccctgcacccccctcccgcttctttctgcagacactgagccacctgtgtgcacggcccctcggtttaggcggtgtgggttctcagcctccctggtgtgtctcgctccccctgcagcccagcagagcctctctgtgcctagctacagcacgctccggaaaatggcaaacgtgctgcgggctgggcaggagcagcttccccaggtgggaacacgcccagcatgcacaagtggcacggattgaattatgtcccccaaaatatatagagaggtcctaacccccagcacctgtaaatgtgaccttgtgtggatatggcgtctctggcagatgtacttagcgaagatgaggtcatcctagagcagggtgggcccttaatccagcataactgcagcctcccaagaagatggaagacacaggcccgtggggagcaggccatgggacagcagaggccgagacaggagtgcgctggtggctaccaaggatccccagggagagccagtgaccctcagaactaggaagaggcacggaagggtcccccacaggcttcagagagggcgcggccctgcccaccccttgatcttggacttcaggcctgcagaactctgagagaatccgtttctgttgttctaagaccccgtgtgtgtatgttgttacagcagccgccagaaatgaatacagcaggacttggtgtttcttgtcaccctccatcctttggtctcctgtccatctagacacagagactaatagggacatggagaaactgaggcacggagattcttgactaagaacttccccaccatcatcctgacatcgcttggactcctgcggaagggaagggccaagttccagaaaacagagcctagctggcatggccagaccgccccgtgtgggagggagcagggccctgccagaaactttctccaaagcacggtgcatcggaggcccctttccccaggcagcctgtgtctcagggcctgcggctgccaggcagggggcactgcctctgcgtcttcgtttccccaacacggttagaattctcgaggtctccaccacgcccctgtattccaggatcacaaagaacttcctaaatgggaacccattttcgttcagaacaccctgcaggagccattgggagaggaaccgtggagcagtacccaggtcctgggcctgcctgagccaacccgtacggctcggtggctggcctccccaactctcctcacctgcgggctgtgaagatcaaatgagatgatgtctgctgacggaagtccaatttaatttttaaagttatttattatccttattatcattttcttatttttaggtagatcaaaagacatgcagtaggctgggtgcggtggctcacgcctgtgatcccagcactttgggaggccgaggcaggaagatcacctgaggtcaggagtttgagaccagcctggccaacatggtgaaaccctgtctctgctaagaatatgaaaattagccaggggtggtggcgggggcctgtaatcccagctactcaggaggctgaggcaggagaattgcttgaacatgggaggtggaggttgcaatgagccaagattgcgccactgccctccagcctgggcaacaagagcgaagctccatctcaaaaaaaaaaaaaaaaaaaaaaaaaaaaagacatgcagtattttcttcatctgtttgtactgctataacaaaatacccgagactgggtgatttctgaagaatagaaatttatttccagttctggaggctggaaagtccgagacgagggtggtgccaggaggttcggtgttgggtgagggcctggtctctgcttccaaggtggcaccttgcacactgtgacttcacatggacaaaagtaggcctcactggttccttccagctcttttctaagagtagtaacccatttctgagggccctgtcctcatgacctaaccacccccaagcccacttcttaatattgttgcatgagggattaagtttcagcatgaattttgtaggaggcacaaacattcaaaccatagcagtatttatccaaaggtttcatctgctcccatcctgaaagctgaagtcctcagcctcgtctctgcaatctgacttcacagtgcaggagggaggggtggcgtagtttaaaagccgctgggccacgggcactctttagcaactgactctttagaaaagcagctctgattcatagtgtttcctgactgctgtggtgtaaatgttcccaccatggaagatttccacatggcctcagttaatggagctggggaaagacacccccagtctgctccggggagcccgtgtgagctgccagcttcacctgcctaaacggatgcttccgggcgccaacctcacagggtggcctccttttctctacacctgaaaccccagaggacagaagcattgtgtctggaagaaagagccagttcgaaagactcaggtgcccaggctgggagcaagggctggagcagccccagcggagcttgtcggtgctttgccgcgtggttatataccaggttagctcatcgtcgtgttggaaggaaaagggctctgagccttcagaagatgagcagtgccccaggatgagtgatggggctgggaaggccagggggtacagcctcagtggggtgcttcacagggtctcaggtgtcgatgtcctgtgggaaggacaagttcctagagagagaggctcggggacaagagctcaaggccagcgtccgtgaggatgtggcttgagaaaaggaacagagctgatcatagaaggaaaagtcagctaagagccacctgcctaattcactctcagtaggctcctgtcgccccagcctgctaacccttggccagaggaaaattaccggcagctcaggggctccctttggatgcttggccaagaggaatattcttcactgtaccatctcggccacacagttaagctggtatctgctgtgtggacactgctgtgtacccagaataacactagacatcagggaccccagcctaaggctgcagtcttcctgcaaagtccaggcggtttcactgggagattccagaaccatttccctctcgggcatcccccgtcaagcatgggctttgcacaggtacaaggccgagagcatttacctagcagtccctcacccagccgcttacccccatacacacttacattagtaacagccttggtgatcttgctgacagtttaagaagcagatgaggactcacatttgtgtcattaaaacacaaatccctttgcaaaactggatctcattcccagctgtgcgtgttagtggactgtcctcctcttcaaatatgaccaagctttttagaacagtcatgcaaacgtcctagaatccaactacagaagaatactgtaggacatggcatttatgaagccctatggtggttataagagggggattcattttacaaagatacaaagataaccagaagaatactcactttatctacacgtccaaacactcatccacatgcacacgcatacacacctacacatacagacatacatgcacaaagggtctcatataccacctcctgccagcgtcctaagttacggtgtccctcagaaacagaggtggcgttgtgggatagggtagttccaaattgcagccattcacacctgcacaatttttatatccaagtgcaatttttaagcttatttttatttttttatttttaaatttttttgagacggagtttctgtcgtcaggctggagtgcagtggtgcgatcttggctcaccgcaacctctgcctaccggtttcaagtgattctcctgcctcagcctcctgagtagctgggattacaggcgtgcgccaccacacccagctaagttttgtatttttagtagagacggggtttcgctatgttggccagactggtctcgaactcctgacctcaagtgatctgcccacccccaaagtgctgggattacaactgtgaaccaccgcgcccggccttacatttatttttaaaagaaactttctaagactagaagaaatggaaaacttctaacatggttcaccataaattgtaaaaataaacagctgcccatcagggtaaatcgtgtcagctcacacaccgcaagtaggggcgagcactgatcaggccgggaggtctggctctggaaagtcatgtcacagggactcatctgttgaggagggctcctccagaccctgctagcccccgatctgaggacagcacccgtctgtgttccgggaccatacacactgtgtgtgtgaaaatccagcccccagatgccgggagagggaccctgagggagcggcagactctggggctaatggcaagaattattcctggtggctccgatgagctggggttgccgttggtgtttgggaagagctctgatctcctaggtggggcctttcccgcccccgcagtgttttgggaaatgcggctcccactacctgccgccctcagcatttaggtgacttggcagccacctccccttgtgaggatgacgaggttgggaagggaggcaggcatctgaaaacggcagccaccgcctttcccttcccagcgcctcccccacgagtcagtcctgatgctgccagggcccagacttccaagtggggccaccaccgcttcctccctcctcaacaatagttaggctggtggttctcaaacttgagcaagctctggggtcacctggaggctgggccccaccgccgagttttccgttcagtaggtctgaggcgggttcatgaatgtgcttttctagcaagttcctaggttgacaaggacgctgctggtccgggaaccacgctctgaggaccactgggccaggagttgaagagagccggagccctcttgcagctcaaggttctgatcagctcattagcccaagattcattttctccactaacaacgtcttcacctgagaaggaaatgagtcccatcctggctcaagcaggccacagacgaggagaagaggctgtcggggtgaagagggccatttttgtcgctgccaggagagggatgccgagcagtgatcctgccaggaaagggaactgtggggttgagatgtggggggcagctgggaacaggggcaggtggggagggacagatgtctcccagcacccttgtgcggggcggaggctgcctgccgccatccctggagctccgcatacactcttttcaacagcaccgagaagaggagctgtgacgtccccgtgtcccagggaggtttgccgggctggggagcacagaattcatctgccagactcagacccaggcggtctagcccaagagggaatatatgtatgtgacaacaattgcatggaatgataccgatttattcatccagtaaatacttactgagcctttactttgtgccgggcactgttttagacacggggctttaagagtgaacagaactgtcaaaaatccctcactcatggaggtcacatgctggtgacgaaatagagacagtgagccacagaaagttagtgtatttcaaacttttggaccatgactcacgatagaaataataactcgtgtttgcatagtgctcactgtttgccaggcactgagttattgtctgttctacgtttcgtatctctttctatttcgtatgacctacctaaaataactttgtgattcgctcatggggaagggcttctcatttgagaaccactgctccgatggacacgctcacccaggtgggagggtttttacccccgttccttcccacctctgcctcgccaaaccagccccttcatgtgatgggtcctcttccgcctctttgaggaagccgctctgacttccagcccacacgacttcgcggagtggtagaagttgagagctagagacgaggtgttagggatgaggtcacccagtatgatcttcccattttacagaagagtacactgaggcccagagggagcactggcctgcctgtggtctgtagtagtgagtgaccagtctctgagggacactgccacaacttcagagccacgctctttctctatctctgcagcaaaagaggagagcttcccaagggcttccccaacccctgggaaaggcctggagtgtgggaggaaactgactcatgccttcttctccatctccttctatctcctccttctacctccttctacatctccaaaccctggccaggagtcaggaggcccaggctgaggccttggaatctgaatttttaaaaagcttctgttccttggaattctacagaggtgggcagccatgtgctgcctcctgctcaccttccctggctgggctctgaggacgatggagccttctgccatgacatgtccatggatgtgagatgtgaagaggaagaatttctatccgatcttaaccaaacagagtgtaggttttggtctagatgtttgaattgggtccaagtcttcctgctttgagtcagctgattccaaatgaatctattttattaatttggtgataagtggtctcaagttccagcctaaacttccttggggggcctcaccccagtggggatagagataaggctgtgtgataccagatcctagaacaaacactcaaatactcagctctgggaatagaagtgcaagcagaaatccatttattctctttgaaaacacaccaactagatattgcttcaactttactccataaatcagtgagttttttggtgacataattcatgaaacttttgggaaaacaacaatgaagccaccagatttgaaattcagaacaacagctgtagccgcgtgatggtgcagcctgtcttcagcttgtcaacaccatattccttaggaatggttggcccaccagttccttgcagaaaccacagaactagaatgaagtgtctcatgtacatcagcttcaggaaacgacaacgtgagacatagccctgctgctgtgttccatctgcttttatatgcagctttgttccaggttctagacatgtggacacttaagtattatctgtgtacatatgctgcacgtctgtgtgtaggtttatatcaaaacttgtaggtacactggggcttggaacacatatattcatgcccagaaatctgtgcacatagatatatagacactgtgtgtttgcatgactaaaagcatggcctgcgtgtatgtgtgtctttcaaatgcctgctgtattggcttgttggcctgcacagatacacccagattcttgaactcagatggagcctgttcagcagtgtcccaaagtagggacagggaagaactagaccttgaagggaatcctgcagtttacttgttttctatcctaaagacacgtttccacctgaattgagaagatcagagttctgaagccttcacaatcagaattgtgaagcctcctctgcttcacggcagcatccccatgctaccaccgctacttactatcactacctaccatcactacccatcactacctaccatcactactatcacaaccatcactacctaccatcgctaccatcatccctacctaccatcactaccatcatcactacctaccctcactactatcactaccatccctaccatcgctaccatcatcactacctaccatcactaccatccctacctaccatcactaccatcactacctaccatcactaccatcactacctaccatcactaccatcatcactacctaccatcactaccatccctaccatccctacctaccatcgctaccatcatcactacctaccatcactaccatccccacctaccatcactaccatccccacctaccatcactaccatccccacctaccatcactaccatccccacctaccatcactaccatccctacctaccattgctaccatcatcactacctaccatcactaccatccccaccatcactaccatccctacctaccattgctaccatcatcactacctaccatcactaccatccctacctaccattgctaccatcatcactacctaccatcactaccatccctacctaccattgctaccatcatcactacctaccatcactaccatcactaccatccccacctaccatcactaccatccccacctaccatcactaccatccctacctaccatcactaccatcatcactacctaccatcactaccatccctacctaccatcactaccatcactaccatccctacctaccatcactaccatccctacctaccatcactacgtaccatcactaccatccctacctaccatcactaccatcactacctaccaacactaccatgactacctaccatcactaccatcatcactacctaccatcactactatcactaccatccctacctaccatcactacccatcactacctaccatcactaccatcacaacctaccatcactactattactacctactatcactaccatcatcactacctaccatcactaccattactacctactatcactaccatcatcactacctaccatcactaccatccccacctaccatcactaccatcactaccatccctacctaccatcactaccatcatcactacctaccatcactactatcactaccatccctacctactatcactacccatcactacctaccatcactaccatcactacctaccatcactaccatccctacctactatcactaccatccctaccatccctaccatcactaccatcccaacctaccatcactaccatcatcattacctaccatcactactatcactaccatccctacctactatcactaccatccctacctaccatcactaccatcactacctactatcactaccatcattacctaccatcactacctaccatcactatcattactacctaccatcactaacatcactaccatcactacctactgttactaccaccactgctaccctcactacggtggctcatgcctgtaatcccagaactttgggaggctgagatgggaggatcacttaagcccagcagtccgagaccagccatggcaacatagggaaaccctgtctctacaaaaaataaaaaaattagcttggtgtggtggcaggcacctgtagtcccagctactcaggaggcagggtgagagaattgtttgaatccaggaggccaagggtgcagtgagctgagatcgcaccactgcacttcaggctgggtaacagagtgagatcctgtctcaaccaatcaattaatcaattaaccaatcaatcagtcaatcagatggggtctcactctgtctcataggctggacttgaacacctgggctccagtgatcttcctgccccagcgtcgcaagtagctgggactgtaggtgccaccgtgcccggcagcactttatattcttaaactaacaacatccacagttgatgaatgaggagcctgagactcgggtgggcagctcctcgctccggtgtaaacccctccatcagaagcaggccggcttggggccggagcccctgtgcaccctgctggaccactctggcgacggaggtccggggggttcatgtttcacagaacagtgaacttccatcttgggaggacctcccattcctactcttgctcctgaggcagtgaactgacagaagccacatccacacagtgcaggtccgggggccagatgcatctgtagtctcaggactgcaggttggggcctcgggacaggtgcacagaggcaggaggctgagatgggaggatcaattgaggccaggaagttgaggctgcagtgagctatgattgccccacccagctatgattgagcctggatgacagagcgagacctcatctaaatgaatgaatgagtaactaactggtgcatggtgagggccctttgcagctgggctgctgggccagctgctgctttctctacacaggcagcctggggaacctcgaaggcaccttagccagccagttgcattctgggcatggaggacctgtcctccctcaaggcctgtgctgtccaggcaccttttcaaatgcctccctactgtcaccagctccggggagatgaatctgccactcctaacaagtaacttagatgatgtcttcttttgaaagtctacttttctgattacaaacgtaatgtaaaatgtaatgccctcaaggactggcgcacacactcagggtacaaatacagtcactcctctttcagtgtccaaattcaccgctccagcccccactctctttgttagggggatatctgatctccctcttgagccctgcccccaattgtccaagaacccctggggtacaggtgtggcctcccagggagctgccaccctgctcagcttcctctgccgccctgctcagcttcctctgctgtggctcctgggccacacggtgtccctggggaaggcgggcccctgctacgttgggctggctggccctggatggaccactacccaagctcagtgacattgcaggtgtgaccacttggggctcagcacccttgggctatggacagagctagagcctggagcaccagatcccaagtcaggaccaggtgtccctggcgtttcttccctagtggttaccgaggcccgaggcggcgtctccatgacaccctcattccctgctgaaggaattctcgtgggtgaagcattatgtaaatcatcagaccggatttaaatacaagacatgagtaaggtgtggcgaaagcattggaactgtagacattgctattctcattccgaacaggcactgagtacaaggttgctcaatgaaaaatagcagactcatggaccatcatccttgtctaggtggggaaactgaggcctaaagaggtcagggttagggctggacggcaggggctgcggaccgcttctgagctgcaaaccagcacgagagttccgaccgcggtgcccggccacgctgccttgccccagcatcacttgacttcctccttctactttccttccttctgcaggccagtctgtagttggctgatgtctgagaatatcacgacttttctgattcttagcagaaaagatgtggttttctaggaagcttctggtgcagcgagccctggttggggtggggctgagggcagttaaagcccaacgtgcccctgcctagccgttcaggaaatggcccggctgaggtgtcaggcagctgccagtctgcagagctggcttcagaggaagctgccccttttctatttttttttttttttttttgagacagtctcactctgttgcccagcctggagtgcaatggctcagtctctgcacactacaacctctgccttccgggttcaagcgattcttctgtctaagcctctcgagtagctggaactacaggcatgagccaacacgcctggctaatttttgtatttttagtagagatggggtttcaccatgttggccaggcttgtctctaactcctgaactcaaggggtctgcctgtctcagccgcccaaagtgttgggattaccggtgtgagccactgtgcctggccttctttacttttttttttttttttttgaaacagggtcttgctttatctccctggctggagtgcagtggagcaaacacagctcactgcagcctcgacttccctggctccagcggtcctcccacctcagcctcctgagtagctgagaccacaggcatgcaccaccacacctggctaatttttgtattttttgtagagacgggttttaccatgttgcccagggtgatctccaacccctgggctcaagcaatcttcctgcttcagcctcccaaagtgctgggattatagatgtgagccactgcacccacctgccccttgtcttggtggtcttgtgtcaaatcaggtgagacatgtccaggatacccgtctgctggagacgagggtgctgaggggattgagcaaggctgtggggccgagcctggcagggtcgagggtgtccaagtcaagggacaccaggcccttcatggagtggtgcaacgccacagccccgctgaccccagctgagtgctgcagcagtgggagctggcctcctcttcctcttctggctctgagtctactgtgtttccttcgttgcttctagaaataaaggcaccactgtggagggagagggaacagagattaaatgtgggcccagcctctcctgtcctttccagtcctgcctctgctggtgcctgttcccgaggcccaggtgtggcctcctccggggtcctgtgcgcgttcccgaggcccaggtgtggcctcctccagggtcctgtgcgtgtctccaaggcccaggcgcggcctgctccagtgtcctttccagccagcgctgcccacaggagtgactgtctgctcagatcccggctttaccggaggagaagctgctgtgggttttgttgcagggggcgggaactctggattagctgtaggaagtaattcctccctaagacaggcccactcggtaggggagcttctgaaggcactggtgtaaagggaagtcagccagaaacagtgattaatagatcattagcatcttaaggggaaattataaaggtgttagggcttaagagccccctgagaaaagtgcctcgcgtgtggcattcagaactctctaagcctctcccctgctccctgcagtcccccctcgaggctgcctgattgccccgttcccagctcagcttctaatctttaaaaaggtatttaaggtttatattaaccatgactatactaatatcaaccatttctctccgtttgtgtgaagcactctcaacgccctgcgagcgccgacggttggatggagggagggtcgcccggattcacccccagctgccatccccgtgggccagcactgcctctttctctccctcttcttccaccttatcttcctgtccactttccccctttccctcccccataattgaccccaatgtggaattgagggtcatttcaaaatatttctgatactatttgaagaaaataaactttatctgtttaatgaaaaataccaggtctcaccaatttgctttctcctgtaatgattggggtggtggggggagctgtgtagccccgaagggcactctgccctggctgtggcagtggcaggaggtcacactttatgggattcggtctgtctccccaccgctcctgtacggtgatgtcttccagagatgtgaagacggctgtgcacggtgtggtgtggctttgttttcctcgcagcgcccagggcagggctgagctggaggtaaccggggttcaagttgaatttaaacaaatagcctcaaataaacattggcagtctggcagggacctcgtctcgggggtccccgcaagctggctgggccgggccctttcgcgtctggagtgctcactctgttctgcttccgctgttgtggatgatccaagaactgaatattctcagtggcttcttagtcctaagtgaatttgtcacaggacattaatgcctaaagccagagaacctgccaggaggagagggcaggggacccgaggggctaggtcctacctcacagttctccagcccaggagctgtggcctgaggaccctggaggacccgcatacacgccctcctgtgccccgctaaggctgcacccagacaggaggccagaggcacagctgggacagcctagagactaccccagcctccacaccccatcggaggggaattcacactgggaagggggcaagttctgatcccctggaggcagaggagccagcgatgggtccaccttgcctttgttgttgttgttgtttttgtttcttgttttggtgactgagtgaagggacttgaccctggttctcccagcttgagcaggagcgtcactgcggtgatcagggaagctgcctggaccagctggcctggggcagccaccaccccattctctcgcccctcttgagaatccagcctgtggacccaggtgtgtcagcctgcagtcagaccacagtctgtctcgggctggtgctgggggtggcagaaagggggtcctgacgcagcccctgctcccccgagtctctcagtctcctggggaagagatgacagacaaaacataaaagagaaatcatgctataggggaaggaatgctccaaagacacggccgaagacaaaactcaggatatgggaagcggtcatgaatattcattgtaatcacatctcactggtttaaaaccaaaaaatgtcggggtgagttagactcaggatgtgcactgggtcctgggtcctgcaagtcccacaaattagatacattcacagggagctcagacacgctggtccatggagcaatcaatgcccgtggattggcctcgtcacagtccccatctccgatgcctccctgagctgcaccccactcttgaatacggaaaggctgccctttgtgggacagatgcactttcatcacggtgagcagccagcaatctgccatcacagtgggcccttcctcctggcatcaccaggctgcccacgagagcccccgggatgtccgatccagaccaatggaagcccagggtggggccaggatgctgggtgactgtcctgcaacaggacctgggtcagtctccttgtgtgtctgtccatacagcaacctctccttatctggcaagtgatgacaatttaaaaccacaacgagagtggttcctaaaggcgagcttacgcctttaggaaggctcccaggcttaggccagggaggatgctgttagatgcctcggaagggtaagcaggcagacaagagcaatttctgaaaactttctaagggtgtcgagtgtggtggttaatgcctgtaatcccagcactttgtggggccgaggtgggaggatcacttgagccaaggagttcgagaccagcctgggcaacatagggagacccgtctctacaaaaaattaaaaataataaaaataataaaaaataaaaatattacctggaggatcacttgagcccaggaggtcaaggctgcagtgagccaagatcgtgtgtgtcatggcactccagcctggaaaacagcaagaccctgaccctaaaaacaaatgaacataaaacctttctaagggcaccctgttatgagttgaattgtgtgtctcctaaaagatgtgtccaaatcctaaccctctgtacctgtgaatgtgacctcttttggaaacagggtcgtttccgatgtgatgagttttgatgaggccacattggagcaggctggcccttttccacatggctggcatctgcgtatgagggggattctggacacagatatgcccggagagacctctggtgaggatgaaggtggagatcaaggtgatgcttctacaagccaggaaaccccaaagatggccggcagccacccgtagctggcagaaaggcctggacagattctccctctcagcctcagagagacccagccctgccgacaccttgatctcggacttccgggctccggaactgggagatggtgcgtttctgttgttcaaagccccccaggagactcacccacagcgatggggaggggcggcactgcgccgtagccctccacactccctccactccgttcctggggtgggggcttaaacctctctgcacctcatcagatgctttccagggtcccttccgaccccagatggtccacattccagcaagtaggggtagtgctgggtgttcctcctcccactatgtggagatgggatgttcagcccggaagactctcacctgagggtgcgctgtgcggtgcaaacagggacacccgtgcctttatttaaacagaaacccacatcaaacaacgtgatgtactgattggttgacaaaaacgtggccagaggctcccaggaagctaaccctgcacctcccctgaaaacaatggctcagcatttgctaactcagtgtgcctggcgactttgtggagcaaaaccaccttgagtaacgggaatcacctgtacctggttacaggacttaatttaccaaaaattgtggctcaggtcatcttgggtgtactttctcattcccttagaagtgggagtcagtttaagacaaatcatgatcaccaaattctgtgacttgagttgacaccttgtttgaatttgtccttaagttttcagggtcagccctgttgggggctgctgggcagaaaccttgttctttccaaggtgcatttaactgctgtcggggaatgatccacctgctgccattttctattttttttttcctccagaaactggcagtaaggtgagtatttagcaaaggtaactttttaagtagattcactattctgttatccctgcctggcccccgccatgggccgggccttctcctagaggaaggagagatggacggtgaggtggaaatgctggctgtggcctcaggctcccagcgggggcagtgtgcttgtgtgccagtgcactgggcaccccacagaacacaccccctcccgccatctgggggaggcacagcggggaggctgtgaacctttcctcattaaggacttattttttatgccagttggattctgggcttgcctcgtgccaacctcccctttgcccctttctgaatgtgttaatcacaggggaagtgttatttctccaaactatcccccacccctggaacaactgaaaagcccgctggagttagaaggatcttggctggtgctggggctggggaccagatgggtttctggagcgtccatcggcttaagagccgagacagacactcctgccgccccgctctggctctcctctctatagcagagcgcaggtgagggcggcacccacagggctgtctctcacccgcaccatccctgcagacttccccagggccctccctgccgcttccaccctctcctttccagggcctcctccgctcagcagctggaacagcctttgaacatcattcgtcacaccctgtcctgctcagggatgagcagggatgagaacccttcccgctgcacactcccgagccctgcctcagggcctttgcactggctaccctcctgcccggggtgctctgtcccagcttccaatggtcagttccctttctcaggtccaccccacagatctccacgaggccttccgtgaccatctaatcaaaagactcacgcgctctctgttgcactgatcacacctgattctcttacagttcttaccggaatgaaattagctttttattttgacatgcgcctctccactggaaagccagcttcgtgatggacgctgtctgtctttctgttcctgaatcttccagggctggtgcaccataaacgagtgagtgccagcaacctcagacacctgatctgcccacctcctccaagatgtcccccacttttcaggggacagtgtgggtgtcctgggaggaacaccaggctagtccggagcgggtcctgcaacgtggggtcagggcacggggcctccctggaaatggccaccgtcctaactgctcgcctgggataggggtctctgggaggctgcccatttattacctagagaagagggagggaaggtctgaggatgggcctcagaggtgggctctgagcttttgtcgcctcagtcccaggtagcacctggagagtacccgagagcggcccctcaggagtggacatggatcctgcgttcctttgcaggcacggggggctcacgctgtggaagggacccagggtgggctgtgctgggaccccccccccagagatgcctcagtgcccagcagaccagccccaggggaaggggggagaacccctaggctccttcctctgagggggtgttcagccgccctgaccctcctccctttctcgtggacctaacctctgacagcctcccacgcctcccacagtgggcaggtgtctatggagggtctgctggctgcctgggaaggcactgtgaacactgcccagaagtcggagcttctgcttcgcccccaacaagcaggtctccttggtgtgaactggtgtccacaaactctgtggggcaaagactcagatttattccctccctcctcccttccttccctcctcccttccttccctcctcccttccttccctcctcctctccttccctcctcccctcctcttcctccctctaatcagtcactagtgtccaccctattgggttggggggaaattcaatttcaagcattctgggagggaccttcctccccttcccccaggcctcagaagagtctgggttccaggcatctggtggcccctgtacccttctagtccagactcctgagattcctccatcttggagatttcgtgcagcagccaggcctgagtttgagattctttgccgagtggaggccccagtgtgtgagtttgttctggtggatgcagcagccaccccgctctgagatctggcccctctctcccgtctcggttctggggaagtgtcctctgctccccactctgtcacctccctagcggcctctgatcctgccaggatgccccagcctcggtgcaggcaggccagggacacagcacctgaccgggacacagctcctgcctgggacacagcacctgtcgggcacacagaactccctccagggggcgaggccaggacccgagaccagcttggaggaggaggcagggcgtgcaagggggggaacatacaaatgaatatcagaacacgttttcctgccacatcagtgaaacaagggcacgtgtttgcctaaacctgctgtaaggattggcccagaactccgctgaccatagccattaactcactaaggtgtgatgaccagaaaccactttaatgggccacctcttgggagaattaagtgagggaaactccttcacctaaaagaagtcttttatgacttctttcacgtaacgaaatatttttaaggttcgtccatgttgtaccatgcgtcagtccttcctttttatgggctggataatattccattgtatgaatataccatgttttgctcattcatcaaaggaaatttgggttgtttccaccttttggctattatgaataatgttgctataaacatttgtgtacaaatttctgtatggaaatatgtttttatttctcttgagaatatacctaggagtggagttgctgggtcatattgtgactttatatttaacttctgaggcactgccaggcagttttccaagctggcagcacccttttacattcccaccagcaattcccagcaatatgaggattgcaatttatttgtatccttgtcaacacttgtaattgtctctcttatgttctagctgtcctagtgggtgtgaagtggtgtctcattgtggttttgattttcatttccctgataactaatgttgagcttatcttcatatacttattggtcattcgtgaatctttcttgggagaattaagtgagggaaactccttcacctaaaagaaaggatttttagtgacattggatgactcgaagtcactccaggtgagagagcacaacatgtgtagaataaatagtgaaagaagggaccacgctcctccctctcatcacaacccccccccgccccgcccccatcctaagaagcataaaagagggaagtttggccagagggagttttccagagcagcctcagctgtccaccatcccgcaggaggcctcaggccaggctctggttcctcttccccccgcccccggggctctttgctgcccctcatgagtcccatcgcgggagggccggggaggcacagatggatttctggaagcttctctgagagatcttctcaggtcacactgtaggggcctttcagggctcagagtttccgtcccccagtccttccagctccgtgtgttacctcaaaggagagtgagatgctgacggatgccaggtgcagcctgctcagaccccgggcttggcttatttctctcctcggcctctctcttctctgcctgctccctgcatctcagggcgccctggagaggaaagaggtgcaccctgggccacttggcctttccgtggcccacacagcacagtgcaggtggcgggacttggctctggcccgtgcaggtggcgggaagggtggctcccggtcagcctgcggacagataggttcctctcggcctgggccaggcacagagtttcaagcctgagaatggcgaatggcaaaccgctgaacttctatcagcgaccccaggtgtcccctcgtgagcatggtaaaaaaaaaaaaaaaaaaccaggtggaacagtcctcgacattggaacagaagccattccatcccatttctccatctagaatgaaatcctcaataaccttggattctataacgcagaaagtgtggttctgtccaggcccctccccagctgacatcactaatgaccaatggaggcaggctcattgtcagatggcctcaggggggtgtctgcgcctcggtctcctcaggaactctggcagctgcgcaggctgtacacggggccaccgtccccctccaggactctcctgcctggcttccccccgtcaaccccgtcctcttatgccctcccccgctgcagggtccccggaaggaattgtatgatatttggtcttttatgacttctttcacgtaacgaaatgtttttaagtttcatccatgttgtaccatgtatcagtccttcctttctatgggctggataatattccattgtatgaatataccgtgttctgtttattcattcatcagttaaaggaaatttgggttgtttccgccttttggctattatcaataatgctgctacaaacatttgtgtacaaatttctgtatggaaatacgtttttatttctcttgagaatatacctaggagtggagttgctgggtcatattgtgactttacatttaacttttgaggcactgccaggcagttttccaaactggcagcaccgttttacattcccaccagcaattcccagcaatatgaggattgcaatttctttgtatccttgtcaacacttgtaattgtctctcttatgttctagctgtcccagtgggtgtgaagtggtgtctcattgtggttttgattttcatttccctgataactaatgttgagcttatgttcatatacttattgatcattcgtgaatctttcttggagaaatgactttcagatccttttcctgtgtttaaattgggttgtctttttactattgagttgaacagttctttatgtattgtgaatacaagtccctatcagatatatgattcattctttgggttgtctttccatcttcttgatggtgtgctttgaagcacagaagttttcattttgatgaggtccagttgcttttgttttttcttttgttacctatgctttcggtatcccatttaagaagccttctaacacattgagaacacgtcaaataaacacaagtataagcagttattttttattgttctgttttgctttttagagacaggttctctctttattgcccaggctggagtacattggtgtgatcatagctcactgcagcctcaaactcctgagcttaagtgatccttccacctcagcctcctcagtagccaccatgccccactgacttttaaagttttttttttttttgtaaagacagggtctcgctgtgttgtccagtctggtctcaaactcccgagctcaagcagtcctcccattttggcctcccaaagtgctgagagttacaggtgtgagccaccatgccaggcccaagtattggcagttttatattgatatcgtggtgagtgaaaggcccttaaaaggagggaagaagagatgagacaaagccacggtcagtttgtaggcttctaagactatgaaaatttcttcctttctctcctaagtttgctttgctagcctttatagcagtgtcacctctgtgagatggcttttagggtcattctttttcttcatgcattaaactgttcattctctctttaaacaaatatttactgagcatgcactgtctatcaggaactgtgcagagatgaatacaacatagacctgaatccggggagagtcctgccgtcaccccttgttgggctaggatttgatatccattacaggactctctgaaaacccccagaatgccactgtgaccagggacctatctccaggctctgtgggaaggagaggtagctcttcctcacaaaagcgtggagacccctggacaaagagttgcactcattccagggccagcctggggtcggggctcccctgggtagcaggcgtttgctgtgtgcttgctgggtgaatgggtggcccagtgcacctggatccacttgggattcctcctttgttccaaggtgagatcacaccccaggctcatgttgacctgaataatcaccctgggagtttttctggactggatgggaagggagaggaagcgacatgatggggagcccatggcatctgctgcgaagctggaacccagggaagcgcccacatccactattacaatatcaggaacaacagcaccaagacggaggccacgtggtcctcctggggctgcccttggaggcacgtaggctctggcattggaagtcataccacgacaggctacagcaaggcagtttttttttttttttttttttttttttttacctaaggccacctcaagaaattcctactggaatatgtgtttggaaaagctgtgcctctacccaggaccttttcctggtaaaaagcatatttctctttatgtaaaatgagcgtcctggaacccactgtgttcctttctctaggtctacctacctattttggctgcatgttagaatcacctgagggacatttaataaaccccagttccggctgggtgcagtggctcacacctgtaatcccagcactttgggaggccaaggtgggcggatcccttgaggtcaggagttcgagaccagcctggccaacatggtgaaaccctgtctctactaaaaatacaaacattagctgggtgtggtggcaggcacctgtaatcctggctactccagaggctgaagtaggagaatcacttgaacctgggaggcagaggttgcagtgagctgagattgcgccactgcactccagcctaggcaacagagtgagaccctgtctcaaaaataaatgaatgaataaataaatgaaaataaataaaaatcccagttcccactggaccccagatggattaaatgagaaactctgagaccaggcattggggtttttgtggttgttgttttgaactccagagatgatttctgtgtccatccaaggttgagagccagtggtctgcaggaagtctggacccaaatatatgacttatctgtagtgttccatcctacacagctgtgttctctggttccagccttccatgttaaattttctccaaacctgattttcactggcttgtagaaaggtggccttttttttctcaatacagcctttcctgaccacagtctctgccgtgatgtatgtgtgcaatacagaaacacattctgttgggtgaataaacaagtgaatagagcaattaggaagcaggagagaaaatggaattgcaatggtgttttatttaactcaaaagtggtattttgtgaaaaacaagtttgatcagtggaaggaaaaaaataaatggagaatgttggaagagggctccgtgtatttgaggatgtatcacgtctagtatttgtttaatgtccctttagaacatttattttcacttacagtcattactttttcttgatagcatacaaatccctagctcttttctttttcaatgattagggtacattttcacctcataaaggaaagagagaggaagggaaggtgagagggaatttcctccttatgaagagctggaaatggaaagaggaaatgggtgaaattaatggaactgagccaggcgcggtggctcacatctgtaatcccagcactttgggaggccaaggcaagtggatcacctaagatcaggagttcgagaccagcctgtccaacaaggtgaaaccctgtctctactaaaaatacaaaaaaattagccaggcgtggtggtcggtgcctgtaatcccagctactcgggaggctgaggtgggagaatcacttgaacctaggaggtggaagttgcagtgagccgaggtcacgccactgcactccagcctaggcgacagagcaagactctgtcaaaaaaaaacaacaacaaaaaaaaaagtggaactggaagtcaggagagatggagaaagagagaatggatgggtgggggtgtttagggcagggcggtggtgggtgcacagctttgcataccaactggggaaaaggtactctacctgttagggtgacagctgctccagttctctgggatggaggggcttcttcaaatgtgggacttcctgttttaaacccacacagtcctgggtaaaccgagactaattggtcaccctggatgctggccaaggacctactggcggcttgcttgctgatttttgtttggaggcaattggggccaggaaagggagtgaagaagccttaggctgggatgggaagcttgacctagctctgagccacacagctttatgctctggtgtctgtaatgctgggcatcccttcgctcgatgcatttgtgctcaggaaaggacttgctgaacaaatgtccagctcaggggatgggacgtgaaaggagatgtgggcctgaggagcgtcccagagacaaacagggcaggaagttctctgttttaacatgaaaggggaaaaaacaggcttcaaatgtattcttcccactgtgctgggagttccctggagggcggagacttgtgcttcatctggtacccctgtcacctagggtgccaggtgcatggggagcggccagtgcatgttaaatctgggccagaggaagcatgcgttgggtgtctggctctatgtcagggttgggagcatttattatacaaaaagactcccatcctcacatcattttaaggtatcattgagggtacgaatcatatactcaaagtcttcataatcagagaataatataaagtgaatttaatgaagaaaaacaaagaatcgtgtcctatttgggtttaggactacattctcaaaggccctttaattcgaatttgattcaaatagcaatgccagggcaaagaagccaacaaatgaccttctgttttttttggagacagagtctggctctgtcactcaggctggagtacaatggcacgatctcagctcactgcaacctctacctcctgggttcaagccattctcctgcctcagcctcctgagtagctgagattacacgcgcctgccaccacacccagctaatttttttgtatttttagtagagacggggtttcaccatgttggccaggctggtctcgaactcctgacctcgtgatccgcccgcctcagtctcccgaagtgctagggctgcaggcatgagccaccgtgccccgcctagatgaccttcttaagcgctataagttacactgagtttatttaggattagggaatagactcagaagaaagagagggaagggggcaggagaaagcgcacgagtgtcggctgagttccgctggggtagtaagtggccccacgtcctcagcagcaagccaggacagaagtgcatttctcgctactgctgtacatgcatcaccgacagctggggctctgctttgtgtcctgttaattttgggaaccgcaggctgaaggagcagttcctgtctgggtgcttgctgtgagaggagcaggagagaggtgtcagacagctccaaaagcttccactgggaagtggcacccatcacttctgggaaatgcaaggcacacagccaagtgtggtgggggtagtggggataataaccctcctagagggaggggctccacacagaggctactaggatctcattacaatctcatcacgatttaaagtatcagtcgataccattcaccgcggcttaggagttccggcaactatctgcactaccttccacaaaccttgatgttaacacaagcagcataatccaatcacttctgtatcttcttagaatgtggaagtcaggaaccaggcaggatgacaggaagtggggaaaagccgaggggagcaaaacacaagctgaactgggatctttgacctgaaccaattacgaagcttccagctaagaagctttccaagtcatagaatattatgaatattctgaaccaagggcgatttacggcatgcccttgagtccctgaagtccaaggaattgcctctcagtttactttaaatcaaaagctgattccttcttaaagggaaagctcagatttccgacttcacagttcccttctcagaggttccttgggttctgcctccataagttataccaagaataactgggggcctcccacacaccattttctctctatgcctgtttccccgtctttacagtgaggtgggtgggtgctatcagtggttcttacttagcagaatatttcaatcacccagttctcagccccagcaattttgattcagtagttcttaattgggatctagtttttgaaaactccccagaggttctaattttctctccaggtagacgaatgatttagccaggggtggactttacctcctttccagcccccatccaccaggaatgactctgggccccacatccctgggcccagccctggtaaaggatcataggatcaggctgtggaagtttccagaaacagatggagggtgtcatctcttcccacgtctctccctagcctctgatgtggagtttgacattttaatcagagatgaggcccccagatggcccagtaggccaggactggttaggcagagggtgagtgaggttccatctccttgggatctactctcttgtccctggactgacttaggagaggggtctgcacccaccacggtgcctggcccatgtgaccactcacaaatggggccaaattcaacagcccctatttccaaataaggtcacattctgaggttctgggagtgaagactccaatgtcttttttgcgggtgcaagcactttaacccataacagcagagtataatgcattctgagatatttcttttaaaatcattaaaacatttaagaagtttcagcttaagttttagtgtttattcaatttttggaaaaaaaaatgttgatacaaaatccctgtagccaacaaaactggatacacatttttcctgttcttcctgagcttcatagagagtgtccccaggcggctgtgctgagaggggccacgcctggcagagtccggctgtggcctggcccctgctgctgtgacaagccaggggtcagggagcaggttctgcagttgagcttgcgttttccgctgtggggtggggtggggtggggtctgaaaaccaggtcgctgggaggaattctaggagccctagattttcaagtgatagagccgggcttggcggccactcagcttccccaggctgattagtcgctggaggttgttttcttgtttgtttcatttttgaatcagggctgaacattctgtgttgtggattcattgggcaaccttttgtggggagggagggagtgtgacgtggaggtgtggaggcaggtccctgtcacctgacccagggtgcaggtggcgtccacatgggtctgcacccctgaccctggctccacacagccaaggccattgcactaagcgtgtctgtcagagcttgggaagacgctgtccacctgccaccactggaagcagcaccatctcacaggccagctgccccaggtgcccaagcctgggcagcggggccggctcaccgttcctctcagccttcccctcgcctcctggcccttggcttttcacagtctcagctgtgcagcccagccccaagggagcccctggacctgggccgccgcgtgctctgagacatgtcccaagactggctcagagggtcttcagggccgcatctgccttttgctcctttttactcccacagcgccttcacccaggcagcgctgggtacatcgtggtcagttgattaaaggaggccttggggacagtaaagtcaccccccgcccttgaccctggcctgctgacagtaaagtcaccccccgcccttgaccctggcctgctgccctcctgaacccacctcgttcctgggctcgaggcctcctagggcggtggcagttgtgctctggccccagccctggccagaacatcatcccacccagaggaggctgcaggtgtctgtttctggaacattctattatttactttctgccatttcctaccttgccttaaggttcagagtctctgtatctgtccccagtggcagttgtcatggggtgaggtctttaaatgggcttctctgacacctgagtcacgcggcactggaacgcactggggtgcctcccagatccttggctcccagcagctctcaggccctgttcgcctccgtaaaactcagcctacagatgtgcatatgtgcgcgtgtgtgtatgtgtgtgcatgtacatacatacatacggatttaatcctcacagtaaccctgtggggtgggcataattattattaactccactttacaaatgaggaaactgaggcatagagaggctaaatgacttagccaacgtcccagcactggcaaagcaaagctggaatttgaacctgtagaaaaagagcatccgtttcaaagggtgagtagaggcatttttctccttcatggtgtgctcaggacgaggaatccaatgtgtcttagagaggacttgcttaggggcattgttatagagggcaatttgtagaaaaaaaatggttttgtgcagtgtggtttatgttgatttcaattaaattggggagccttgtgcatgctaaacgacagcttggccttctaccacctgggcagcccggggccttctgctcagcagtgccattgaggctgttttaggtcacagacattcagccccggagcacctgcctgagactagccaggcttgtgctacagcctgttggccttctgtgtgtgccaagcctgggcccaatcctggttcccagcttaaaagaaagatcgagttgccatgagccttccacagccttctagagccttccagagccttgacagtgtgtctagggaacaaaggaggaggatgctctggggccttacaaaatgcaaggacccttcagtgcctctgatttttacctgatcttgcttatcttagcttcagtcttactcctttcatgaagttattttttaagactttcttccaaagtagccccttccttctggaaacttctatgatggtggctgctgtctgtgccacacacgatgttgtgtggactctcagcctgcttgttccctgtctccacagctttccttctggccgggactgaggtccgtggggttggaggctctctcttctacttttcttgggtcccagcaatgcagcatgaggcaggtacctggctggggggggtcctaagaatatccattgactgggagacggggtgccgagagagagagcgggagtggtgatgggccactgagagctgctagggcagggtgggcctcagggttaggagagaagcccggcttattgttgtttaaaaaatggaagaggaaagaaaatggggcttcccaagtgccaagttccttctgttgaaggtggcgctcatctccagacagtggctcctgcttatcaggtctgaggagctcttgccttgactggacattgaccctgtgggagacgtgaagttggagaccacggagcggtgttcagagtagagtgtgccctgcagtagccagaggggccaggccacggagcggtgttccgagtagagtgtgccctgcagaagccacaggggccaggccacggagcggtgttccgagtagagtgtgccctgcagaagccacaggggccaggccacggagcggtgttccgagtagagtgtgccctgcagaagccacaggggccaggccacggagcggtgttccgagtagagtgtgccctgcagaagccacaggggccgggccccaagcatcaaaatgacggaagtcaaaggagcccacggcagtgggtgtggaggagtaatcgtgatgggggtaggagcgaggtcagagaagttcttggaaggagtgaagctctgacagatgcttaagcctgtccctcttgaatttatgctaagcccatcagctccttttggcatgcaccattttttagaaaaaggttccagctgccggcgtgaatagcgagtccttcctcctctcacttctgctccctgcacacatcgagcttgttcagactggagttagacaagtcactgtggggtcacgggacaaagtctcagccggttttccagtggataggcatatctcttccttatcaggtgctggcataaaatcaggaacacctggtcttagccttggccctctaaggacacagccatgtgaccttgggcacgtcacttaaactgattgatcacatatgacttagcgtttatagacctgctggcttatttggtagaggtgggtccctgattgggcaggtgacatgctccaaacacaagtcagccaccgcaggagctgcatgcacactcagtacacacggcacttctttggacagagggctctggggccccatcccacatttgaggctcaggggaccggttttcacccgtaaggctccaggcagtagcccaagtatctcaagaccttcaggtggtcagaacatggccttgaaagatagagaaactgttatcctttgcgggggttggtttgtttttgtttagactccattaaaatcaggacacaaggtcttaatgactccaaatgtctttgcaatcctgcagttttagaactattagttctacctggatggaggtacccagggaggggcaggggggcgaactattctcagctaatctaatctcagcacagccactcagcaaacatctggttactttggtaaatattggcagtctctagcgactggaggtgggtgaggctgcgtgtccccctgacagccttgggactggtggcctatgacaacaaaaggaaatcctagagcagggtttgccaaatccctataggcgattttaggcggcaggtccaacctgttcttgtagctcagaggaagtctcagcgctgccctctggcagatgcactccgagcaggacccagaggtgttaggaccggcaggactggtctagctaacagcagatgcagcagctgggtcctcggaggtggaggatgaagaccaatagcgtccaggtcaccggggctgggtgggctgcgggccggccagattctctgtctctttatccaagggggctgcagcctgtgccatcctcctgactcactctgcacaccactcatttcgccagggagctgattgacaagccctctgctgtgaatttcaacaaggatgttcacggcgcagagcagccctctttggcacattggttcccaattgggatatttcagaagcaaccacaggacctggcatattgcacagagttcatgagtacagggcactggcctcaagctgtcataggaatgaggttccaaagtaaaatgccacaccgtctacatcccaccaggcccagtcaatctcaaatgctggccccagccagtggcatgccgtgccccgaatccccagctgccagctcccaagtgaaataaaagtgtggtcaatgaggctgggccttgagcccagggggttccctcttctttcagctgccctggcctctggctttcccctgcacagatcttgcaggacagtgagggcagggacagcattggcacataaaaggggggtagaatatgggctttattggtcagcgtctctgcccagggcagttgccatcagcccttttgcagatactccctctgcaagctgccctgccggcctggtgccgagattggctctggacacagggttctggggtgcagtggtgtagtcctgcatagcaatgcctcatcgcagggacgtgagcttggcatgcagcatttgacttttaggtgaagggctgagggcggcatgggatttggcaaagatttgtgctagatttctgggatgctgagaaatctaacccaggtctgttattcaggggttggggggtgggggctggagacacgccttttacacatgtgtgctcatgcatgtctagttttctaggccacttacacagctcaggcagtaccatgcatcatttgagattttcctgtcacatttgccatttgtcattctttgaagtcactgttttgacttgttatgtaatatcataaggccccaatgtctggctctatcagaacatacttgacaatatcccatttctgcacactcaggtggtacctgatcctttccgtattgctgcagactttgtttatttcagatgttataggctggacctgtaaagggggactctcaacttgtggtgtgtgagtatcttcctcttattcttaattatgcaagtaataaacaagcatgagccacagaaaaactagatgataaaaataaacaaaaatgaataaagggacagtggccctgttaggatgtgctgtacggagccaggctggggaggggaacatcactttgatcgaatcctggatttgcagcttgtgtgttctgtaacctttgtgactccacttctctgggcctcaatttccttatcgataaaatggacagtattttgtgcaggttgagagaggatatgtaaaatactcagcacttaaaatagactcaaaacatgagttccaggagagggccctggtgataacctacaggtgccagggaggggctttaggggcagggctaggctttctagggatgccaagctctagggtcaggagggtgcctgcatgcggggcccaagggtcatgaggcctgacagccttgggaagcctgggggtgtggaaggatgaccgtgggccaggctcctgtgggcctggcagcccatgctgaagaagtggggtttgttctgtagatggcatggagctagtgaaggttttctggttctgttttgttattgctttgtctggtgagggtgctaagagtaatgcctgaaaaacagagtttaggaggatgaattagagcgggtgagtccgaggggatgtgcttcaggaaggcattgccttttcacttctgattctgacaccagccccatgcaccaaaatggtcttcaggctttgctaagtatctgtgatctactaggctctgttgttcaagacagctgactccgccctccagggagagtaggtggaaagctcagagccacctgcatgcggagtgcagtggaggttctggaagcgaggagaaatgcaggtgaagacagtgaccgtgcttgcggtgggcagcttgcaagcaggagtggagttgtttatgttccttaatctctaatgagtgatcctgggtccctgagacgtggaattgctgccgtgagaactacagcatcatcacaccccataagtcactctcaaacgctggtctccaagcgtagcaaacctctgaatcctttagacgacggagcccatttctctgacatttccagcttttccaaggaaaaccaattaggcttttttcctcaggctcgtatgtatgctttggaataaagcacacagaaaataaaacaggcccagctcacccagcaaggctagttccagaaccagcaggagaaaatattgagattggccggatctctggtcgaccacttgcatcggtgcccggggggctggctgcaggctgcaggaggtttggcccttcgatcttcgccaaatggcgccagctttctgctaaacctcaggtttatgctagcactgccctctggttccagaataatcccgcacatcccaggatgatgcttatttctgtcctgatgcgtgttcatccatgatcccaacagcagccctgggaggtgtgcagagcaagtgtttccactcagcttggtttttcaaaggaagaactgaggttcagagaaatgactgatccaggacttggacctgggttgttgacacagaatattaatgctctggtctgaaagggaccttgaggaacatcccataacacatggctcattctacggacaaaaaaaaaacaaaaaacagtttccgcttaaaatggcctgctcaggtaggcaagtgcagagctcaggcttgtgagttcttagagctatctggccacagcacgccaggcctgtgatttgtcaggtctctgagtggacagctggattgcctggtaccctcctgggctgaaagtgactttaagaaagccacggacttccaacccctacagaggccccccaaagtcccagctgactcagccgcctttttgtccgtgggccttagtagatggccatgcaacgcccttctgtcccctctaggaagccttcctgaatacgtcatccacattaatctttttccaccttgtgttgccatcaaccttacctgaataacacatttgcccactaaatcatagcctttgagtcacaggctcgtggaagaagcctccttttcttgaatacctgcagcaacagatcactcaatatctttggaagcaattcctccactgctgagaagttcaagtcctgagcaagttttatttaatgagggacacggcggggttctgaaatggggaccctcattttctcctaacaattcaagttcattttctgccccacagcctgttttcagggcacctgggatttgttgtaatcaggtacaggaagacatgcagactcaggaatgagtgtcacgaaggaaggaactgatgatactcacagatccctggaagcaggaggctaggcacaccactgccacgtggggaagcacggggttgggcaggaggcagagggagcaagggggagatgcaggcaagagactttattgtggtttctgtgaataattttaggggactgtgggtacaggggctgtccctagctgtctggtacctgccctggggtgatttgggtagtgggtgatggcctggggtgtgagagcccccaggaggaggtgaggaggggaagggtctgtgtgggttggcttgcataggaaaagcaagctcacagatgagttgcttactatctccaggaattgcccagccctgggagggcagtccctccaggatcagcaaggccccaggtgtcaaagcatcagaatacagaaaatcagagacatggctgatataggcagagaccatgttgtctcctggatgatgtttgcaggctgtctggttggagttgggggaatggagtgtaaatggggatttcactgccagagccttttggaaagccatacccatccttctggccagaggggaaaaaaacccccacaatctttgtgctccaaggacaggaatccccagggagttcagatttctgaagcctttgcctgaagttagatgggaacagtgcaggggttgtgctggccagaggacctggagcccagagctgtccactgctgcatcatcggcctctgctcctgcctccctccatcctgctgcctgtctttttaaaagctccggtccagccctccctcctgctggcttgctgtgtggtaaggagtttcctccccagcagcgcctgacacaggtgggaatgacagtttgctgcagtcccgtcaatgggggaatctgcccgagctctgcctgcattttgagcagcaaagcagctccagccaccaagaccgttgcctgcgctgtcttaggccagcccatgctgtctgccagccgcttgttgcgctgccttggggactgggaacacacccagccccggtccccatctgttgcagacatgcagtggcagcagctcggagcacagccgaaccctagaaattgcctgtgctgaaggggctgggaaaccccttctctgatggacctttcgagtgaggcagcaggatttgtcagagctgggagtgccgcccgtccccgtcactcgcatcctgccatccagcagcttacaagcctgcactgcttattagcatctggaagagaagacctccaggaccccttggggctgagtaagcagacctgcgggagctggctttctaaatgcatagtgattgtgcgtccctgggtgtgcggttttccccctcacgatgctttgtctccttggtgtgtaagactgatgctgaattgtggctttgttctccaagagcctcttattaaatcagataccccaaggctgagcaaaatgttccttctctccacggaagctgtatgttttctccttacataactttttcttggtgatttaaagagcatcactagtgaaggtggtatgtgtgtgggcgtgttcagctccattcctctctgagtctgtctctcctcccctgccaggctgagcagagctgcctcacacactgggtcctgggtacagggtctcctccctgccttcccaccctggcttgaacttcccttactggagctgaaatcttagcgaagttgtcattctttgcctggccttgcccttcctgagtcatcacttattacctttggcccaaacagaaaagactggggatgatgtgggggctttggggatggcccacagttttctggggactctcttgaccccatatacattgaagggtatcttggcctcctgcggagcgtggagcccaacgcttacttgcttgctgaagttgtggggaatccaaagaagcagcagatgggaggggagtgggggagagaggaagggaaggaagagaagatcgtagatggcctcctcagtggctgaaccgtgggctgtcaccgctgtctggtggagaggaggagggggaggctgagaaccagaagccctgactgttgagtgaatttgcagcaacaagtagagctgcaggctggaaagtactagattcggagctcacccagcatccctcttgtcgcccttctgtgacattgatgcatggcactttgagtaagccatgtccttttttttttttttccttacaatcgccttccgtaagccagaggctgtctgtctgcttcaagtctgtgattcggggtccttgagtgctggtgattaggagtgacctgggggtcgcttgacccccctcctggggggaggcttgattctgtgcatctgaattttcaacccaggtggagagcaaaggtgatagtaaacaattgaagaaggctgggctagcagggaatccagcgttgatggcgttacggattgtaggtgttggaagatggggagaggcctagggatacaaccaggatgcaggcaggaggccccaaaacataaatcgagaattcggggactgctaggtgtgaatagttgagagtaagtgagagggggaagctccctgggacgcagtcagagtgagccggcaccctggggctccacacaccctgggcaggctccgactcacccgaggggcctcactgtgggcctcttaggtctgggggtttctcaccttccagctgcttccccaacttgcatggaaacttccaaggactagataaatctcaggtgtgtgtgtgtggttttttttttttcagcccagcagtagtaggccttgagagacacacgcttataatgaggaaactgagggttcagtggttaaattcagtgaacataattgaaaatctaaaatatttaatcttctttgcctaaagtcacaaagggattcagctggaaagagaagccaggtgtcctgcggtccagcctgttcttttgaagctgggagtggggtgggtggtggaggggaacggaggctggtggactgaggttgggtggacccagtccctaagcctggtcttcgtgtttgttacccagctctggcttctcttcaggtcctgtcccagggtgaaattaaacatcagcactttagcaaaacaaactcttgagtcctgtgtcccaggcattggcctttccaacaagaggaagatgcttggtcttgacctcctcacttcatagtgttggataaccaggggtccctggaactgcggcttctaattttgtgttcttctttcagctcagctgttaactaatggaatccatcttggatttatccaactccttcacagcgctctttcaaactatagatctttttcttcctttaaaagtattcaggtctctcctccccagagatgccccacagaccagtctcaccacacccccttctaacaaacccccttacctcctctcagactcagcccaggcctaatgaaggtgaatgcctgtacttttgttttatgcattactttgtattaaattgtgttcaattcttgtcggtagattcaattgatgactcctaatgcagtcaggtaggggtcttaatttcttagaaggatctgtctctacgttacctcttacactgctgttagctgtctgtattgcatattttggtaaatattgattgattgattattaggcatctggcaccatgtgtggcagtttcatgaatgttaattattataattttcatgatgatcctgggagatttcccttttacacaaggaaattgaggctccatgaatttgaataatttactgagattgcataaccagtaaatggcaaactagagctcaaactcgggccctcggacaactccaaagttgtccctccaactgtacttatgagccacatggtgaatgtccggtagtgaaaacctacctttagctcttgttgggggctggtgacgtagcaggaaacctaggttggacctacaggtaagtggctcgttcaaggctcaataccttccctcccttcctagtgggcaggcttgtcctgaagcctcagcagcccggcaccagtgggacagtgcactgacctgtcatcagccctgcacacctgtcagctttgtgggctttccagccaagcctttcattggcctgaaccaaacatccttcccacaagtgtgagttaaggccctggagtcctaaaagggtttaatgtgagatggcaaagctctagcctcaattactgaattatgagttaagagaaaaatagaatggaatcacaagcacctgatgcccaagaactggggggtgttccttcttcaccccagaggcctcgtggcctgggcctggcagagcattctgctgttcaccccctggctaccacgggcaaattatttccttctcctgagcctgatttttcttctaagaatggagacagtacctgccttgcaggagtaaggggcagctgccagcacataatagatgcttcataaatagcaggtccctctcttcaggtgagccgtcagccgtggcctgtcctggcagagcccagcagaacaccttccaaagcagtgggagcaactgagtttttgatggaattctccaggtcttagcactttgactattcatcaggcgactgaggcgagagggctgtgggttctgcagggtccctgtcgttcctttgttcttccaatcccacctgtcctagctggtggttctgccccacctgtcacacatggacagggtctgccctctccgccacctggggtcccatggtggttctgctactgccaccttctgaaggtcactgggcatgtccgtatggtcttcctcgatcgtaaatttccttctcggtgccccgtgcacctctccccctgtgctctgacccaggggaggtagggagagagcagaagaaaagcaaagccagacttaggtgtttgttttgattttattttgtgggcaaggtatgtggtggcattttattgtttaatgtctgcttttagggagtctgccatctgcctggtaataatggctgcagctccttagtcaccggtgagctagagcctggctgtgcagattccagtaaataagataacagacgcttggcggggctgcgggtacagagccagcccatgggctgcaggcgctgccaggaactgccccactactgtgttgcgggggtggcaactttagggggttccaggcagcccagggtgggccctctgggcagagtggagggctgtggagttgggggcccctgttcttccccaacttggctttccttttctttttggtcatgggctctcagagtctgggggctcctagggcagggttttgctagtgcttggagagagaaccagctgcagaatcaggagctgaggacagtgagaaacagcaccaagcctcggaaaccttgtgggcttttcttttctcacaacccaaacaactgatgttttcaaccttagatgaagacgttcttgctttgcaagctgcgttggccaagtcacattgagaatcaggttttaactgagggtggaattacagctgacaaatgtgagcatttgggggtgctctctaaggcttttctggaaggtctactagggtccacttgcctgttgtcagaagggagaactggggtggcttgtgttagagaaaaagtgggaaggaaacaaaatattatcttcacttgatgtaaggagaatgcacatgactccaggtaacccggggccagtaagcagcgtcttccgtggaccatggtgggtgtggggctctttcttggggcccattgctgtggctcataccctgcctgtggctctggggtggctgacgtggaggttctggcactttcccaaaaccgtagccatcagacagttaaatcctgccctgccgttccattcatcaaagcagggaaatgtgcaggacacttttagaaatattctcaccaataagcatccgaagggtgattgctgcttatccaaacaaataagtaagaatgataatcctttaattgccattccccaaggttttctagtacctaaggccttcccgccacaactttggcaggaaatgggtagctcttcaaagatgagctttctggataacggagcttccccctaataaacggtgcttgatttgggctcaggcagcccggtgaccattgccatgtgagtcaagtgagctggcagggaacctggaggtatccttggagggggagtttgcatctgaagagcaagcaggaatgatatgcttttaagccccggaagaccaatgtgaaggcaccgttcctgtgctgagaagactggtgggaggaccccacagcgagcgcctgccggagtcccctcgaagctcgccaggtggagcggccaccacaactctggaatgaggcccactccgacacctgccgtggactgcgagagtctctggatgatccccgctgctgattctgcacccgtctcggggtaggggtgtgtgggaaggggccgggctggcctagggattcacctgttttgaaagcagaattgctcagattccagaagcccactcacccctcttgggatttgcccttagtattaggccaagacccaaggcaggcatttacgcaggatggccaaacctggctgggagccagctgcaggcatctgccaccaccccttccctctgagtcaccccatactcatccgtgcaaggcgtagagccctgagacgtgctcactggcatcttccaacacgaactccagggggacgattggaaggaagggtggccgtggagtggggaggagggggagcgcgggagagaaccgtgctcccaccaggcctgggcttgggcgtgaggagctttaagtgccccactgcggcgttaggatagccaaggctttagccttggatgctggcccagacccttcgggggtctcacagactgcaggacttgcagctgctcctccctggctgcctggaggccggccctcaggccgcgcagccatctgtcgtggttcgcctgtgaggagagacttgggagggaggggctttctgaggcctctatttttttttttctcctgttcaccttccttctcaaagcccgacttgatctatgagaaccatctcccctactgtctcctgactggggagaaaagatgtcagcggatagcctcaagcccccccaacaacctgcactagactctcttgttacagtacacgttcctgggtctcgcccgtctgctgactgtgcatcaccaggcgctcagccatgccttgtgtgcactttggaccagctttgcaggagagaggcctcctgtttccctgctgctcttttatctgaggaacaaaatcatgggccttcttgcctacagtccaactggtcattgagtctagcagtttccccccaaatcagtttcacccatgaagagagataagtaaatccttgtgcaattgcaaaagaaaaaaaaagaatccagagtatttttcaatggtcccaaatgccgaggcactgcggttcagccagctacaccttgtctggaatactgtcgacaaactagagtcctgccagatgcacttgacaatgaaatcaacccgagcatcaccaatctctggtgctggactcagctgccaccactttgacaaagtctggagtgcagtgagtgaggacactaggtgatgggtggggagccccgcccgctgtggccggggttcctcacattttaaatatctgccgtcgtcttgctgcggggcggtccctgtgctcacttgggcagagggaaagggggtagtttgtagggaggggttacgaaactatgcctttagcctcttccttcctccagagccttcccttgagtctagcgtccccactacaggcttcccccgacttttattctccaagcggtttttctgtttggccgttgtctccaccgcatccagatttatctcttctctcccctatgccttttgggtcttctgagagtagctaatccaataacccgccaagtcagagaagggttcggatgcacgagttctcgctcctggcttcctctgaaatgctgccttgacccaagtgaggggcccgggaataggcagtggaaacggttgtgtaggtttgggacatcgcaccctgctgggacttacctgttggagaaactgggcttttggtggcaaacgaatcattcttcctacctccgtggcagctgtgcatctacgctgggttctggaaggcgcagtgctggccatttcagctcgtaggttgggaagaaggggcagtgtgcccgatctgataggtgtaacacgccatggtgctttggcaccaagaggccaattgaaactggagagttttagagaataaagtatgaccgtcacccacagcacagctgcttcctgaaaattccactcccgctgcatgaaaaagcacatggagtattccaggattcttaatataggcattttcccacgttctgtagattgcttgtttttcttcccctatcccatgggtctgctggtggctgactggccactttttggtcagctttattgaggtgtgatttacatataatgccctttgactgacagtatacaattagatgggttgtcgtaagtgtgcacagtcatgtgaccaccgccacagtgtgatctggaacatttccaccactccacaaggtccctctgaccctttacagcctctgcccttccccacctccaccttcagacttgagggtgggtccatgtcttacctttgtgtatcccatgtccagcgcaattctgaacccaggtggacacaagtgatgtttaaatgagtacattaggaggcctggcttttttttttccccaggctggagtgcaatggtgcgatcttggctcacttcaacctccatctcccaggttcaagcgattctcgtggctcagcctcctgagtagctgggactacagcatgcaccaacacgcccagctaactttttatagtgttagtagagacagggttttgccatgttgcccaggctggtcttgagctcctgagctcaggtggtctgcccgtctccacctcaaagtcctcaggttacaggtgtgagccactgtacccagccagctctggcatattttaaaaatcctcccaagactccttctgtctcctcccattgatcctaaattttgaaggattgtccacccaagcatttgttaattagtaatttcttcatttagtcactcactcctggtaccagccttcctgatcagcctgagataatcagcgtgaccgaagttgataacattccagctgaaagcagagacttgctgttctcgtttgcctatgcagtcacgggtgaaatgtgcaatttcctttccgttccttgagtgcctgcgagcactgcgagagcctccattgttactttctgttatctctcaccctagaccagaaatcgccagccttcaccactggcctctgcctttttcttttttcttttaataataaatgaggaagttagcccttgagcaatttaggagttcacccaagagcaccccaaaaggcttgaagtttacagggatttttctctgtcccaaactgtttgttgttgtcatagttgttgagacggagtctcgctctgtcgcccaagctggggtgcagtggtgggatcctggctcactgcaacctccgcttcccgggttcaagcgattctcctgcttcagcctcctgagtagctgggactacaggcggccaccaccacgcccagctaatttttgtatttttagtagagacaggtttggccaggctggtctagaactcctgacctcaggtgatcagcctgccttggcctcccaaaatgcttggactataggcgtgagccactgtgcccagcctgtcctaaactttgtcaccaaggatttgatgtgtcccttcattctgccttcctgagctccctttcacttgtacgttggggaaggatcttggcaaacctgaaggtaaggtggaatctgcctctttcctctcatcaaagctctgagaaggaagaatctgtagtgtccctgggttcagtaatcatagtatattgcctctaaactcagtgaagcattttaaagtgataactcatgttttccaaatgagtcccaggcatcacagccatgtctttgttaactcatatgtggttctatacttctatatgttaactcattttccagtaggaactcccatgattcccagtttttagattaaaaaacagagaaatgaagtaactttcccagggttacatagtcacaagatcacctattgctacataacaaaccaccccaaaacttaaaaatatgatttgaaatcatctttcatggatttaggagtcatctggctcagctgagttctcactgggggttcctcctatttgaaaagtcaggtggcagctgagcctggcacatcctagaggctccttcactctcacatcactccctggggctggccgtgcagctgtttctccatccgtgcagcctctccacgtggctggcttgagcttcctcataacatggtggtcttggtgcagattcctaacgtggcagctggtttcacccgcggcagacattacaagagatccaggaggaactgcgaggttccttctcacctaacccagaagtcaggtggtgtggtttctgctgcatttctgttgagcacagctgccccaactcaaggatggaggaacagattcgcccactcaacaggagacagcacatgtatgcagggagggaccacattcctagtggctgtcctgtgggctacttaccccatggagcccctgtgcctgccatgcgttgagccacttccgcagcggctttcagactttgacagtgagccacggcgaggaacttcacatcatgacctattggatatagacatcccagaaaactcctggagctctggttttgttctatgaacagcagccgcaacaaaacctgtgtgtcctgagtggattttatgacctatgtcctacgtgcagtttgagaagcagttccacaggatgccacctcaagtgccgactctgtgccgcgatggaacaccacggaataaagaaaacaaatgtcaatttgggttacacagatgccacgtcttaccaacccagcaaaagtccaggtgttgaacaaaatagcctgttggtgagtcagtgcgggaaatagactctcctacatcatagttaggagagcaaactgtccaatgctgaggagggctcgtggtgacatccgtgtccccacccaaatctcctcttgaattgtaattcccacatgtcaagggagagagcaggtggaggtaattcaatcatgggggtggtttcccccatgctgttctgtgatagtgagttctcacgagatctgttggttttataaggggcccttccccctgtctgcacgtggcagaaataataaatgcactgacctgcaagcagcagccacacttctgggaacttatgctggaaatatgaagtatggaccaagtttttattgtattaattctctgtaattgccaaagattgaaagcagcctgcgtcacctacaggggactggttaaactagagcattccagacaaaagcatatgacgtggatacccccaaatccctacgtgctgatattgaaagatctcccagataggcgaggcagtaagacacgagcaaaacagataagagacagggaacagccttcatatttgcatttgcataaagcaaccctagctgtctacgcaactaaaagtggttcctctggggacatggcatggctgggccaagggtatgactcttcaattacaggttgttatgttttgacttttgaatcctattaatttactttttttttttttttttttgagacatagtctcgcactgctgcccagtctggagtgcagtggcgcgatctcaactcactgcaacctctgcctcccaggttcaaatgattctcctgcctcagcctcctgagttgctgggactataggcgcccaccaccatgcccagctaatttttgtatatttagtagagatgggatttcaccatgttggccaagctggatgaatttacttcttaaaaaaaaaaaaacaagctggataatatagccgttgctctcagagtcctcacaatctatacagagatacaatttatatgtaaatagcaaatgggtaatacgtgactgattttaaattcttaggcattaaaatgcaatggagtaggatatcattttcaactggactgctcagaaaagttggtgtaaatttgtgggaatcagctagtttttgaagaatgagtaggatataaatgggtgagagaaaaagggtcaggacactcgaggtaggaaggaatggtgtgagccactgctgctcaaattttgtaacaagcctccctttgaagggagaaaatttcttactgatggctgtccttgaaccccaatatgataaagatcgccttaaattcctatacaaagtgttttaatcgcaaatcatcagaatcaaggaattccggctccccagctattacctttaaaatcacttatctaggtcaggcacagtggctcacatccataatcccagaactttggaaggctgaggcaggcagatcccttgaggtcaggagttcgagaccaacctggccaacatggtgaaaccccatctctactaaaaatacaaaaattagctgggcatggtggtacatacctgtaatcccagctactctggaggctgaggcaggagaatcacttgaacccaggaggtgaaggttgcagtgagctgagatcacaccactgcgctccagcctgagcaacagagcgagaccctgtctcaaaaaaaaaaaaatatatatatatatcatattgcttatatatatatcatatatatgtctatgataactttaaccttgtgggagtcctgagcccccttttttgaggaatgctggcacggggggattaaagaggagtagagggtgtcccaggacagcgtgtaggtcaggtggctgctgcagaagagcggtgtgggagaaaggagaggctgaggccagggctgtgtcctggggtgcactgaatgccaggcagagtccgacaccttctgcaggcaggaagcaaccactgaaggtttcagccagcaggtccctgttcaatgttcattcctttctctaggctgggcacacagatagcctggggagaactgacctactgtgatcttttgattctgccctttaagccatgaaaatagggcagtgcagactaagagggggccaggtgggccgtggggagtatccctcaggtagcttcggtttcccctccacctgtggagttcccctttcttcttcacggacctctccaaaggctgtctcccagattagtctgaaaacagatctttgggaaacgttggcaccctcggccatcctggaaggtcagagtccactcactttgggcacgaagacctgagacgtggcagcctcgtgttgcacaagcagagggaggtgtccctgggcctcatgagtgcaaagggcagaagttcatgatccagggggcttctaggatccactgctgagaaccaagagtgaaaccagaagcactggcaatgccagggacaaactacacaaaggggacggtcctctggctctagggatgtcccacagggcctgacccagaatcttctgcactttctccatgagaaagaaagatcccaaacccttctgacaggtgtaggtgacacacgcagaggccacactcagggaggggtttccttctgcctctcagcagccaccaggccctgcagagaggcttgggctgcatggagactccatcctgcacacaggacacgagtcagggacacctcagtgaccaggccctgctcacagaggcgtccaaactctgtcccaagagacgacgacttttaaccccattcctaggacatgcgatgcaggctttttgctttttcttgtttgaaaaaacaaagacgcaaacaaccccctgttttttgtacctgactcccagctggcgcagcagctgatctggaagtctctcctcctctggtgactttggcctcacatctcagcagttttcttccctctcctccttatataacaagcccctctagaacagaatgagtttgttggcaacaaaacaccaaaaataagaaaacctagcaaattcccttgtttaggttcattagcgccgtggtttgcagccttgagtccccaaccaagaaactcaagcttttctgcaccacgtagtctccccgatgaaccagctgcccagcgagccctgtgaggggtcccccagctccagacattctgaggctgcctggtgcctgcagctggtccctggcctccatctggagccctctgtacttggtcctcattgccccagcctgggggccaagggcctgggcctgagagatggggacctgggttctcagacccttctcccagcttccttgctgcccagccccagcaaggtatttaatctctgagtgtctctggtctcatttatcttcttggtctgagcgctgagcctcagactggatcccactaatcttctgaccctgagcctgggagcatggcatgcacctttctctgtgttctagaaggacctggagccgtggatacaggaagaattgacctctccagttcccatttcctggggaacctatgacctccagcatctctgaggagctgggtgggtggtccaggcctggcgtgatgggcagttgtttggcagatgaaattgaggccatctctggccatttgctgctattgctttttaaaaatttagtggattttacttgtgagcagttttaggtttacagaacctgaagcggaaagttcagagggtgcccatctgcccctccctgaccctgcagcccccatgccaatctcccctgttgtctgcgtctggcattactgtggcacctctgttaccattgagcttctgttgataccttattgttaaccgaagtccatagctgacattagggctcactcttggtggtgtacattctgtgggttttgacaaatgtgtgatgtcgtgtgtgtgatgttgtgtgtccactattacactctcatgcagagcggttccaccgccctagaaatcccctgtgcaccacctgcccttccctccctccctcacccaagccctggctgccatcacatcctttggtggttgtcctgcctctgtcctggaactgctcatgccttggggcctgaacacaggctgtacccaccaggtggcagtgaccagcgtggccctggggcccacctggatgtgttcgaaggaggagtgtcattgcggtgctgggaggtgggatggcctggaacagaatttgttttgggaaggccttggaggagctggaggggttgagtctagacacctcctgtctcagaggaggaaactgacgaccagagatgggaggcgactttctttttttttttttttttgagacagagtctcgctctgtcgcccaggctggagtgcagtggcgtgatctcagctcactgcaagctccgcctcccgggttcacgccattctcctgcctcagcctcccgagtagcttggactacaggtgcccgccaccacacctggctaattttttgtattttttagtagagacagggtttcaccatgttagccaggatggtctcgatctcctgacctcatgatccgcccacctcggcctcccaaagtgctgggattacaggcatgagccaccgcacccggcccgtgaggcgactttcaaatgacacagctggttaggcagaaatctagatccaggcctgcctcactgagggggtagaggttcaatttatctttttaaacaagaattaaacttataaaaagactaaaaagtaaaattttaaaagagctagcagtgtggttgttgtgagtgttgttagcccacccgtgagggattttggccggtgtgaggttctggagggggcggcatacctcccaggcaccttcatgtcctatctggtagctgcctgcagcgtggccctggcggtgtggcctggaatggggagtagcagacaccttctcctgacctggctggtctttatgcatcgctgctggctagatgctagatgctggccggtggcatctggagcccctccatgcagagtgtccgcgcccgtcagtctggaggacacgacaggttccatggttcctgggaagttcctggagcggctgccgcctgcgtggctgggatcacagactgaagggctctggggaagtcacagattcatgtacaataaatgacaccagaaagggagttggagcacgggctttgtgctgtcgctggagacaagatgcaaaggtgcccgcagaacccaagtggcttcatagaattagaacatttgctatgtgcccagtatagccaggcccgtgcgagggatggccagcccgttgcaatcctgtaagagttactgttaccagcttatgtagtggaaacacaagctagaaagtcagaagcagctataagagcatgacatgatcaaaagggaccttggttagaagttgcaagaccaggatttggttctggctgagtcacggctctaccatgtggctctgagcaacttgcttgaatctctggacatctgttaccccacctgtaacagaagggccttggagaatttctgaggccatttccatcctaacaccctgtgactgcccagttctctgggtttaggcgctagaggtgagggcacccgcagcaggcccgggccagttgggaacagaagctgacaggcaccgctcggcagggggctggggctggtggttgtccccaaaggtgtaattgctgttctgggtctagcggtggcctggggatgaggccaagctaccctgcatgtcaaagggccaggggaggagcagatgggggtggtggtgagaggtgaggagggagggaatcaccacacccttgtggtaataaagagatgtgatgttctgtgttcttaactccatgtgtatttctgggcataaagtacggagaggggtcagagggcttcagccaggagaggaggacagatggtaccccttgctccacacttctggtgacacctcggggacagaaggtcagctcttctctgttccctgaaatctacctgcatgatttcaaagcttatctaatgcagaatttttcagactttttcacccacaacacaataggaagtacattttattcaggctgggtacagcggctcatgcctgtaatctcaacactctgggaggccaaggcaggtatatcccttgagcccaggagttcaagaccagcctggacaacatgggaaaacgccatctctactaaaaatagaaaaattagccgggcgtggtggctcacacctgtaatcccagctacttgggagactgaggcatgagaatcgcttgaacccgggaggcggaggttgaagtgagccaagattgcgctactacactccagcctgggcgacagagtgagactccatctcaaaaaacaaaaaacgaacaaacaaaaaaacaggccggacacggtagctcacacctctaatcacaacactttgggaggccaaagtaggtggatcatgaggtcaggagtttgagaccagcctggccaacatggtgaaaccccatctctactaaatatacaaaaattagccaggcgtggtggcgggcgcctgtaatctcagctactcagaggctgaggcaggagaatcacttgaacccaggaggcggaggttgcagtgagccgagattgtgccattgcattccagcctggatgacagagcaagactctgtctcaggggaaaaaacaaacaaacaaacaaagtacattttattctatgtgtgtgtgaatcattgagacacaggcttcatgcaaccatgagatacattcttattgtaattcagtttttggtggttgtgcaatccactaaattgatttcataatccactgacaagttgggactgtcagtgtgaagagccgtggccagatgctgcgggagtggccggctcaccccgggatggaagtgaggagacaaatgaaagctcctctattcactatgcttggcttgggaagccctggcttgctttttaagtccatggtatttcctccttcctctgaactccctgtaccttttgatctataatgtgcctggcacagagcaggtgggtgaaacaagatggagtagaaggagtccttgggtacccgtagaaagtgttggggaagaatcttttgatgtatggctctgtaaatatggacagttgagattctggaagcactgaggtggcagcctttgcaggcctcagctctgggccaaagcccaaagccacatcttgggtagctgtttgggagcagaaatgaggtctctgagccctcgttcagaggtgtcctctctcacacaaggtcctctacgtagaggagggtgtgtctcagagccagccagcaactcggtgaccttacaaaaatgtccccagggtgcccaattttattgtagttcatggtgtccctcctgcagtttgtcttcaagcactaaccaaaaccgctgggtgtgtacccggtggggagcaccaggcggcggtggggggtggggggggtggcaagaagctgactgtgggggaagcgtcagatctgaccagggccatttgggcctctgcagcagaggtcaggccggggccatctcactttcacctcgtggctggttttttcctctctgaagtctgggtggccgatgactggagggtgtgtctgcagctggctggccgggccgggtgtggggcctcggggcctttcccttgagtcggtagtgcccacggagggctctatgctggtattggctggtggtttggcattttatttgcgagccaataaaacctccccagaaccccagagctggccttttcacaccctgtcttggtagaatcataatgtcagagctgaagacagtcctagaaatgaagggctgttccctccgtacaggggctggaggtggcgcatcaggatgtcattcccttatcccgaggtcttggtgtttactggcccccgggccgtcctcagtcatttacgccccagcttatgaccactctccccgtgtcagctctgcgaaggggaaggacagaggctcatggaatccagccctgggaggagccggtgactcaggggtgaaaaagacgcggtccttgccgagctccaactgggtgtggcaggagacaggccctcagtgacaggacagggtgacaagatgccatgacagacacttgcacgactgttacccagcgtgcgaaggcaagaggattgccccactctgctgccaaggctcagagacgaggctaggaggtgatcgtggtgcttttctaaacctgtgattgcccttcacgtactgtgaatgttccctgacagtcaaaggaggacatttggccatttcctgttgttctctaagcactgccaggacaacggcccttcacatccgtctttgtcctctcgtccagctggggcctgtgggtgtctcactgggccctgggcaaagtgagggttccatagtgtggacagagagccacagtgtgggcggagagcccacccgatgactgagcagacccatccgtctatgcagcgaaggctgagagcttccaaacagcggcctgcttttaccctggactctccccatgtctgtccccaccagctcgggtgagggggcctagggctctgtgttaggaggggtctgcagagaaggagaaccaagactagagatccaagcatatagatctcctatttttcttaatatatgtatactaagaaaatatattaagttaatatattatgtgattatatctccttaatatacatatttttcttaatatgtatattgagatataatcacataatatattaactctatataatgtatataacatgattacatatacatattatcgtgatatatatatatatatatatatatatatatatatatatatatatgagatttgtttgaaagaattgactcatgcgttggtcggaactggaaagtcccgaatccactgggcagacggactagaagctcaggcagtcgatgctgcaatcatgaagcagaatttccccttccagaaccctctgttttccctcttcaggcctgctgcggattgggggaggcccacccacatcattcagcatgatctgcttcacttcaagtcactgactgtagatgtcatccacgtctgcaaatacgcccacggcagccacctgcttggtatttgattgaatcagtgggtgctatggcctcgccaggctgacacatcaaattaaccgttactgactccacgatgggatgtggtcagtggagcccagcgctccctgtcccataacatcccctcccctgccccctggctggggcccgcagtgccacctgtgaagaccgcagctactccggatggaggcggcaacctgcagcccaggccacacccttggaagggagctgggaggctgcctgctgctggtcctcgaggagacggctgcacagaccatgcaaatgcgccccccaacctgcatgtcccggggcctcccaggtacttgcctccttcctcatgaactgggagctgacccagactcctgtagcctccacccaacctgtccctctaggtgctgcccctgccccccactctccctccttctgggggatctcagacaggctggaagaagacaagcatgtgtgatgagcagaggctggactcaacctggcctgggagcagctgcctgtaagaggctgccctggggccctgaactaggaaggggctctcaggaatcccacagcacaagcccctgaggtcaggacggtcaggatggccacccccagctggtcagaagaggcactgttggcccctgcagagcatcctccaccacaacgtgaggaggccagtggggtccctccaagcttccatggagctctggtcaagtaaaggctgcccggagtgggcaaggaaaggctcggctgccctttgcacgaggacagagccggagactctggcagcggccatgctgtgatcctctttagaactgccgtgcacaagtcatgaatcatcttggctttcaccttgggaacgggataaagacagctctctaattataagggggacagccagtgtctttgcagaagcctctgaaacccgatctcaggccttggttgagtgtgagcaactgccctggcttccgcgggagccgcatgaggggcctggctgccctggtgatgatgcctttgttgctccccacagccttcatcatcaggccccagtgtgccctcggccagcggccctcgccatgcccagtgccacgggggctcacaccgcgggaagggcctttgatgacgtcctctggtctcgtttcccaccagcccgtgataagaaggatgatggcctccttttacacactggaaagtggaggttcctggattttaaagggcgtgctccacataagacgtgaatgcagaactgcggggagggtcgaggtctcctgggcactccgggccagggattctgcagctacttggttttgagcaaaaagagtttcatgtctggtgctgatatggagctagggaagccccgggtggcctcgggccagacgaggaactgggaatacggtggagcaggggacttcctcaaagccaggggaggctcaggctgccaggccagggtccttggccttggggggcggggaaggggagccccgaggcggttgtgggaaccaggaccaccaggtgagggagccagggaggaagggtggccataggagtgaaaaacagttggatgtttcttttgacatcaggaagttgcttaggctgtagtgagaaactacggtgtcctctgtggaaagtaaatggctctggaacttctctgagagtggagcttaggccttcccggatttggccactggccctcccctgctgcctggttccagtgattcaatatttgttccttatttttctgagagtggttatataacatgaatgtttttcaaaggctccaattgacctggctctggtcacctcctgccgcccatcagtaccaagaattgcccgtttggtggttttggggattgcgcaaggccggcctgtccagaggcacctcccccgtgcctcccagcagaggggcctgccaaggccgtcaccacttggggcgagatccaggccacagtcaccactcagccgtggtcagaacctatgagccactccccgggcagtgactgagggcaggcaaggtgggcaggacggggtccaggtgggaaccgcgggcctcgggcctgtagctggagatgccacacgcagctttcccggggtcactgggcgtctgatagaacccgcctggtgctggatcccacagcccaggcccttaggattgagggagctgaacaatcagttgagaaaccttaagggttagaacctaagaagcgtatcaagacacaggttaagatggaaaggcagaaatgctgctgggtcctggccgtctcacctagatagcgttgtgaaggcagaggaagctccttccttccccggcggtgcacgccccgagactccgtccaaacaccctgtggctctgagagcagtggagagtctttggtcgtttgagagtaggaggaaattattttgatgatgaagataggagatgagaacatgcatcttattctgagtctaatgggagtcctttacaatgttcctgatctcgcctattgttgtccgcttcagtgggtaaaaacagagaacgtgcgagctacaaggcatcttcacaggttctctagttcaaccctctcatttgacagatgaaaaactgaagtccggatatgtccaagattccccagatcgcagatcacagagctggggctccggctcagcccccggctccctccctgctgcaggctgtgttcttgtgggcctgagggacacgggggcttgaatatggccgggaggggccctggcctcggcggacgcaaggcccagcagctccagatggtgctctctgtgctggggtccgctcagcaggagcggagaatgcaaatcattctcgatgtgttgcttcctcggttggaatcaaacaggaatgttgtatcgtgaccctgatattgtaaacctcgagtttgccctgaggtgggggccatcgtgggcccctgctactggcagcctttctatttgtcctgtatttgcactcttgtctgtcttctttctggggtatcccagctgcatcaacaaaggagctctgtaagacaaaacatcagaaacgctggaaggtcggaactgcatctgatcgatatacacttagcacctgctgtcagggctaagatgtgagtaaaactgcccccatccttcaagaatacacaaattagttgattgcaaacattagaaagtctattatcctatggggaaatattgggataagtagcgggccgggggcaggaggagctgtatgtgactccaaatgtggatagtgcaagaatgtgaagtgattgcatttggtggtgggattttttagactttcctgttccttgcaacaccagcttgagttacttttagttaagaagaacttgaagagaaagttagtatggtaagttgcctggggaatgaatcacaggactatacaaatccttatgtatccttccttccttcccctgaggtcacactgtgccaaggatacttgttttaggaagaaaagctctctttttatagcctctgataccaaattgtttttctattactggaactgaaccactccaaggaggtggtaaagtttcatagaaagagttctgagctaggagcaggtggacctggttacaggacatgcttgctactgtctgattctctggcattgggcaaatgacttaacctctctgaccctcagtatcttcatctatagtcggggatgataccacttgtctttcctacttgtgtgggttgctgtaaggaccaaatgaggcaacagttgggagatttcagaaggacatactaatgtcagattaatgttggctctgtcgttaatacttcactttttttgtgatagacttttggcttttgcctggatttctaaggcagcgagatggatgaatgagttgcttttaaggtcagcttacatctcaggaattctctcagatttagggcttttctctttggtcctgatgcttttctgacaggtgactttatcagtccaaatcctgaaaattcacctttttatctccaacacatgtggtcaaggtctgacttacattttgtgcagcggatgaaaatcagagtgctaaagctgtctcttggcggaaatcagggcttcagcatctcttggtgcctcagcgttgccccctaaatgtcctcccagtcctgtgagggcctgagtggccggcagacgggaagaggaagtgagggactggactgggagtagagaccagtggtggggaaggcccaaagctctggcaggagttttaaatttagaaatcacgggaatggggcacatccaggagcctgggccttctggcatgtcacccgagacaccaggtcctaagtattctacaagccaagactctagttgccatagttgcagttagagattttcccacaccggccccaagatgcgtgatgtttcctggtgagctctggagatgagagccaagattagaatactgggacttgctgggaggtgggattgggggtggggagccttccagcaaagcctgccatctgtgccaggggacttccctgttgggctgcatgaccaggcaggcacacacacctgagtccagcagccacgcagcaggccacgatgttgggcttgacttgatgctttcatactcactccagcccgagacacctgcgtgggacctgcctccaccactccgggcagccgcctggggtccacgggcagcctgagctagcagcaggcctcacatccggccctcagctcttttacaccatcttgacgtgagtccctttgaacctcctcggcctcagttgttagagcaggatgctgcttagggttgcatgaggagcaagtgaggatttgtgaaaaagcttctgcatgtggaaactgctggtgctgaacaaatgttagagggtaatgagaatttgaaaccagagaggaatgtgctcattaaaatgggcgataagagacccaccctggtccctcgtcacttcctagtgaattgcaactgcgtgtggcctgatggttcactggcccagcggcacagactctgcggccccatgcttgctgcaggcgcaagagggtgcttggtcggggagttaattcaaacacatctggaacctgctgcctgccgggtacagtatgaggccaagaatagagaggtgggtagctttcctcttgccagggatggattcaaagtctagttagagaaataaactgatagatgagtataatacgggattatcagtctggtaataaaggtgtatctaaagtactgtgggacacagtctaggataattaataagagataattaattctgtctgagggtgactctcagccagagagtgtgtttgacttgggctttgcaggacacataggagtttactctgtgagccaggatttggggacacggagcaggaagagcaagaggaaggaaagagagctcagaggaaggaaagggcttggggtgtttggtgaatggcaccagggtgattcctgcattgctatgggccgggcttcatgctgggggctggggatgggaccctggagctgtccctgagtggctgaagcaaaatgagagcagttcacaggaggggtggatggtagccatgaacagaagtgtctgaggagttaagacagcattccaggtgggatgtccatggatgcatagctgtgtttggaaaatgacaaaccctctgcctgggctgttgctgaaaggaggagaccggaacagagaacatcagaaataaggctgcggaggtcagttcatctatggggcttgggttgcagcctgcagggccggctgggagctcctgactgtgtctgagactcctgagactcctccttgggaggcacgcagctctccatctggtctgtggtggaatttccaaatgccctcgctgtaccgcaggccagtgcactctacccatgctccccaggtgatgtcagtgtgcagccagggctgagaactttggagataaacaccaccagaaaggctgagtctggaatctgcacatctgagatctcactggcgtgtctcagtcagccaggcctggaagccattgctgaggtgacggtacgagtggctggggccttagcagggggctgacgtgatgaggctcaccctttcaggggttgctctttaagcagagacttggagcacagatccaaacagggaaggctgaacaatttggacaataattaggtggcccaagagggaactgggtgagagtgggtgtaggcctggacccccagggcaaggacgtggagagaagggaatgggttaaagaaaggttaagtgcacagaacactacagaaggaaatgaaaggtggaaatgaaagaagacacgcaaataaatgaaaacacatcctatgtttatggattgggaggcgatattgttaagaggtcaggactacccaaagtggtctatagattcagtgcaatccctatcaaaatcccagtggcatttttttccaaaaacagaacaattagtctatcctaaaattcatgtggaatcttaagggaccctaaatagggaaaatagtcttgaaaaaaagaagaacaaagttggaggtctcacatttcccaattttaaacttactataaggccacaataatcaaaacagtgtaatactaccataaaatacagacatatagaccaatggaatggaatggagagcccagaaataaactctcagagataaagtcaaatgacgttccacagtcatgccaagactattcaactgggaaaggaccatcttttcaacaaatagtgctgggaaaactggctatctacatgtaaaagaatgaaattgcacccttacgtttataccatatacaaaaatttacataggtcaaagacctaaatataagagctaaaaccataaaatataaaactcttagaagaaaacatacgggaaaagcttcatgacactgaatttggcagtgatttcttgaatacaacaccaaaagcacaggcaacaaaaggcaaattagataaatcaaagacttctgtacatcaaaggacacagcagagtaaaaaggcaacccacagaatggaggaaaatatttgcaagtcatgtatctgataaggggttaataaccagaatatataaacaattcaaccacaatcaacccaattaaaaaatgggcaaaggagttgaatagacatttctccaaacaagatagacaaatggcctgaatggacatttctccaaacaagtcagacaaatggcctgaatagacatttctccaaagatgatagacaagtggccgataagcagatgaaaagatattcaacatcactaattatccaagaaatgcaaatcaaaaccacaatgagataccagctcacgcccacttaagatggctgtcacagaaaacaaagaccaaagataacaagtgttgatgaggatgtggagaaattgaaaccctgtgtactgtgggtgggaaagtaaaatggggtggctgctgcagaaaacagtttagtggctcctcaaaaaattgacagtaggatgacctgatgtccagcagttccacttctggggataactggaaagaattgaaagcagggtcctgaagagatattcgtacacctattatattggtttgctaggctgccatagcaaagcactacagattaagtggggtggcttaaacaacagaaatatgttttctcatgattctggaggctagaagtctaagatcaaaatatcagcagggttggtttttctggggcccctctctttgggttggtagctgtcttctccctgtgtctctatgtgtggtctctgtcttgtaggtgcctgtgtcctaatctcttccttgaaggacaccagtcatattggactagggcccaccttaatgacctcattttaaattaattgcctgcttaaagaccctatctccaaatacagtcacattctgaggtcctggggggcaggacttcaacatatagattttttttggtgggaagggagacacaattcataccataacactcatagcagcgttattcacaatagtcagaaggtagaagcaacccaaatgtccatcaactgatgaatgcgtaagcggaatgtggtctactcatacaatggaatattattcagccttcaaaaggaagggaactgtggcacacactaccacctggaggagccttgaagacattatgctaagtggagtcagacagtcacaaatactgcctgatgctacttatatgaggtacctagagtggtcagattcaaagagataggagggtggttgccaagcactagggggagggggagggggagttagtgtttgatgggaacagcgttttggtttgagaagatggaaaggttctagagatgacagtggtgacggctacacagcagtgtcaatgtgcttcatgccaccaaaccgcacacttaaaatggttgagatggcaaattttatgttatgtgtattttaccacaactaaaaactttaaaatgaaaaagaaaggttagggatgcagctgtgcccgatttgaggatgactgggcaggattctgcctggtgtggaggcaagattcaagaggaagaaggggcagggctgtttcagacacagtaagtgtgtggtgagctactttccccaaatctattttagactctgttttggccacgatgtcattagactctgctaatagttttgcctcagccgccaccccagtgtcaccctccccatccctgtcccatcatcttcctaggcagacacatgtccctggacccatgttccgtgctgtggggtaaaatcatgtccatcagcagaatagcctgagacgggctctcctccctccaccctttctgcctgccttcctgactcctttagtcccagccatttcttctttcctccttccctggggtgttgggaggtcatggctgctcctggaagtttgactgcacgttctggaagcggatgtgcatggtggtcaggggctttgggggctgggtgtagcaaacacgtccacatcccttcttcatggtggatttgaaggataaggtctcaggaagggggaggtgacacccacgtagagttccatgcagcccctgggcccgagggccactgtcactgaccacgtgctctctgtccaccctaggacctgagctccttcgccatgccgctcctggacggagacctggagggttccggaaagcattcctctcgaaaggtaagacctcctttccagaagtttctcacagctcacttgaggtgccacggaggcaggcagagcctgagcccacttccacctgtgtgttcaccctcacgcccacccgcatgtccgcttgcacacctggccgtaaccgagcccatcctgcgacagctcacctcgcatggccaagcctggcgtatcggccgggctatcccactagagagcctcctgggcttcacccctttttcttctcctcacgtggcactgactgtggcccactagacccccctaacatgggcagaggcagtggaggaagatgagcagtgagctaagcccggtggaaggtatcggtcactgccgaccatctgtggtctttgggctgagttcgactggcaggactttgccctgctgcccaccagcgcccacccccagcgctgggctctctccttccacctcgtgttgcaccctctccacacgcctttttctctctttccacttttcctttcctctctttagctcctcgccgtccctcctgcactggtgaatttccctcccattaggaaactagtgtctcgaggaggttgttgactgtgtagggtcaggtggccagaaagagtgtggggtggggtggggggctctggagagggagccacagcatcaggtgagggtcgaggtggccgtggcagggcgcagaggtccaggctgcttgcaggtttctcctgcagccaggaagtaagggtgggtggaggcctggtaggggacgtgcttcctggcattctgccacccacagacccctccggcaggtgacagcagacagagctagtgatctgggggctacgtacagggtctgggatgggttctgggtgccggctagcctgggatgaaggcaggagttcccatgctggaaaaagcaaatctcctctttaagcatttgaattacacacaactgaatcaaattggtgtcggcctgtggggctccactggtgccagtgccctccccaccctgccctgaacaagcaaccttattagcagctctcgtggcccatccagcaaagactgccagggaatggccttgagcttctgggccagcagagagtggagtggcaggaaggggccaccaaccccgtgcaaggctgtgggaccagccccgcgggcactgggtcgtcttcctcctgtttgactctgcaaaacccttctttccagtgaaaaccttgcacggaagatctgagagtgtgggagagacacaggggccacagccaggccctggccccagcttcctctctggcagctgcatgacaaatggccccataggcagagctctgctccgcagacggctgaatgcctgctctccattagctctgcggagccaggcacacacttgggagtcttgtcaatacccggggaatcatccggttgcattcaccaacatatcatttggctatagcttgcccaagagcaaggcctgaggccctgtccctggtggcttcagctggcgcctgttatctgcaccgccacgcagcccaccccagcaggcctgtccctccgcctggctttcccaccgtctgggagtgtgatctggcccccaaggttcccggtgagaggggtcagacagggcccagcatccagcatgcttcggccattttccagagacaggactggcagggctgcttcctagggctccctcctcaggcctgatccctggatgcccgactccactggcctggattcagaatacagaatggaaccccattcaggataatcctggggtcccccttgctcatcaaatatggttaaactggcctttcatgactggttctccaggggctcatggctcaacttcccccgtgacccccaccctcatggtggcccaagtgaatggccggccctctgtctctgtgcttcaaaccccttctcctctgtctctgggcactggacacctccccggccctgtcactgcgtctctgaagcctagccagctgtcagggcctcctctgggtcagggcctctgttaaggggcaggtttcagctccgggccatttatccatctgcatggtgcttatggtgcttcggccttgtgggcactctgcaagctctcctggggccccgctcccctatgtgtctctgtttccctgtaggactggacatttgcattggctcggccctctcccccggctccccagcaagctccctatgctgtaaacagagcacgtccatgcaccaggtccgggctcacctttccagcagctccaaaatcccacccctccctccggtcctcccatgtggcctcggctcctcttccggttcacaccctcgaggctgctgtcgtgattgtctcagccctgggaacgaggcttggacaaccaagtcgttgtccacattgcgggaaactgagctgtgaccaaacccgggcctccacccaggaccagcttatgtcaccttgtgataggaccaccctggtgcctgtgtgtgttgttcctactggcttctctcagcccccatcccaccctagacctgcacacacagcacccaccacttgaagaagaacctctttttttttttttttttttttttttttgagacagggtcttgctctgtacccaagctggctggagtacagtagtgtcaccttgctcactgcaacctccacctccatctctggggctcaagtgatcctcccacctcagctgcttgagtagctgggactacaggccaccacacctggctaatttctgtattttttgtagagacagggttttgccatgttgcccaggctggtcgagctcaggtgatccacccacctcggcctcccaaagtgctgggattacaggtgtgagacaccaccccctgcctgaagactctcttgtttgtaaatttattctcaggatttgtcctgattcccatagttaggtggaatagtggctaactgggatattctataaacagagaatctaaatgcttttcatattaaatggtcaaaaaaaaaaaatcagctgggcatggacaactgtaatcccagctactcaggaggctgaggtaggaggattgcttgagcccgggaggtggaggttgcaatgagctgagattgcgccagtgcactgcagccttgagcgacagagggagaccctgtctcaaaaacaaaaaacagaactacacaaaaaaagaaaaactcaaaacttagcttgagttacaaggtcctatagcaccacactcttcttcctgccgggcccactcacgaaggtgtccgcgccaggccggacctacacctccacgtggcggcgccggctctttcggctggagaggccgcgcggggaggctgtgctgcgcgggtccacgccacgggcatcctatcctcccggggccgcgggctcggggcttgggccgccctctagtggcggaagaacgtccccaggccgcggtccggacagcgcaccccgtggtgggacagagagaccccgaagtggcaccgaggctgcctgtggggtgtcctgtgttcccttttcagcacagcgcggccgcccgagggcagtatttcccgcgtctgccctggtcctggctccccgcgagcgctgcggacgagttactcgcccttcttgcttctgaactgggtcatctctgaggtcctttccactcagtgttgcttgcaagtttcccaagtggtaggacaagagctgtttaccacgcaccgtgtgcttcctggcctcacgcggcttcatctgacgttcaagcagcccttgaggtgagggcacggccatcctcattttacagatgagggagctgaggctcggtgagaccaagtaacatgcccaggttggctcagcaggtggcagagcaggggccaaataccggcacccagaggcagggcaggagctcctccacgcatccagcaggaacacggctgcgggcacgtgagatatttctcaaagtctgctatgagctctgtgccttggcttaaagttatggggtctgataattttttaagccatgactagaattttaaatcattggtgaagtgagtctcagaggtttggggctttgttaacttccttctttccttctttctttccttccttccttccttccttccttccttccttccttccttccttctttccttccctccctccctccctccctccctccctccctccttccttccttccttccttccttccttccttccttccttcctttctttcctttctcttgaaatggagtctcgttttgttgcccaggctggagtgcaatggcgccatctcggctcactgcaacctccgccttcggggttcaagagattctcctgcctcagcctcctgagtagctgggattacaggcgcccgccaccatgcccagctaattttttttttatttttttatttttagtagagatggggtttcaccatgttggccaggctggtttcaaactcctgacctcagttgatccacccgcctcggccttccaaaatgctgggattacaggcgtgagtcaccgtacccggctggctttgtgaacttttctcctgacttctgttggcaacctcagtctttcaaatgctgaagcagcttggaggtgaaaaattcatcatcacctaggactgaggtctcaggatggagctccaggcccgctctgttctggaacatagggatcttataggcaggcaagaggactgcagtcctgtgtggtcagaacttggatggacgtgaggtcttgagaggtgaaggcaggcaggcccataataaaggagggagacgctcattttgagctccgcttcccttcctcccctctacctcctggaagccccttctaaggagtgggacaggatggtcagtggacctccaggacgtggtgctgccagcctgtgaggggccatccttggggcaggtgctacctgcagaccattcagtggctacctctgtggaagagcttagggctgtttctctgggagggtactatggggggcccgcatgtgagagaggacaatgataagtttcatacagggcaggaggcagcgtgtccagagcgtggagtgactgcatccattcgtctgtttttctgcaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaagtaagaccttgatgctattgtttcaggtgggtgctggggtgctgggggtctcttctgcagccacacatccacggtggcaccgaagctgccaggtggctgtgagcagcttggtgctgagtgcctgtatctgtttctccccacccccacttccccctaaacaaatctctctccagaacatcagtttccacctgtcactttcttcccatgctaatctatcaaagcgtaatccttctggtccagcaaggtccttgggttaactgtaaacatcctgatactcacagtacagcttgtatggacaatcagatgacacacttgcctccagccttctctggaaactgcaggcatggagccaagcttaggccctcacccggggccacgggaccatactgctttggtcagcctgatatggcttccactctctgtggtttggtatttgagggtttgactacacctgtttctggcaaatcctaactttttctgtttggggctctgggcagcagggaatggaagctaggagggatttgctggggaaatggaaggaggaaatgtgagtgtttaagaaagagttccgtaggttcattagtgtttgtgatctgaggataaggtattttcatttgagcgccgtcgatgataatatgaaatataccacgaactagaaagtttatggcgtttactttctcctttcctttgtctattctttccagttctttctactgacttagaacatttgtattggggaagatagtgatgtggaaaacaaatttgtccttgaccatcagaggcctgggatagttcacctttctctccaggctgacttttactcagaaagactggcaatactgtgtgttagagcaacgctttatatctgcaaggccaggcggcagcaagaggggaatttcggtgtttctgacttcgaactcttccatcaggcagcagtggctgtaggacgagaagccaggtctctgtcagcctcactacttcatccaccaccttggaggtggaggggatggtggccgtattctgtgtgagtggagcagatctatctcttggacagattttgcacttcgtctttctacataaaacaaatgaaggtgctcccgcctgtgggttgtgtgtgtgttgtggggggcaggtcctgaccatgctctacacacacccctcactcaaggctgtggggttgtcacaatttcctttaagtttgtgcactttagccttaaggtgcccctttctttccccatctccttgtataaacatcgtctagagatgagggatcaaagtgctgtacagaggaaggaaatcaggcccgtcctgatgggaaagctgcgtgagggctccacgtcacacaggtgggatttgtcaaagagaaggaggatgtgtgcgcagtttgccttgttggggaacttgcgatgttgtgtagattgaatgtgctggaattggtggatgaaaagacaggattcctgccttcaagggctcctagtcagaggcaagcaggcttcagaagaaaggacgagattgtctccatggtactgcctgtgctcagttaggacagggcaggctttctgagcggggcggagagcagcacagggaacctgatgatcggaagggtgcccaaaggagtgtaggagctgtgagctggctcccatgggaaggtcttgaagctctggcaggaaccatcaccctccgcctccctctacatcattctcctgcacagagccctccatgggggtgggaggagagggtgagagggaggagcggggagaggaggaggagggtccctgcaggcagagggtccctttgggagcccagcagtggcaccaggaggtgcaggagaagttgttcagtcctcagggcctaggctgcagctcagtacagcatttggtgggaggtttggtgctgtccactgttcagcctgggaaatgagctgttcttttagaaactgggtctggaaaaatctctttttgaaaccatatcaatttcttaaagtattcctccttttcactatctttcattgttatttatgtttagattttcaatctctttcaactgttttctttcagtaactgacagaattgcagacagacagataatcaaagctagaagggactgtaaggaaagcatttatgggggaagaaagcatatgcatataataatttgaacacagcatatatgggtgtgtgtgtgtgtgttttggatttgtatagatgtatgtgtgtatgtatgtgcatatatgtatgtgtgtacacacatatataccttttttattttttaaaaggacatgcattggactgctagtggtagcttctaagtgaagaattaggagtggatgggtggaaggaaaatgttgctttatctgatattccaattttttgagactagcttcacttattggtaattaaaaatgaatacatcttgaaaaaaatgtcaagctcccagacctgagctttggggcggtggcgagatgtggaacagaagttgcgggtgttggtaacagcagaagaaagagttgagccaccaggaatgcctggggacagccaaggccccgtgctcagccttaagggctagctggggaatgctgggatgtagcagggcttggagaaggcatggggagaacctacagatggctgagtgtggaggtccaggatgggaggcggtgttgctccattttgcattgctataaaggagtacctgaggctgggtcatttataaagggaagaggtttatttggctcatggttctgcaggctgcacagaggcatggtgccagcatctgcttctggggagggcacagccatccagtgggagcctcatgcccactgcacagataaaaccaattcaccgagatcttggtattgtagtaaaatgtttaatgtgaggccagccacatgggagatggagctatcactcaaatcagtctccccaaaggctcagagcttagggtttttatggacaatttgatgggcagggggctagggaacgggcactgctgattggttggggatgagatcacagtggtgtggaaacgggcctccagcactgagtcggcctctaggtgagggccacagggtcagctgagtcatgagtcatgggtctgggtggggtccattggttgccagaattcaagtctaaaaaattatctcaaaagaccaatcttaggtgttaaatagtgatactatctacaggagcaactggggaagttgcaagtcttgtgacctctggctccatgaccccagagcagtacgagatcatagaaactacacctgcatgttagcccggttcaggcccctcccataatcctaatctgtggtctttcattcatctcacaaagctggttttcagtccctgagcaaggaacagttggtttcagggaggtactattatcatccttgctttcaaattaaactataaactaaattcctccctttgttagcttggcctccgcccaggtaatgagcaaagccagccagcctgtgaggctggatgcaggatggagtgggccaggctggaccttctcctgctgtcgtgatctctgccaaggtgtttgcaagggcttcaggctgcttccactcatggaggaaggcgaaggaaagccggggtatgcagagctcacacgcaagggagcaagagagaggggggaggtactggagtctttaaagcacccagctaagagagcaggactcactgccgcagggaggcaacccagccattcatgaggcatctgcccccaggacccaaacacctcccacggggccccacctccaacaccggggatccaatttcaacctgagagcggggaagaaacactcaacctctatcagaggtggatccaagactcccagcccctctggatctcagcgggtcccagcagacactgtgctcacagtgagggaacgcaggcacaggcctggggatgactctgctggtgtccacatggggtgctgccgcagtgaagagctagacctcggggcccatgctgaacctggccatggccccttccattggggcctgtggtctgcacaggaggaagctcccagactcccctccaccctttccttaaagccaggggccgagacaggcaggtggagtcagagagtgagtcccccaacccatctcctgtactgcaggagctccagctgcgggctgaggaatgtgggggctgtaccttcgggaggcctcaccccggcagtgtccagcacccaaggggtcctggggatgaggctggggctcagaagcagagactgtgaggcccctgatcatcctctgcaatgtacctgaaggcctcattgctgggtaggggcccacagtccactcatagctccacacccctgtgcccctaatccacacactggggtatatgagcccctcagctacctctcattccagaaacttaaaactgctgcttcctcacctagggtgcctgcactgccccggctgggcctgccatctgcgccttcctccaggcctgagtgtggtctgtgagctcagtgagcctgtgaattgcttttttcctatggcagaagtgcagacagctgcgaagggagcgggacctggggctgcctgctggggcccgtgtgtacccggggcctgggccctcccttgggacacagggagtcaggcactgcagctctttattgttggtggacatggtgggacgttggccactgaagacaggcctgactcctggctcctttcggctgcctttttctgttgagtatttccaaggcccttcaatgtccttggtagaaaatccccaggttcactcttctggcttgtcaggtactatggagaaggcagagcctgttacagcccggttacaccatcggggtagacagccaggggccgggctcaggaaggctatgacatggctctcagctactcacaagggcaaggattgattaggttggggtgggggcatggcttcttcagagaagccccctgggatggggagttcagaacagagcaagcctggtccccagggcaattgctcatgttggtgcccttgagaatcagtgaggccagctccttggctttccctgaaagaagccatccctccccgagccctatggctgataaggcacgaagctccaggtctctgtgctgtggtgttacttgactgggaggtcaccctgagctccttccagatggccgttcatttgtgcctggcatgaggctggcctggaggaggcaaaatctgtctgcttttctccgtacttgaaatctattcctggatcagggttcccagactgtagattgctcccccactgccctagaactaacttcatgaaattgagcctgtgagtaatgccatcggcccatctggagggtcttgggaagaaacagccccgtgaaagccactgtgtccactggagggatgtcatgaagacttcgttcattacacaaggcccctgggaggaacttgctgtctggtcttggtaccaagaatagctgaacttctgatcaacgggactgcttttgtctctagcagacattaatcgtgtaatagcgcatttcctctgtctgcactggctgctagaagcctttgaaccaaatctggacaaaaggcattaagggatacatttccagcctttctgaatccagttttcgtccctcttcttttatattcacacgaccacttttttaacaagcaaacaatgtgttggaaggatttgggggcatttacggaattccaaaaagagctgaaccctcaggactcaggaagggaaggaaccagactggccctgaggcctcagcagcaagaattcgtggatctttccaagagatccagagaagtcctagtctgtgtctctctccatttactgtcctaaatgccttgtcgcaggatatctgattagcccagttaggatccctgaatcaatcagggcggggtggggggtaggatcacgcaggagaaacagaatgaccaagaaccaggaggtagggcgggaagttccaggataagaggtccagttggcaatccaaaggggactgtggcatcccaccctccttggccagcatgtgtgcatgcacgcaaggatgccctcatcacacgtggcccaacgagcctacatacaattgtgtaagctgcttcccccatggagggcgatgcagcctcacatccagccttgacattaaggaggatgtggctatgatcccctgttttctgagtcttctgtctcaaggtaatgcccacttctcctcatgttctatttgcatctcatctttctgtcctataatttatggcctacatgacaaacatagaatctaaagtgttgacaggctcctcaggtaatactgatatacaccagagcttgataagcactgttttctttctttttcttttttgtttttttgaaatggagtctcactctgtcaccaggctggagtgcaatggcgagatctcggctcactgcaacctccacctcctgggttcaagcgattctcatgcctcagcctcctgtgtagctgggattacaggcgcccgccaccacacctggctaatttttgtatttttagtagagacagggtttcgccatgttggccaggctggtctcaaactcctcacatcaagtgatccatctgcctcagcctcccaaagtgctgggattacaggtgtgagccactgtgcctggccgataaacactgttttatattattaaggggaaagaaagcaggaagatgaaaattatgatcactgtcatttcagagggagaaatgaaaaaggaaaaagaggtaattcaatcttctaagacactctaagacaggagggggaacacagatggggaccatggttctggattccacagctgatcttgggaccagcaagtacctaggctggctggtgttttttgcccagggaagagaaccagacctttcttctggaaggatcttacctctcagaggctgcctgtatggagttgccgtagtctttcactaacatttgcctctggtcagaggtacagtagcgtgaggattcgtagtgtggctggcgttctcatcatactcctagccaccatggaatatcaaacctacttccctttgatgatcagagtcaaacaccccaaccaaaacaatgccccacttttccgtctctccctctaatgcagcagtcagcaaatgacaaaatcagccccgggacaaaatctggcgtgccacctctttttgtaaacaaagctgtcatggagacacagtcacgcccatctgtgtgttcctctcctgccgcttccacacttcaacagcagaactgagcaggtgcaacagagaccccatggcctacaaagcctgaaatgtttacctggctgaccttgtgccacaagaattattacgtggctgagtggctgcaggagcttccagaacagtgaatctttagcttcaaaagattttgcaagttggtttagggtgatcttgcctttggagatgaggaaaggaaagtgcatgtctgtgtgttcatgaactgccaataataagattaaagtcttttaaaaaagcaaaaagaatcttacacagtcagcaaggcaggacctccagaatgatctaatgtcgtgttgctaaattttgctccttataaaagtctgtgtgtgttctaagtgcattgtatgtaattctttcaatcttcatagcaactcttctatttgtacaatgtttaccaaactagaaactgaggcacgagggcttaagttgtggaacaaaggccacacagctaccaagtggtaaagccaaaatgtgaagtcaggtggttgaactccgaagtccacttttagtccaggtgctgagactctgctttaatggaatagatcttagggatctataaaccaataatgggatagccagctagccatttacgaaaaaatagataaaagtggctccttggtcatttctctctctttctttctctttctttctttctttccttctttctttcctttcctttctttccttcctttctttcctttctttctttccttctttctttccttccttccttccttccttgcttcccttccttccttcctttcttcccttctttccttcctttccttccttcccttcccttcccttcccttccctccctccctccctccctccctccctccctccctccctccctctctctctctctctctctctctctctctttctttctttctttctttctttctttctttctttctttcattcatttagagacagggtctctgtcatccaggccagagtacagtggcagaatcactgcagagcctcaacttcccaggctcaagcgatcctcctgccctttgcccgcaataggtggaactgcagatgcacaccaccatgcctggttaattttttaactttttgtagaaattgggtctcagtgtattgcccaggctagtctcaagctcctgtactcaagcgatcctcccacctcagcctcccaaagtgctgggatttaggtgtgaaccaccacacctggctcttggtcacaccaaaataatttccgtgtggaactaaactttaagtgttttaagtaatgtacctccaaaacatttgaatatctaaatcttgggatgtcaggcctttctagaaggtgcaaaaaatatgtttgtttgtgatataaatatccacagcctttcttgccttctctcaaagtttgcaggcttgattctcagagctttgctatattgatgaggtagaggagagctggatgcattcctgttagaaagaatgaagaatgtctaagagagaaatgcataacgggggtccaggtgagtgaagggaagattctagaaggtgagttttggttggagaagattttggagagtttgggagcgtcataccagagattgaagcccagttcttgtgctgtgtaggatggtgggagagggatagaagagatgaccccctgaaaggggcattatgtgtgttgggaatataagcacaccgctggctcccaggcagcctctccagacacctcttcagatttcctgaaaggactcaccttagtagaaaggccttcctttgacaccctgggtaaagtagtagcaatctccttgcaggcatctacactactgattccccacaggatatactgtctatttactggttcacttgcctgtctctccccaccagagtgtaaactgtctgaggacaggaattctgttttattcaaagctttctcagggtctagaatggcgcctgaaggcactgagcaaattgtttgaaattaattcaccaacaacttaacttgtttttcaatgctttctaaaatgtgggctgatgcttctgaatacaagatgatggctatactgacccagggatttcagtgggtcatatgtaagcccgaccgggtccagaaactgtgaagggacagaggcaattatcattgatgacatcaagatgaccacttccatacagcttcccactccaaatagaaaatgaaacaaaacaacaatataaacgtgaaaaacacgtgctagaccagaaggagatgatgaattgatggaggactaatatccctaatgtacaaagatatttacaaaccagtgaagcgaatgactcaatggcctgagtcttggaatcgaaagttttaacaggctcctcaggtgatattgatatataccccagagcctgagacttctaggaaagatggcattgtgtgtactgcatgcatacaaaatgattcctcccacagttgttcagatacagcaaaaggacacggagctctctggctttggaacagagtgcaggaggaaaggaggaagtggaataatccctaagcacccacctcccattccaccaccagcctcactccaatttaatggtgctgagtttgggacgtggggattttgaaagcatcagcagacttggaaagacaagaaacgtggtgctgatagaagtgatataatgttttattttaaaatgccaaaaatgtaaagcggaaatcgaaattttagctaagggaaaagcataaagaataacatagctggaatgaagatagggtaaaaatcatgcatgtaatgagattactttctatgttcttacagtagtagaaatcaggcagatcttagagcctgaagtaaggaacagaggagggctggttatttttgtaagcaacctatacattgtgggcagataatttgatcatgctttggcataatttctgcaatggtaaatgtgtgaggtcataagcccacagtgctgcttgaatcttagggagcctgtggttgcactggaaaatggtcaacacaagacccaaccgtggctggaacccctacttctcagcctctgcaacgcttaatgctaaagtcggggatggggcgtggggcatggtggtttgttcactgggttctccaggagggaggccactttctatctcacccccctacagctccaggtcgaactcctaaaacccaagagacagggctgctctgagactggttgatgtgttttcaatacatgtgctatttgtaggtcactccataagaatcaagctccccagaaaacctgcgagacctcagagccctcactcctcccagcacaccttgctcagtgaccagcaaagtgtcagttgaagaatgataaggttcctacatttggaaaggatcacttctttaaaaaggctgcagccagcaggtcaccattctgacaggctgggaagcatagtctctagccagatgctggaaacaggcactgcgagagtggaagacagggatttatgctgaacagcgtggccaaatgtacatattcaacaggttataggaggagctatgaatattcacaaagaggaagcatagacatgcataattggctaattgtgtgcagcatgcatccatgttcacgctggggtggagacttaacctttaaatggattacagtaggccctatatgtcagagggtgaagccaaggatgcgaagactgtctgtgtgcagcctccataggctagtcagagccactccatggtcaggggtctcttatcaggaaggaatgctggtcggttgtgtcgaacctgcaaaaggaaggggcagcatcagacagctggttgatctcaggaatggagcaagtctttcaaaagggcaggtttccatttaacccttggggaaggaagcctaatggtggttagcaagggagggggtgtaatgaggcacatccgacctctcatcccattatggccgggaactcagttttaaggtttttctggggtccccgtggccaagagggggttctttcagttggttaggggcttagaattttagctttatttctcaaaaggtactgaatttggcctccgtggtccctagcagtggacacacgcactctggggccagcaggttaggtgcccactctatggggtgggggtgcaccctcggccatgtcagcccagcaccccagccccgcaagcagtgccacctgcccacctcgtgtttccgccacacctccccagatgcggctgcagcatccgtgccttcatggcccacaggttagtttcaggggctgtcacacaggcaccacaggctgcatggcctaagctgcccggattcctgttcccacaattctggaggctggaagttggaatcagggtgtcagcaggaccatgctccctctgaaggctctgggagggctctgttccaggcctccctcctagcttctggcagttgcccacaaaccctggggttccttggctcgtagatgcgtaacttcagcctctgccttcatcatcctgtggccttcctctgtgtgtgtctgtctctttttcttttcttaaagtgacagcagtcaaaggagattaagagcccaccctactccactgcgacctcaacttaagtgactacatctgcaatgactctgttgccaaataaggtcaccttctgaggttctggaaaggaaatgaattagtgggggcactgtctaacccagcgcagtctacaaccacagcatcaactgcattcaaagttcctgggccattttctttgatgtttactttcacttgtcttctcttctttgcttgactgaggtttgttcacagcctttctgcctgggttagtttcttcttgtgactcttaaatgcagtaaaacactgtagaaagctgcctgcccagcacagctgacacagccctttggtaaaaccagatagcatcattgctccctgcactggggggacaccctccatggagctttggagcatctcagggggacaggaaggccacagtgcattagaactccaagtctgttgaggtcttgcaagtggggattggattaggagtgggtaagaatcatgacacagtggcccaggatgggaagaaagagcaaggctacagagtcgctgtttcttcaggcacgggctgtccttgtccattgacttagtcctggcaccaactgcagccttcttggtctgtttggaaaaatcttgaagactggccaggtgcagtggctcacgcctacaatctcagccctttgggaggctgaggtgggcagatcacttgagcccaggagttcaagagcagcctggccaacatggcgaaaccctgtctctactaaaaatataaaaattagccaggtatgatggcatgtgcctgtaatccgagctactaagggaggctgaggcaggaggatcgcttgaactcaggagacagaggctgcagtgagccaggatcgtgctagtgcactccagcctgggcaatagagtgagactctatctccagaaaaaaaaagaaagaaagaaagaataggaagagagatcttgaagaacaagagttctaaactttattgatgaagcttctgatttatttaagctttgccgttgctaatggggttttggtggggtcattgcaggcgtattccccttacctcaagaatatcctaaaatttgggcaggaagtttggcctcatgaatgatgacaaggggctgcatgatacagcctagaagtttgggggagtttagctctccacagagtaatacttgaccagtaggaactgtggctttgaggaagctgggcagaaacctcctccttgatgatggctatggatccccccacatatagttcctttctagaaccctcctggaggagtcccatgagccaagtgaacatgctttctaagctcccctgctctttattctgattattatgttattatttgcagcttgtcatgcatcagcagccagcatgacaactcatttcattgctgcttctcctgccctacctcaccttgatcttaatccttgcctcaggctctgcttctagaggaaaatggctgagagaaaaaggaggctgtggagaaatgagaatctctgggcagcagcacttaactctggctccataatcagaataagaggaaccagagcttttggccagttcttcctttgagcaggtctaagacagaaacatttggtttcaaaaaagtcagtgagtaatgactcacgtcacagagtgacttgccacaggatttaacaattagctggtactctttgagcctcactcacatgcactgatatctaagcgagtgtggatgactacaaatcatgacaggtgtattcatttggtagggccactataacagcaccacaaactgcgtgcattaaacaacagaagttggctgggcatggtggctcacgcctgtaatcccagcactttggaaggccaagtcgggccaatcacttgaggtcaggagtttgaggccagcctggccaacatggtaaaaccccatctctactaaaaatacaaaaactagccgcacatggtggcagatgcctgtaatcccagttactcgggaggctgaggcaggagaatcgcttgaacccgggaggcagagattgcagcaagctgagatcaggccactgcactccagcctcggtgacagagtgagaccccatctttaacaaaataaaacaaaacgggagtttattatctcaagaggctggaagtctggaatcagggtgtgggcagggccggctccttctgaggctgtgagggggtctgttccatgcgtctgttctttctcctggtctgtgctggtcatcactgccattccttggcttggaagcacagcccccagtctccgccttcatcttcacagaggtttttccatgcacatgtctctgtgttcaaatttcccctttttctaaggagactatccctattggactacgggaccctctgactccagtataaccctcatctcagctaaccacatcttcaatgaccctacttccacatgaggtcacgtttggaggtgctgtgagttaggatttcaacatgtgacttttggagggacacaattcaacccatgacataggactatcaaggaatggatatgtcctgccttctccacgattgatgtgctgaatggaacaacacaggccgtaggtacggacagagttggagaaagatgagttagtggtaggccggactggctcggagaggtgttgtgataaatggagacactttagcgggccttgacggataaatgagagggagcctcccacacagtagcagaccccactgtcttcaggtgtctgtgaacttgcagtcctctgacacctttttcttgaaacacactagtgcctgggcataggtcatccccagtccccctttctaaagtggcctgagccagtgttccaaatcagggtgatagctggtctcagcactctgcttttactctctcctgggacttatccacgatctgggcgcctcgcctttggttttctcctttttagtgagatgaacatgtctgttgttactgagtacaggttgttgagtgaactgtgtttgagcttcacttcccaccaacctcccacctaccattgttgactccaaaatgtctccttttgacaagactcttcctgtaagtttctcccccacctcacttcttccccgttcctaccatcatttaaaggaaatagattttgataaatgggctttactgctgtaagtgaagttggaagaacaaaggtttcagatctgcagcccagccgagtcctcgtgcagcgcatatgtgagaagttacagtgacacctctgtgtcctttgggagattttggcatgggctgagtgttcttttggtccattgtgttcccattcacacagtgtcacagataaaggagatgaattgagtctgaaattgctgtttattacagttcctggagatactataatacctgagtaggatctgcacacaatagccactcaaaaccattatcagatgaatcacctgtcaacgttaggaaggtccccaatccagacacatgatgccatcatcagcatcaggttagtgggtcaggagtgccaggggtcacacaggaatgaaaatcaagttatcaggccagggctaattggggaattagacaagatgaagaatttatttcaggtgcaattagatagagttttaaaatacactgtaggatttcatttaatcctatagtaactgttaagggttgtatgatgttcccggcaaaaatggtttgtggaagtcctgacccccaggacctcagaatgtgacctgacttggaaatagggtcatggcaggtgtaattatttaagatgaggtcattcatgtgggccctcagtccagaatgactggtgtccttaaaagaaggcccagtgatgacggagacccagggagctggtggagctgagacggggatgccctggtgcctgtgatccctgaagctgcagggcagaaagggctcccccaggtttcagatggtgatatggtttggcttcttgttaccacccgaatctcctgttgaattgtaatccccacatgttggaggaggggcctggtgggaggtgattgaatcgtaggggcagacttcccattgctattctggcgatagtgaatgagttctcacgagatctggttgttgaaaagtgtgtagcacttccccttcactctttccttcctgatgccatgtaagacgtgcctgcttcctcttcaccttctgccatgattgtaagtttcctgaggcctccccagccatgcttcctgtagagcctacagaactgtgagtcaattaaactttttttctgcataagttacccagtttcaggtagttccttctagcagtgtgagaacggactaatacagatggactgcgggctcacacacaccttgacttaggctcccagcctccagaactgtgaagggataaatcccattgcttaagcccccctggccatagacagcagccagagaacagacacagcaaatgtccaggaaagctatggccacacagcagacaggatgctcggcctctcagccatgatcttctgttgttttcagtgaggcagagggcaggtgtgttaccttggagtccccactgcagcctccccatgcttcacagatggggaaggagtccctgtctctctacaaccttgaggccttacccccacctgctggccctgcccccacgtcctgggaccaaaccctgaccatcctgacactgcccccacctcctggctctgcccctgacccacttgctcctgggagcatggttgggtgggaggcaggacagtgtgaataggtcatgaggtctccgggcttctggtaggactcatgaactaaggagttgacagcactcgtggtgtagccatcgcagtcctgggatgcctctaggcacttccccgctctccctgggtcgtctgacaggtggagagctcttggcactgggggtggacagtcagaaagtactgggcgggggtagcaggtccctaggccctcagctcaggtgtcagcaaatcagagctggagttgagtgtttgttagcttaaaggacaaatagcaaaatgaaaaagcatccaaggaagggcgccaacctctgggtctctggacagcctttctcccttctggagcgctggtctctccatcactctcctgggctgggctgcgctctggctttggcccagggcagtggcctgaagtgtcccctgtggccattagagctgtgattgcagatctgtcaaagcggctgctgcacagatgtttccatcaccacttttattatgtcattcccttgctagagacttcagaaaactcaaactgcttgccagatcagggccaacctcaccccccaattcacaccccgtccacctgcgcaaacactgcctccctcctctgccaggctgtctgcccgtcccagccctgtctaacttggttttaacttcatttgtgcccctctccacctggagtgtgcctttgtcccttttagacaccaactcctgtagagacgcacaaggaggaaagcagtgaggctgcatgttctgtccagagcttgcgggtttccgggcctgcaagctccaaggggagcctgggctcagggcactgtcagctgcaaatgggtgttagggctcgtcaggtgacacaggcagcagctatagccctggacggcatcagccagaccaggcacggcatctggagacagacagctgggtatggctggcacacgagggagggcagaggcccagggtccatgaaagaggccaaggaggcatatgggtcacagaggcccagaagagtccctcaagagaggggacgatcagccctggaggtccggccaggctttggacttggcaggtcattggtgatttccaagagagcagcttcagtagccaggaagggaaggaaagcgtgtggggcagtggctgaggagccagcgaacttccttcaaggccctggggtcagaagcgcaggtggatgcatctgtgccaggagcttggtgcttgtgcaagagccaggagctcctctgcctctcccagcccacccctgcggtcagggtgggaccacatgatggggtttcaccaaagagagaggacaggcgtcacttcccacccaagacatcaagagcaacccgtgtgctcgactctgtgccgggatggctggaggcagagacacagaggtgaggagggagcaggacagcaggagacccgccttagcgtgagacctgccttggctgcgtctgactgtgtgtggcctttttaggggctcagcttagattctggcgcttaattcttactgtggcacttccgagcccacccgacaattaaggcgagctggtagcgaggggatggattcagtttaatggacgttttcagttggttctttgtaaggtgggagaagcacgtgcaggctgagaggggaggagccggtagagggagcagggacagagctgtcacgactcgggagccctgcccatctctagtgctggcttttgtcctgctcaggctgctggcttatttgctttgggggacgcctcctgtttgtccccatggtcttgatgaggctgcttgtcctcacagacctgcccttatcccagccagccatcagtcagggagccgcgctgtgggcatgtgtctgaatgtgccgtctgctctgtaaaggatgcttcttagggttgcagatggacctctcttgtgtcccccacccctcagtgtttagcagtgagcttcagtggggtttgagtccaattctgaacacatggcaatcctgcaaggcagctgctcatcctggcaaaaggcaagtggcttgttctacggcacacagctcagaggtgctggtcgatgtgcgtgggctagtctgccccaaacacagaggatgcttggcatagtttgcctcttttccaccaaacccctgtattttgctcccatgaatagctgacctgcccatgccagccttcctagcccccatcctcacagaactgacactgcctctcagtggtggctccctttagaggctcccagtaggccacagctaggcttcttgtgcctgcctacctgctccttaagcttacgtatacgtcgtatatgtaagaattaacatatgtgtgtgagtacgtgtgtcaatactgtgagatagccaagcctccttcctccattgggctcattcttgcaacagttgcctgcctactgcggaaagtcatttcccaccctggagatgcgtgtaggggatcctgctgccctcggctaccatgcagggccttcctctcgtcttctccccacctgtcctgggccccttctcccgctaagtccatcacatttgtccatgtgcacagtttgttcctcgctgaggtgcgcagcagactgtgctaacccatcggacagtggctgcctcttgtttcttcatagcagaacctggtttaactcagggcatggccccaggccatgagctgcagttggtctagttcagtcagaagtatccccttcccacatgccagtgaatgggagaagtcggctagggatttaagaaaaacgtgcgtcccctaacaacaacaaaaaagacacacggggataaatttccttttcttcctttgactgtggtctggggacatggtttctagggccatgaggacaaaggtcaaggcacaaggtggctgagtggaaaggtgggcaggtgattctccacgcagttggcagcaccaatgtcattgcccgatgggtccttccgcctcttgtacagggaaactcaatccactgagaccacggcgtcacagtaaagaaagagttaactgacatgagtccggtcatgccatgcaggacagttatctatcaaatcaagtcagtctacctgaaggctcagaggttagcagttttcatggatagtttggcgggcagggactagggaatgggtgcagctgattagttgggatgccttcagaggggtgtggaaaatgacactgactcctcctctgggtggggccacaggactggttgggtggtgagtcaggagtccaggtgaggtcaaattggttgccagaaatgcagaagtctggaaagacatctcaaaaggccaatcttaggttctctaatagtgatgttatctacaggagtaattggggaagttacaaatcttgtgacctcgggacaatggctggttgtcatttaactacacctacatcttagcagaattcaggcctctctcaatcctaaccttgcggcctctcattagttttgcaatggtgttttagtttggggaagggctagtatcatccttgctttaaactgtatgtagtttaaactataaactaaatttctcccaaaattagcttggcctgtgtgtgcccaggaatgaccaaggacacttggaggtcagaagcaatatggaatcagctatgtcagatttctcctaacagtgatacttttgcaaaggcagtttcgctaagctgacctgctttgcaactgcctacctactaactgttcgttattgtaggtgataagcatccttgtggcttagcctcctttcagttatttttttctgttcatgccacgaagccatcctaactttatcctgacacatctccttgccccaggggagctatggacaaggtgcgctgtttggctgaaggcaatcatggccaagctggcagagctagcctggaatcttccagacagagggctggaggagggatggggcacgggagcacagatagactttaactgcccccacgttgtcaaggaaaggaaagcagagcgagagagtgggtagtggggtgggtgctgctttggatggaatggcgagggaagtcttctctggtaaggagaccacactggagccagagagagagccactcagaggtctggggcagaggaaatgctaagtgcacattagcaaaagcctcatgctgtagggcagtccccagcttttaaaaaactctctcagctgggtgcagtggctcatgcctgtaatcccagcactttgggaggccaggccgaggtgggcggatcacctgagataatgagttcgagaccagcctggccaacatggtgaagccccgtctctactaaaaatacaaaaattagccgggcatggtgggtgcctgtaatcccagctactcaggaggctgagacaggagaatcacttgaacttgggcagcagaggttgcagtgagccgagatcctgccattgcactctagcctgggaacagagcaagactctgtttcaaaaacaataaacaaacacccagctctctctcaaagaagtaaggaagcaaagcaggctgatggagacaggcttctgggagacccagctgctcaggtctgggctctgcctgctgtatattcacttctcctaggttctctctggcctgcctcccatctcagcttccttttttaaaaaaagaaaaggctaatctttgataaattcccacataatctgcaatgaacagagaaactctgtaggaatgacttggtgctaccccaccacagtccacatcttgggacagccgctcagcctggagcccgtactagaaggaagaatgtcgatgttaaatctctccctcattcaagacaatgtggcctcaatattagatgccttttcacctttattttctgaatgtctgtttacatctgagttcactcgtagaaaaagtctgggtgagagagtaggtcggggtccccttggccctgagaacagctggccaggcggagcccacctctggtttttctggctttgtgacagagtgaccactagggggtgacatagcctcacatgctgagtctggtgctgggagcaggttggtcctgcctgggggaaagcagcaggtatcgttcctgcctgggttttttccagtgcggttcaccttcaaatgcgcctcccagacagaagaaagctggtgttaggagcggacaaggatacctgcctgcccaggcgtttcaaaggggagttgtctggcatggaggatattcacctgcaccacgttacatgagaacctgctaagtgctgggcccttgggaacgcagcagtgaatgagcccatccctgccctcgtggggataccattctagggacaatcggtaccacaggtggaaaagtgtcatgtgtcccaagtgccaagaggaacaacagtcaaaggagaggggctgcgggggtgctgctctatgtgggcaagtcagcaatagcctctgacatggagacatttggccagtggtgagatggagccagggagaggacaggtggaggccatggcacgcctggcggaggggcccacgatgcaaatgtccggaggcaggagcagcctctgagcctgcagggagctggtcaatgtggccagaaccaagtagggagggagcaggtgctggagtgaggtcagggagtggggcggggccttgcaggagaggtcaggattccaggttttaattgagcgatacagaaagccatcggatgtcgatcggatgcaatgcagagagatgtctggctactgtgcagtaaagagatggtagagacagggctggggtgagcagtgaggggtccctgcagtggatctggagatacattagcatggtctcccgcctcctcagagacctccttcaagtcttgcccgctacagaaagccttactggattctgtttgccttgagcaatctgccagagccctgaaatatagctgttattttaagtctctttgcagtctgtgttctctcgtgataacttcctattgccttcttgtctctttaaaaatcacatattgagcttttcatgcacttgcctcttattttcccaagctcttccagttcatacctcctcatccccccaggtctatcagtgccttcggggtttggaacctttggggtacactgatggtcacccaacatgggaagaacaccatgtctctggggaccttggatctccctgctctgttttcctttctgtgggctcccagctcctagagctcaacatgcctttatccttttccctcctccctcagatggaaacagttctggcaaaaatatttaaaatagacattatagaacttaaaggtgacatagttcaggggtagttgacacatttatctcataacaaagaaagaattcctagcatcaaaaccagatgccacagattctctttttggaagcgactgtcttcccagaaccctaaaatcatgcagtggtagcttttagggagtgagacaaggtggcctttggccagctggcccccacggagcaagaaatggcatcttgtctgatgggggcagcagggcacacccagtaactgctactgacaggatcagccctgctggacattgggacattatctttgtcctactagaaaaaaaaaaaagagttgaaaatcactggcctagacagccacctactttgattacaccgaaggctactctaggtgatgaccatggtgtctggtagggacaagcacaaagcaaaaggtggagaatatactctgacacccggggaagatttacagcactgagatggtaaagcggagccgcagggcttcatcgcagcagtggtttgaaaacgttttgactgcagcccacagtaacaaatccatctgatggcataatccagcacatacaacacatcaacaaaagcccttttacgaagcaatattgaccctgactaggtactttattttcgattctattgtttcagctgctttatctgacccacacggttgatttcatgatggggtggcgggggcagtggttgcagtttggaaaacaccaccctagatggtcagagaacagcagaatgcgtctggaacgcctttgaggcgagtctggtttggggggttcttagggcacagaggatccgctggatggaagtaagtcccgggtttctgccagagatgtggaatggtagattttccccctgtccgtttccaagactagctcacaattatgaccgaggtcatgtgtattttgaacatccaaaaggaatttaattttctctgtttgtggttgaatccgaatctcccattccacatggttgacccccaccctggagcgggcactgtgtctcatcctgctgcatctggggatctttttcagaggatctgtgctgggagctgtttgaaattcgaatgagtctttcagagaagtttatttaacttgtaaaacttcaggtcctttcacaccatttcagcgttggatcacagacagctcttcctttatatcccagcaacttgagtttatttttcaaataaaagtctgttttcccataaaatgccaaaggttttgtgctttgtgtggaggaatgagcccaagcttttaagactttaatttagagcctctgagtcttgcatttccatcccaagggctcccggggctgaggagcaccccactccagcttgccccgcagaacaaacgccaggcagtggttcagcgagtgagcatcaatagggccattgtccctaaatatagagcaagaccaaaaaccggggggtcagactcgagtaattttaggactccagcatttaggcctgaagctcaccgctggttactcccccgaatcgcagcgctgaccccgtctgaatcgtctcctgcagatggccctagctcagctgtcagcccgggtcctacctggaagagggttactctccgtactaaaagcagatggagtttaatacacggacgtcacagttctgattatgtggctgcgtggttataaaggtgaggaaagagctgagacgccagactagagtttgggaagcgacccaccgatgagtaaggaaaatcctttcccaccccaggtgggagaagggaagagggcggcgctgggagccctggcggggctggaaccaggagctgcagttggtctgtctggcaggaacgggagccaaaggggctgtagctatggtcagatgttgcccaaggtgtctccctgtctcctgcccagcgggagcctggacacatggcagcaggggtcagaggtcagcccctgcatccaggcagagtaggggtgaggattgagcatgagagcagcgcaggtacccgctcgcctggaggcaccactgagtcgttgcgtgtgcctgagccatgtgctgagcggggtgcccgagatgcacccacaaatccatctagggtccctcccagcattgcaaggacaggaaacctttggtgcctcagaggcagagaggttcctggggaagctctggtggctcctacgttaaaaggaacccacacttccttcgttgcagtcacgtgtgtggtgtgtgttcctggggcattgctcacatgacctgtacgtgagtcattttactcctcactttcagggaggccacaggggcctgtgggactgtaccgatggtgcagaggcgagacctgctttgggggcagagggacctgtggctgccggcatcactggtggtccagggggagaggcctgagaagaggaggagaccaatgggggatgggagaggaggcgggagagggcagtggaagtatttgtgtttgcgcacaggtagagacactgaggacttttctccacttccacctgggagggccccgcagcctcctggaggaacctcatggtgtgcacaggtgatttatatcattaataccaaagaacacgagcaactgctaaagtgagttgctttaggcaccggggtgaaactgggaaggctcgtgaggggccgtggcccccgtgagagtccccttgctgccttggaaatgactctgcccagcaaggagaggagtctcttcaaacagcagttgacaaatgtttcctgtaaaaagccagatggtaaatgtcttagacttcgaaggccacgtggtctcttttgcaactacgaagccatagacaaagtataaactaatggtgcagctgtgttccaataagtatttataaaagcaggtggccagcaggattgggccattgggtagtaatttgccaactcctgtttttaaaacataaatcccatcatgtcatcccctgttcaaccccttgacgccgccccagcacatttaaatgaaaactccaagccccaccacacatggcctctgaggtcctctgaggtcaccctgggctggctctgactgtgtcttgtgcacacccaccccctgtcttcctctgctcaggctcatgtcccctaggccctctgcctgaaacaccctgagatgctgagcatgtcccctaggccctctgctagaaaacaccctggagccagaacacccttgaggctgtgctgtgccgtgcctcccagattcccgattccttcaagaatgaggaactcactcccagctgtgggtgtgacagacagatggccctcagctaaggagcaccacctcgccagccttcagcccctcccagagccggcctacgcccaataaccggccgatgtacataaaggaccagcccccgacccccgctcaggacagctctgaaggggcatccgggcttcagaactctctgtcggggcttcacggggtctccatcgcccctttgtcaggcccaagagcactccctgatgtacatccaacatgctcatttccatcccagagcctgcctctcagagagcctgcagcgacccttcctgcagatagacacaggtggggtcccttccttcaggtcgctgctccaactttccaataccacagtggccttcggaaggaagggaggcaggggaactgaggggaccgcgaaggtagggcctggagaagtgctggggagtgaggtgcagctcgaagtgctggagagtgaggtactcgaagttagggcctggagaggtggtggggagtcaggtgcggcggagggggttgggtgggcgggagaacagggactatatgaagccaaagcccagcctccctcagggctgtgccctgtgagttgtacaaagggccctgggtctgtccccagatgttgccatgatccagaattactgtgagctttaccctgtacccgacaaaaaagattgactctggcttgcccaagtctgcccctaagccccagtgctggcccagccaacgcgggcaccctgggccccccgctcactggccacagctggagccttccggaccagggcagctgatgaggtctgaatactggggctgagcagactccagaaaaacgtgactcatcttgcctgcccacaaagaaaggaaaagtatgtgcggcatccaagtttcctgaaaagttcagccaacacattgcagagttatgtggcctggcatcccgtgtggtccctggggacagcgccctctggcgccagcctggaagacgtccccagccagggctggcctgcacatcctgtgtccaggctgttattatttgggagaagccaacgaaaaattcccggaagaatctccttgccctcagcgagttagagtcctctagttctctcagggcctgctttggtgatgctcccaccttcggagacagtaaaaggcagcactaacacatgctcttacttaacacacaggcccactgtagctctttttctttttttcgagatgcggtcttgctctgcctctcaggctggagtgcagtggtgcgatcacagttcactgcaactcaagcgattctcctaccccaacctcctgagtagctgcgactacaggtgtgcaccatcatgcccggctaatttttaaatattttgtagagatggggttttgccatgttgcccaggctggtctcaaacacctgggcttaagcgatcctcctgccttgacctcccaaagtgctgggatcataggcacaagccactgctcagcctgtatttcttaattccttttttaaaataacactttagggctgggcgaggtggctcacgcttgtaattccagcactttgggaggccaaggtagtggatcacttgagcccaggagttcgagaccagcctgagcaacatggtgagactctgtctctaaaaaaacaattattaaataataaataacattttattttgacaatttcaaacataaagtcacaaaaataatacaaagagttctcatatccttttcacccagattgcccgatgttagcatttcaccagatctgcccatatctcatttctcacgatctctcactgtgtgtttatatgaattctgaacccctgagaggaatttgcagacatcatatccctttacccctaaatatttcagtggatgtttcataaaaacagggtcattctcctaaccacagtataattgtcaaaatcaggaaatcagcacaaatatcatgctatcagctaagctgcaggcttcattcacattttgtgccttgtctcaggggcgtcatttcttggaagaggagacctccagccacgcgttttgtttcgttgtcctttctcttcagtctcttcatctggaacagctcctcagtcctgtctcatctgtcacgacctgagcacttttcaggaggacaacggccagttcttgtgtcacctgcccttcgacatttcctcaccatcagagccagcctccgccctcaggtgggcacccacccatccgtgggctgccctgggcttctgcatcccagcagggtcacccgatgcggccgcgacacctttccggtgaagtggacgccggtcacttggtgaagggggcgtctgccaccataaagttctctactttaataaagggcttactttcccccttgtcaccagtcagggcttcagggggacctactttgggattgtgtaaatgtcttctttctcatcaaactttcacttgctagttttaggattgatatgtatttcttgcctgaattgttactatagtaattaccaaaaggcgattttctaaatttatcatgaattctacattgactggttggaatgctactttaaagaacaggtttttcttctctccctgtgtgtgtatgtatctatggactcatggatttgtatcctattcagtgccatgttatttctcattatcaaatattttaaaaaatttttattttaggtttgggggtccatgtgaatgtttgttacatagataaagatgtgtcatgggggtctgttgtacatattatttcatcacccacgtatttcatcatgtattaggctcagtacccaatagttatcttttccgttcctctccctcctcccaccctctgcctcttaagtagcccccagtgtttgtcgtttctttctttgtgttcgtaagttcttattatttagcccccactcataagtgagaacatgcagcacttggttttctgttcctgtgttagtttgctaaggatgatcgcctccagctccatccatgttccctcaaaagacgtgatctctttcttttttatggctgtgtaatattccgcagcacatatgtactacattttctttatctggtctgtcattgatgggcatttaggttgattccatgtcttcattatcaagtttttgatgctcaaattgtcctagacgtggccagcaggagcctctccaggcggatcactgtgtcctttgactttccccatcatatccccaccctgtccccatcatgctgtgggcacttcctggctttctggctgatcttgtacattcctcaccccagccctggaattagccattgctctaaagagcccttgtcacttttagtggcaaatagtgtttacgtgtgcatgtcactcctggggtgtcattgcttctaggccttctcagcagatgtattagagacaacctaaacacccacatagaagagagtagttggccaggtgaggtggcttacacatgtaatcccagcactttgggagtctgaggcaggaggattgcttgagctcaggagttcaagaccgtagcgagaccctgtctctaccaaacaaacaaacaaacaaacaaacaaacaaaaatagctgggcatggagacatgtgcctgtcgtcccaggtacttgggagtctgaggcaggatgatcacttgagcccaggagttcacggctgcagtgcgctgtgattgcactgcactccagtctgggcgacaaagcgagaacctgtctcaaaaaaataaataaataaataaataataaatagagtagttcaatgaaataaagaagttacagctacatagcagagtaccatgtagctgtaaaaaaaatatggcatctttgggccgggcgtggtggcttactaaacctgtaatcccagcactttgggaggctgaggcaggcagatcacgaggtcaggagatcgagaccatcctggctaacacggtgaaaccccgtctctactaaaaataagtaaataaataaataaataaaaattagcctggcatggtggcgggcacctgtagtcccagctacttgggaggctgaggcaggagaatagcatgaacctgggaggcagagcttgcagtgagctgagatcacaccactacactccagcctgggcgacagagtgagactccgtctcaaaaaaaaaaaaaaaaaggaatctttgaatcagtatggcaaaagacatgcctaggcaatcctcaaaagacatgaaaatagccattagacaatagcatgagcatacttagtcatcattagaaatccagattgtagaattaatccatattttcctttagtatttgtaggtttaactttttttgtggtaaaatgcatataatatgtaatttagcaccttaacaaattttttttttttttggagacagggtcttgctctgtcccaggctggagtgtagtggtgccatcttggctcactgcaacctctgcctcctgggcccaagtgatcctcccaccttagcctccttagtagctgggacgacaggaacataccactgtgcctggccaccttaacagtgttaaagtatataactcagtagtcacagtgttgtgcgaccatcaccccaatctagttccagaactgtttcatcaccccaaatggaaacctcacatcccttagccctcaatctccattaccccttcccacagctcttagcagatgctaagctgccgtctgcctttctggacttgcctattctgcatatctcacagaaacagaaccccatgacctgcgggcttctgcatgtggcttctatcacttagcagattgttttgaaagtcgatctactttgtggcatatattggaatttcattcctttttatgcctgaataatattccattgtagaatagactccattctgcttactcagtcatccactggtggccatttgggttgtttccaccttttgtgaatagagctgccatcaacgttcatgtacaagttgttggaacacccgtttgcagttctcttgggtatatacctaggactgcaggttctgggtcatatggtcattttgtgtttaacttgttgaggaatgttttccacagtgcagtgttttacattcccatcagcaatgtatgaaggttccagtttctccatatccttgccaacggttcagttctttttttttttttttttttttgagatggagtcttgctgtgtcacccaagctggaatgcagtggcaccatctcggctcactacaacctctgcttcccaggttcaagcaattctcctgcctcagcctcccgagtagctggggctatgagcatgtgccaccatgcccagctaatttttatatgtttagtggagatgggatttcaccatgttggccaggctggtctcaaactcctgacctcacgtgatctgcccacctcggcctcccaaagtgctgagatgacaggcatgagccaccatgcccgacccagttcttttccttttttttttttttttcagtgtggttgtcctagaggatgtgaagtggtctaccattgctgttttgatttgcagttccctagtaaagtttagcatcttttcttgtaccttttggccacctgtgtgtcttctttggggaaatatttaatcaaggcagctgctcatttttttgattggattgtctttttgttgtagagttgtagttctttatgtattctggatactagacacttatcagatatatgacttgcaaatattttctcctttcctgtgagctgccttttcactctcttattattgtcctctgatgcacaaaaatgtttcataacagcagagttttgatgaccaacgtcaccttcatatgctgcttctctgtacctggcccatgtagacactgaacgcttactgaaatggaggaagcagagagagtgagggaggtggataccggggactacagttcactgattcaaagaaatggggcatcaggataggctgatggacgggggactgtctcattgcccctccaggtgtctgcttgctacaatgtgaaaggctgactcagggtctaactatccctttaaagcttctagtgaggagagagaaaagatggcaaattctccgtagcctccttttctgagtttgatctttggatggatggttaatccagttctcttgcttaaccgcatctcttctgctttgcagtgagcacagtttcttttgagcatctcctctctggagacatctggcccgtgggcctctatgaggaaaaccgtcagcctcttcctcaccctcggaggctccaaaacacccaggccagccccatgttgcctaaagcccagaaaactgtgttttaaaattttggcgaatgattagcaaatactctcactgtcgtcactgggggcaggttgggtgaaagtgcccagctcatctctctggctgcgggcgcggcggggcgaaggccaggtggcacggcacggatgttctttcctccttgccgctgctgatgacggagttttgcaaccttttttatttttattttagcttttgccaaagggagtttttgagaatgtaccttgctgatttttgtctgctatagatacttatcaccatttaccagattttttttgttcaattttctcccctttacattttaattttcagtgaagtagttcaatcgcatggttaaaaaaaccaaacattccaaaacaatttatattgaaaagcagtagttcccaccctcctcaaccaaaccccaaaagaagcctttaaaaatcatatgcctcgtcaactattttatgatttatcagtgttaaaccttgtatgttgacgtcctattaaaatggaggggcagataattcaatgtcccaccccacaccttcccagttttccctctgctctcttttaaaaaaatcaatcttttgaaaattaccccctaaaatgcctttctgacttttttctgataacctctatgaaattttaataaaacagatatactatctattgtttacattgttacatatactatctattgtttacttatactgtaagtatagctgttccttgtatataagaagtaagatttttggctggttacagtgactcacgcctgtaatcccagcacttagggaggccgaggtgggcggatcacttgagtccaagagtttgagaccagtctgggcaacatggtgaaaccccatctctacaaaaactacaaaaattagccaggcgtggtggcacgtgcctgtagtaccagctactagggaggctgatgtgggaggattgctgagtctgggaggtggcagttacagtgagctgagattgtgccacagcactcaaccccgggcaatagagtgagaccttgtcccaaaaaaaaaaaaaaaaaaaaagtaagtttttttgccccctccaagaggtgattttcacccccttagccccactgagagtgatgctataaacagaaaagaatttgaggtgagtgatgtccgtgaatgtagtaacatctgacatttgggataaagccaatctgaaagagtgaacaatcaagtggtagaatgacttttgttttttgttttgttttgttttgtttttgtatcttgccagtctcaaggaatgaacaagccacgtgagctaactttctagatatctggaacttaagccatcgagtaccagagcatacatcttttttaagtgtcagatgcattacatactttacagtttttttgtttgtttggttggttggtttttttttgagacggagtctctctctatcacccaggctggagtgcagtggcgcaatctcggctcactacaaaccccgccttccaggttcaagcgattctcctgcctcagcctcctgagtaactgggattacaggcgcccgccaccacgcccggctaatttttgtatttttagtagagacggagtttcaccatgttggccaggctggtctcgaactcctgacctcaggtgatccacccacctcggcctcccaaagtgctgagattactggcgagagccaacagttttcttattcaaaagataccaagtactgtaatttcactctttatagatgagtcaggttcttgctagatcaccctatatgcgtcaacacatccagcagcagccactgagttatgagaacaaacttctgtttgaggcaggatgtctgtgccctctgcccgagttctgctcaccctctctgtctccttccttgtgccactacctgctctgtggcagcccatgttcctgccttgaatggtacctaccctctcccccgccccatcacaatttgctgcgaataaagttttcttagtatgtgtggttaaaaagagtaaattgttactgagaaaatcccttcattcctcattcaggacgtgaaatgctggggctttgagcactgggctgatgagcagggctttgtccaattccttctgatttctctgctgagatccagagcaggttctgccaaggtgtggagctcctattgcaagtccaagcgctgcctggccaggccagaatcgtggagcccagcgctctctccccaggctccggccacagcctctgaattctcagcatggtgcccagcagccgtcccaggagcagccactggagcaggcggccttcagtcctcacccaggctttccgcagctgttcacgcgaggtcctttcgggcaccttgtgcctgagctagtggagctcctgagaggctgctttcagggacagagaatggccatgtcctctgtttgtgaaatgctctgcagcttacaggatatttttgctattctgtcttatttaatcaccttgaaaccctgtaaaatggtctctcttatgggagaaatgtggaagaataaactaaatggctcagaattgcatgccaatgggtgaacctgtgttgctttaaggttctctgacctaagtgttttaaacctttctacctgttaccttgttttgaaatatatttcactataagaagaaagagatctgaggcaaacttcagctcagccctcataatctaagctaggggcttcttaaggagtgacgtgcaggaggaggtggattgctctgtgaccagcccaggtccagacactggaaatcctgccccatcgcctagaagtgagagaccacaggccaaactggctttccgctgagtccgggagttaaccgggtccttctccaaggcttcggtgcattcccagctcacttcagcacttgtaagagaattaaatcacttaaagagaattaaacagaaaacccaaatggctggcctgcagagtttcagaatctggttttcagaagccattgcttggtggcccccgttgagcccagcgctcagcttctgcgccacggagcagctggaatcagggcaggttcttgccgctggagccctcagagctcttggcctggtgtgctcttggacactgagcgactgcagggttgccaggcaccacgagaagggactgaaaagggccccaccgagccctccatgggggaatgcgatgccccttccagattttaaggagatccagggatttcttactctttgggtgctgcatttcggcatgctaaaaataattattgctatcgtttttcacctttttagtacttctctgtgtttttaaaatcaagatgcccctgttgcctctgccagttctcagtggccttagatatcgctggtgtgagtggagctgtgtgagctgaggtggtttgtctctgccaaaaaaatcaccctcttgtcactcagagactcaggctccagttcctgtggtcaccacgaggctgtgcatgaccatgagtgtgtcgggctgacgtggaacagaggcgtgggggcttgagtcagggcagagggtgctccgcagaggtgccagctcataaacacctcctggggcagggcgtggaggccccagtgaggcgacgtggcgatctcagagtcaagtgcagcagtgacctttagaactttccatgaaacatgacacagtattttgcaaccggcaggagagctctggcaaatatgtgctaaggcgtgttgctgctccccggcgcggaggggacccgtgccctcttgcataatgagatgtggtttggaacgcagccgtgcaggggactgggtgctttgcaggtatggcctcgtgatccgcaaaggttcaggatgagcgggaagtttttgagtagtgcatcctcacctgcttctgcagccgtccacccatggagcagaggcagcctggctcttgatggccccctgatgaggaaccagcagagccagtgtcgacccccacaatcccacaagctgcccacggatcctgggcaaatcactgagcacctctgaacttctgggtttttgaaaaatgttatttcttgaactgaatagtcatggctggcctccctaccacacagcatggttgagaagaatgtaggaaactgctgcgggcaaagtctcccagctctgtacagccgcagggtgtgggtgactagggttccccctgccctgctctgctggtggatctctcggtcggccgggctgattctgcctgcgcggtgctcccaggcctcagcagccctgccctgggaagtgccagtctcatgaatgaatggaggcgcatggagggagggtggttacacggagtctcagtgacttttctctcatatgggtccccagtgacagcttcaaggagactatttgcagcttcacataacatgcaaagtggctttgatgagacggaaagcttggggtcttttcaaaaatttggttttgatataattggaagtccagagatagggtgggcttcaaggggcttgatcctgtaggtattcacaggctacctggagtaggaggcagctcggcctgatgacgccctcggctctcagatgcccactgcagtggtggggtgggggacaagtggaggctaggcaccaaccatggtgtctacaacggagacccagagtcccattcaccaggcgataaggctggggtggggctccaacctgcagcctggaccagcaccacgttagtgggacaacatgtgccacatgtcctggcacttccccgatgccgtgggaacgtggccccggggcaccggctgagaacctccagcaattaaagggtttactcgcatgttttgggtcaccggagtctgggggtgggggttacatatcagagccacaggagcgccattgtgtctcttgtggaagggtggtcgccttcacgccacttatcctcatgtgcaggaagcaggggtgaccgtgctccatcttcgagcccatctgcagttcccctgacctctccttcctcatctctctcgcccccagctctgctgtgtagtgcacagtctggctgtggaatgttttgcagcatccagatgtgggggggctggcacacctggtaaaatccaagtattagagtgaacgggacctagtgccatggcctcccgcagcccagccctggctggccaagcctggagccctgccgagggcagaggagcagtcagcacagcctccctggctccagaacagccacaaaagcgtcctccaggaacaggacatgctgctcccagggatgccgagcatggagcagcagctggcttgctgttccctgacccatcatgctgctcctgagtctcgtggaggaactcagtaatcgctccttttctttcttctgcgggtgagatacctgtcatcggggagctttcagtctagctggggagaaaattaaaccaaaagccagaaaacaatgaagcatgctaacagtatgaaatgccttgtggtagtattcttccacactgttttctttttcgagttgtcaaaggtaggtttgtagtcagaaatctaaaagaacagccaccagaagacacacgtaaagaacacacgttgaatgagctgagctctgatttcactccctcccagatcttataaacctagtgtcagaatggtgacctggaagccttggccacacagcacggggcactgctaagagataaaggcatctgccacccgaattacctggtcccgtgccaggctttgggttgcagcaccagccaggggtgtgagttttaaactgtgatccaaaaaggccctggccctttaaaaatacattagaaaatacggttcctatttgggagccattctttccttcctttttcagcccctccctttaaaaaagaattctgagtgtgaaaagcattctgttagaaggaactctgagcagggtcacagttgtggcagggagtttcccctctattcatgtgggatcatcgactggcggaaacagaagaggggaaggtttggtgtccccatccgcctgtgagtggtcaactttcccccgcccacgtatgctgaagaagggtcctcagcccctgccctgcaatgggaaggcgccatctctcccaacgcatcagcgttcatctctaatcgtgggatccaaagctttgtccctcatgtaaggaatttcaggcatgtgtgagtcaaacagaaagaccccagcagtgaggagttttttgtgccccacctctgtgctcagccacctagaagtggcctcggggaggaagcagccggctttgtgcttccagagtacggtgtacccacaaggcaggtcagcttgttgtagcctcctgactcgtctggtctgtgttgcgaggtggctttaatgcaaataaggactttttattttattttattttttttttttttgtgagatgtaatcttactctgttgcacaggctggagtgcagtggcacaatctcggttcactgcaacctccgcctcccgggttcaagtgattctcctgcctcagcctctcgagtagcggggactacaggtgcgcaccatcacgcccagctaatttttgtatttttggtagagacggggtttcaccatgttggccaggatggtctcaatctcttgaccttgatccacccgcctcagcctcccaaagtgctgggattacaggcgtgagccacagtcaggatttttaaacatgcttcttcttttgcctttaaatttcccagcctaaaatgaaaaatcaggatgtagagagaaattcttttccaaatcccttcagtccacagcggtcctctggagtcctatgggattcaggctagggtattgaatggctgctgaattttcctgtgcacatggatgagaaagtatggtatggtggaaggatgtgaatttgggaatcgggtccacatgaggggacaagtccatcttctctcaacttaccagctgtgccatccaggtcaaactacttctctgaccctcagttattcaatttcaatgaaatgttaattatacctgccctgctcatgtgtgggaaggatgaaataaaataataactgtaaggtgaccagcaccccagctggcatatggtaggcattcagtaaatgttattatgttacaaataaaatatggttcttagaggacaggaatttctccgaattatttgtagcacctcatcccttcaatcaacaactgccctgcacgcttactagaggtttaataactacctgttgaatgaatgaccatttaaactcaagcacggaaacgtcaggcctgcctaagttgctggttattttccacacaaatttcaatacatttacctcagtcactaaactttgaaatgttctttttttttttttttttgagacagagttttgcttttgttgcccaggctggagtgcaatggcatgatctcggctcatcgcaacctctgcctcctggttcaagcgattctcctgcctcagcctccctaatagctggggttacaggcatgcaccaccatgcccagctaattttatttttagtagagatgggttttcaccatgttggtcaggctggtcttgaactcccgacctcaggtgatccacctgcctcggcctcccaaaatgctgggattataggtgtgagccactgcgcccggccttgaaatgttctttctgtccgttgtattatgtagtgtaagaatagtacactggctgaaacaaaaccttttcattttccttttaatcaaatctgcctctttcttattgggatacttgttcaggtcttttcctaaagatgttttgctttgttacttttattttattttgttttattttattttttgagacagggtctcactcagttgcccaggctgatgtgcagtggcaggatcatggctcactagagcctggacctcccgggctcaagcaatcctcccgcctcagcctcccaaagtgctgggattacaggtgtgagccaccgcaccaggtgttattttatttttaaatcgagaaaacaatttttgttagaagctgatttttaaaaagaaaaaaagacatctaaacatgaaactcctaaacttacctacttccagaatttaatcacagttaagtttgggctaccatatttaacagcagaaataatccatcagtatatcaggggacctagctggcggtagatttcgcggcttgtttgggaaggctggggtcccctccggcattgatttggcctggcctgggttcccccctcttcttcacaccctccaaccctgaaggcccatctcaagttccccttctccgggcagggccacacgggccttctcctctccttcctttgtgctgacgacacttgcagccacggctcacatactcacggctttttcatgcagttagcattgtttatctttgtctccagctcatttgcaaagtcactgagagcaagacctattttgtgtgttcattcatgcatccttgctacaaatatctgatccccgtatctatcagtcagtcccagcaggagaaaggaggcacactgaactttttggatcactggaggagaattgaataaagacactactttcaaaggtgtgggcaggctgccaggaaccccctaggactggtgcagtaactcgggttcgtatcagcagggctgctgccactgctgtgcctgaaggatgaaggagagggtccctgacccaagacagaggtctgagggagggtttctctgagaggagctgaattcttcccttgggagatgacacagcaaggccagagcaaccctgcagggatgtagggagctatgaaagcctcaactcctccctccttcgggcgtctgctgtgcccactgttggctgcagctaaccagcagcccgggaggaggagcctggccaggtagtccctccagtcggctccatcagggagcaggggcagctggagggaccgcaggcgttcagggtgactgtccggtgcctcccaaagcaggtgccttgctgtaggcttgggagatcctcacaacgggtgaggcctgggcccctatctttttggggttcccagtcttctctgtggtaagggcgacattcacatatagaatagaagagctaaaatctttcaaaggagagaaaagtcccctctttggggagtgatgagggagggctcacttgggggaaggcacggtctctggattgggccgtaagggtttcatggggtttcagcaggcagagctgaaaaccacgggcttaggaggcagggcaaatggtgtaagcgaaagcaggtaggttagaaaattccagccgggtgtggtggctcacacctgtaatcccagcatgttgggaggccaaggcgggtggatcacttgaagccaggagttcgagaccagcctgggcaacatggcgaaacccccgtctctacgaaaaatacaaaaattgcctgggtgtggtggtgtgcacctgtagtcccagccacttgtgaggctgaggtgggaggatcatttgagcccaggaggcggaggctgcagtgagctgagattgtgccattgcactccagcctgggcaacaagagcaaaactctgtctcaataaataaaaatagataaataaataaataaataaataaataaataaaggctgggtcatgccttataggactccctgaccttacaacattcagcacagcaccaagtagacagttgttactcagtcaatttggtagaaattgcatgagaaaagttgagaccatagtttcttgatcggctaagcaatggtatgactatgaggtcattctagacagagatgggtcaggtcccctaggcaggaagagcacacttacacatctttaataggtcaggtccaatcacgtgagcagttgctctaccagtcgatgggatctgaaatgctagaaccagctccagctacaccggagccatgccggggccgagcaggcttcttgggagctggtgtgtgtcccctgcagatggaggctaccgagaccagctcagctggggagacccgaacccggttggcttctgtggatggaggccccatgggagtggcagatctggggtgggagctgagcttccagggtttcatctcacggggatagaatggaagacttcccttggccctccttcctgttgccctagcctggagccatctttatctcatcaggcatctgcagtgactgggccaacaactccagtggtactagaggaattaaagacacacacacagaaatatagaggtgtgaagtgggaaatcaggggtctcacagccttcagagctgagagccccaacagagatttacccacatatttattaacagcaaaccaataattagcattgtttctatagttattaaattaactaaaagcatcccttaagggaaacaaagggatgggccgaattaaaggaataggttgggctagttaactgcagcaggagcatgtccttaaagcacagatcgctcatgctattgtttgtggcttaagaatgcctttaagcggttttccgccctgggcaggccaggtgttccttgccctcatttccgtaaacccacaaccttccagcttgtgcgttagggccattatgaacatgtcacagtgctgcagagattttgtttatggccagttttggggccagtttatggccagattttggggggcttgctcccaacagaggccccatggcagtggcagatctgggcatctctggcttctgtggatggaggccccgtgtgagtggcagatctgggcatctctggcttctgtggatggaggccccgtgggaatggcagatctgggcatctctggcttctgtggatggaggccccgtgggagtggcagatctgggcatctctggcttctgtggatggaggccccgtgggagtggcagatctgggcatctctggcttctgtggatggaggccccgtgggagtggcagatctgggcatctctggcttctgtggatggaggccccgtgggagtggcagatctgggcatctctggcttctgtggatggaggccccgtgggagtggcacatctgggcatctctggcttctgtggatggaggccccgtgggagtggcagatctgggcatctctggcttctgtggatggaggccccgtgggagtggcagatctgggcatctctggcttctgtggatggaggccccatgggaatggcagatctggggtgggagctgagcttccagggtttcatctcatggggatagaatggaagacttcccttgccctccttcctgttgcccgagtgtggagccatctttatctcatcaggcatctgcagtgactgggccaacaactccagtggcactgagctctgtaaatgaaagaggtgagagaaaaggcatgaaaagcagcccaacccaagttgggaggctggacctgtggttcctgaggaggcctgggctccagtggcaagctgctggggcgcttccaccccacactccatccccttgttttcggacgagccgtagataataacaattccgctgaagaaactgatggcgttgcagttttgggaggttatcccaccctagtgggcggccagaagaacccaggctactaatctttagctcgggggttatttaactggtctgacatagtctcctcctcatgtgcatagtcatttgggaagaatcagttaccatgagaggttcagactgttggaactaggctaaatctctctttttttttttttaatagagatgggggtctcactgtgttgccctggctggtcttgaactcctaggctcaagccatcctcccacctcagcctcccaaagtgctgagattacaggcgtgagccaccgtgcctggccctagactaaatcctaaaatgacctggtcttgtcttagttcactaagggggaaactgaggttcagaaatgggaagtaactttctgatggtcacaaagctggttagtagcaaagcaggtaactttagtgaggctatcagacaaaaagtcaaggattttttttctatcttttgcttccaaagtttgttttattggttgcaaaacatatacaaattataaatgttttaggttttacttgatcagcggtttggcttaggagtcaaggagattagaactccagtcctggttctaccattggcgacaggatcttggggaagtcacctccctgtcctgagcctgtttccccatctgtcatagaagggagttggactagatctctctaaaatctcttccagctctgtcatgctgcaattctcagcaagtccagagctcaaattacgcatttgccgaagaccttccgttaaattccagtcggggagctgtatcccctccttgaagacggcattgctgctttcattgagtggaaccgtgagccagggtagattcagcaatttccagcccagggacttgtgtggcttctccacccggcagcagccggagccttctgaccccgtggggccctggaacccatgaatcaaaatagttgtgtgatgtcatgtcacaatgggaatgtgctctggccaattggtgccaagaattgtctgcccagggtggtttccttttacagtctgtttaaagagacatcatgcacggctgcacatgacttgcaggcttgtgcctcctttgcctatctggtcttccctcctttttttaattttaaggagaaaaaaaaaaaaaaaaaaagccctggagagtatcagtgagcagctgaccttaactacatcaacaaatcccctgcgaagttctgtttgcgcttccggcagcttcttgctacttaaggacagccgggctgacgctccagctgctgtggccggaggtgcagccccgtcaggacggctccactccctggcgcctcacagactctggggctgcggtgaggtcgccctgaagaccccctggtgaggacgcttgaacccgggctgtcacctgagcacaggctgccactctgagcttttggggcgccctgtgcctgtcgggctgatgctcctctggctcccggccacctggggctgacaccggttctgtgggtcctgatatgttcacctgtcgccactcctgtggccacagctacccatgaagcgctttgggagcctcaggagcaacaagaaacacaaggaccaaaatcgaagcacggagaggcgccagtcggagcctcatggccttttcggtaggactctgcccattcccgagcccctggtggtctgtccttgggagggaaccccacggcgtgtgtgcacaccctcctaagcagtagctgtttccagccactctcttccaactgggatataacatcaggcggtggttagaggaatacgtgggaagtgtttccttgctgatggcagtgctgctgtggggagccgcctgacaatactctttctgaagctgtttcctttcttgccccacctggcccagggaggctagtgatggattggattgtcattcatttatgcaaaaactgtggctcaggggaaaagtaagagtggatgggcactgttgttttcagctgttaaaaatgaaacatgcagtttagaggaaactattggaggtcaggaagagagaggtcttcttcccaggttccgtagcggagtaatctgacagatcgtgggctaatgtgggaggggaaacacctgcctaatttgtgccccatgaggagaagcttgcattgtggtctccctggtctctggcaacttctgcagctcctccatgtacaggaggatggggtcagggcaagtggaacaggtggtgaagcatctgtggttcagtattttcaaggacctgcagacttggagtgggttttgcccttgtctgtctgcagccacacaggtcgattccaaagctttcttagctccacacctggttaagacctgcccactcaaaattagatgtcagatttcatttattaagaatcagaggccgggcgcggtggctcatgcctgtaatcccagcactttgggagaccaaaacaggcggatcacctgaggtcaggagttcgagaccagcctggccaacatggtgaaaccctgtctctactaaaaatacaaaaaattagctgggcgtggtggcgtgcgcatatagtcccagctactcgggaggctaagacaggagaatcgcttgaacccaggaggcagaggttgcagtgagcccaggtcacaccactgcacttcagcctgggcgacagagcaagactctgcctcaaaaaaaaaaaaaaaaaaaaaaaagaatcagatttaggctgggcctataatcccaggactttgggaggccaaggaggaaggatcacttgaacccaggagtttgagacaagcctgggcaacataatgagaccttctctctacaaaaaaatttaaaagttagccgagcatggtggcacatgcctgtagtcccagctactcaggaggctgagatgggaggctcccttgagcccaggaggtcgaggctacagttagttgtgattgggccactacactccagcctgggtgacaaagctagaccctatctaaaaaaacaaatcagagtcagcgcattgccagcgttactgcttgcatggcataggttattcctgaagagcccactgcaagatggaacagcaggacccctaccccagtgctgttatttatcagctgagtttcaccagggctggggagacacagcctaggggatgagtaaaatgaggagcctggggggtgtatgaagccatgtcccctgaccggaatgtgatgtgttaagtggaaaaatattgtcattatgtgtaacagggaggtgactttggcaaaatgtctgaactgtaaatgaaaactggaagagcagaaaaagaaaaaggtaaatctaaaatctgcctgtatttcttgctatatccgctttgggcagctctcctggaagcgtctgcaggctcagattgtgctgagtcctcgggggagagcaggtgaaggagacagcagtccttgaacccagagagtgttcaatcttgtgaagaagaaagccccataaagagaactagagagcggcgtctaatcgagtagagttccagctactcaggaggctaaggttgggggatcacttgtaggtgaatgtaggccaggtgcggtggctcaagcctgcattcccagcactttgggaggttgaggtgggaggactgcttgagcctaggagttcgagaccagcctgggcaacatcatgagacccctctctacaaaaaaataaaaaattagccaggcatggtggtgcacacccatggtcccagctactcagaaagctgaagtgggaagatcgcttgagcctgggaggggaggctgcagtgatctctgatcacatcactgtactccaggctgggagtcagcgcaagaccctcaaaaaaaaaaaaatggtgactgtgcacgggaataggacacccagccctgagcagggagaggagggatggaatcctagacgggagactcactaacacggtctaaaaagatgacttttatttaagtaataaagtaataaacacttatctactgtagaattaaaccagaacctattattaactaaaaatctggttttgctaatggggatggacaggcccattattaagagcctattatgtgccagacagtggcttcccgccttgtgtttaacggttggctgtcatcctgtctcctacgcttctgacatcaaaaacaatgtttacatctcaaccaagttttgtaagagcctggatgcagatgcaagctctgaccacagggtcaagaaaatcggaggtccctccagagccttcctctggaatttgggaaacagcaagaggccatagcccctgctcaggctaaggctcctcttagtgggctggagcccagggacctgggttgatagtatgtctgactttggttagtgtgtcagtgagaagagccaagagctaggctgggtgggaggcgggagccctgtgccccacagacagtgttgggcgtggatacactgagtgaggaaaaacagtccaagagtgttgaccaagccctccctcccaagcctgtgcctgtctaaaccttacccatttctcaagacccagctgaacgatcactgtctagaaaaccaccctgagggcctggcacggtggctcacacctgtaatcccagcacttcaggaggctgaggcaggtggatcacctgaggtcaggagtttgagaccagcctggtcaacatgatgaaaccttgtctctactaaaaatgcaaaaattggccgggggtgttagcaggtgcctgtaatcccagctgctcgggaggctgagacaggagaattgctgaaacccgggaggaggaggttgcagtgagccaagattatgccattgcactctagcctgggtgacaacagtgagactccgtctcaaagaaaaaccactctgggtgccttttctgtgatctggctgcttgtgaacaggggcgatatctcaggagcacggtctgtagctctaaccctaggtcttgcagcatcgcaggttctccataaaaaccgctggctctgcgatagctggaaaacgttccagcccagggttgctccctgttctccaagaaggattgcttcagggttttgtgttttaaattccctctcagcaacgccctctccttcatacagttattcccggagatagaatctcagggctgggttcggtggctcatgcctgtcatcccagcactttgggaggcggaggtacgtggctcgtttgagtccaggagtttgggaccagcctggacaatgtggtaaaaccccatctctatgaaaaatacaacaattagccaggcgtggtggtgcatgtcggtagtcccagctaattggaaggctgagttgggaggattgcttaagcctggggaggtcaaggctgcaatgagccgtgatcatgccactgcactcccgcctgggtgacagaactagaccctgtctcaaaaaaaaaaaaaaaaaaaaaagccaggtgctgtggctcatgcctgtgatccaacactttggtaggttgaggcaggtagaggagtgcttgagcccaggagtttgagaccaacttgggcaacatggcaaaactccttctctacaaaaaatagttagttgggtgtggttgtgtgcacctgtagtcccagctactggggaggctaaggtgggaggatcacttgagcccacaaggcagaggttgaagtgagccaagattataccactgcactccagcctgggagacagagtgagacactgtctcaaaagacaaacaaaaatcttagatgaggcctcttctccctgagaaagcttctgtgagggtcatgaaatccctgtcattgacttctcctccctcctctccacaggaagcccacctaggctgttggcacaggtccctcccatccactgggtttcctctgtggctgtgtcagtcttttccaggaaccacgggctcctctgccttaactcagcatggagctgcttccccagggacaaggtgcacactgtttatctgggggcttccctgcagttccccgggtcaagagatacacactcgcacacacatgtcatgtacctgtgcgcacacacacacacagagctctccccacagccatcaaatcaaggccctgcagcccccggaatcaccaggtccattcgtaattgcggtggatggcatttccactggaaagcctgtggctgtcgctggaaatgttcacccgctggccttgtgacagagccccctggaagctctgactcaggagtgctcagcccttacccctctctggctgcagagccaggcagggaggccatgtctggcacagaagggaagctccccacctctccagctttcaggctccaggcgctagacaagtgacgagcttggctaagcctttctttcggcctctttggcaaagagaaatccagattatgtcgacaaagggtatgtggcaacaataataaaaatgtagagggaagattaggaaaggattatgctaatcagatcaaagagcaatgactgtagtagcgctttcaccctctgcaattacagggcagtaattaaataaaaaccatttagcgtcttaagggctcatttctgaggccagcactggagccaggagtccaagcggtgtgtcaggaagctggtgtttcatccttgtgtgcccagggtcccagtaagaccggagaccacatcctctgaggacgcttggcccttatacccacctccccttccatgagcccacaccgcatgactacgcaacggcttcttgcccagaacgccagcatccttcctggcccatgaacattcaggtcaccccaatactgcgtgccatggctctcctgcccttggctgagtatggccctgtggggaccatcttgtgctcttcacttcagcagagggatagggctgagaagtcaagcctgtggtctctcccgcccccatccagcccccctgctcctcctcacccctcatagtcctcacactgcctctggcgcccatctgctggcctggctgctggtatcactattggttttgccctgaaatttcccaatatatatgtttgcctttttccaatagaaattttctttttattttactttttaaatttgtttttaaaaagagacggggtttccctatgttgcccagggtggtctcgaactcctgggctcaagcgatcctccacgttggcttcccaaagtgctaggatgacagatgtgagccaccacacctggccagaaattttcgaaagaatacagaagtagggagaacagtataacagcatctgtcttccagggttaacaatgacaggttctgtcattctcacctgcatcctcagggtctttgtgctggcctctgttcccacactagggacagcagtgagtgagagatgcatgcaccctcggggccacacggcctggtgagagtgggtagatgaatgaggggattttaattgtggtcagatgtacataatacaaatttaccatcttcaccatttcacgtatgcattcccattattgtgtaggcattaccacctgccatgtcctccatcactcacagctgaaactgtctcttctaagccctaactccccactcccctgaccccagcccctggcaaacaccattctactttctacgaatgtgataactccagggacctcctagaaatagaatcacgtagtgtttgtccttttgcgtctgccttgtttcgatggcaaacgtattttcatcaccaggtcaggtggtggtgatgccgtggaggcagggcgaggggtcggttcagtgggtgatggggagagggctgtgtggatgcctgtgctcagacccttccgagagctggagaggccaggccccagaagggagcctgcggtgtgttctagggactccgagaggcctgcggggctggacggcagcaggcagagccacaggagccggtctctggcaggtaggagatgaggctgaggctgggcacagcagccagtgtatgcccctcttgtggaccgtgggagggctctggatcacacctgcttgagatgaaggccctcgggggtcttgagcaccgatgggctaaggactggcctgcccaagtggagtgcggacagagctggggctgagcccactattaagagcctattatgtgccagacagctggggctgaggctgtccctcccccaacccctctggctccaaggccctccccggcccccacccacctctccttttgccagttcccacccaaaaccgtccagccctggtgcccattgttctgctggatgtgtccaaacagaagactcctaggggtgcggcatccttgtttgtgaggatgggtctttggggggtttcggacactgtagccagtgagtagaagcatttgggatgatgggacagtgttcacacaatttgagaactctccactcccagccgtggatttggtgaggcccgcccgccaccccctgtccgccccactctcatccatgcctggaaaagctcataacccatctgcctgttctccctacgtcactgtcaccaagcgctgcctggtggaaccctggacaagtggcccagctctcccagaggtgctgctccccgaggactcccggagtcactcagcaggccaggcggctgtcacctcacagggtggcagggtagcaaagcagctctggtgcgtgtccttggatgtcacggtcaagtgcccctttcccttttctgaccccatcccagtcacccagagctgctgctctaagtcaggaagactaaatccccaggaacaggtgagcatcgcctgtggacggggctgggcgctggtggggtgtcagcgaggtgcgtgctctcccaggggcgctcatcagggctgtgagaggtgagctgtcgtgacagtggcgtggctctgggagcagccgccctctggagagcccgggttcccagcagagaagctgaacactggacaaacaattccaggactgcagcgtctgaaagtgtccgaagacgaaagggaaagatttcagagcctgaaggggtaaataatgaagcagggagaaaggagattcaaaagggggtgtatttttaaaatagtgactctggacggtgacagagaagccaccacagcttggtgacctggggttggggccgcagcctggctgggtgctggccagcccctgctgctctgtcacccccatcctgtgagacaggacctcactcagggcttgtgcgtgggtccagggagccttggcacccaaggatggtcacccggggttccaatttccagatgagagtgagcacttggtacattcagagagcaagatgaattctgccctgcggtaataatttgtcttttagcgattgagaagaaaaaaataggcaaagtccaggtgctctcagcgtaaatcaacatgaacgttccctgagggccaaggcagtctctggtgctgctgtgtgttcttggggccctggggactgctggcctccgggtgtctcatgacagtggtgctggttggggtgcaagtccccaggaggtggcgtctcccctcccggtcaggcccgtggtcaaacactctgctgggcctggagggatccacggaggacgggcccccggagctgagcagcgcagtggcctctggaaagcaggctgctgggggagtgtccgggcgtccgccccagggccctgaggctaagagcatgactgcaggaggaggaaggtggggctcaaagcagacccaggaggaagttttgatgactcacatcactaagatgcttggctgggccccacttttggctggaagagatgacacatcagctaatgctagtgagttcatcaatgaacagcacctgaacgctgacccggctgccctgcgcctcccaggggatacagggcctgaaggcccctcctccctccctccctccctccttctcgctcctgggcctggccagccctgttttgatcacagaacagctaaggctgatggaaagggagtggctgcagtctggagtgacctctgagcagctgtggccagtgaccctgaggagggatgtccagttggcagcacagaaaaaaggagcaaacccctgcgtctccaggcaggcacccgtgcgccagcctgcagggtgatcagcctcagtttcctagcccttccagagtccctgcccaggggcaccccagctctggtctcctgctgccccagcctgccttcctccccacggggctcccgtggctgctggtggctcacctggggtcctccccacctcgatggctggatgcctctgcccctgcactcattacagcctggaggggcgtagggccctgcctcctcctggaggtcccagtcccccacaggcaggtctgcctcaaagcccaccaacaccaaataccattgagtatcggttttgttttgttttttgtttttttttttgagactgagttttgctctcgttgcccaggctggagtgcaatgacgcaatcttggctcactgtaacctccgcctgctgggttcaagagattctcctacctcagcttcctgagtaggtgggattacaggcgcataccaccatgcccagctaattttgtatttttagtagaggcggggtttcactatgttggtcagactggtcttgaattcctgacctcaggtgatccgcccgccttggcctcccaaagcgctgggattacaggtgtgagccaccgcgcccagccagtatcacctttttgatacttgactaacaatgctgtgctaacttctaaaaatgtttaaggcaaagtttgctaaagtgtaagcatatggagaagagcacagatcatagatgacgaatttgcacaaactgaacacccttgtgtagccagcaccccagaagctccccatactctctcccagctacttcccctcaagattggcatcgtctggttttgaatttacacgatttttttttggtctggcttctttcacttgcactttgtgagatgcagccgtgcctgcgtgcggcgttgaagttcatcaactccatttcattgctgcagaaccctccgctgtctgcccagacaacgactcctgcgtccgtccagttgttaatggacaccgtggtttccagtcggggctgtgacagagtgctctcatgggcactcttgtgcgttggtgtgcctttctgttggactcgtactaagattactggtagtagggtacgcacgcagccatagtaaataatgtggcatcagctctgtgtgtgtgtgcgtgtgtgtgtgtgtgtgtgtgtgtgtgtgtcctgcctccctggtgattctgtaagcaggtgctgtgtcttcacttccccaggcttcctaacctggcgccctgcatgccagctctcttctgccaccatccggctctgcgcacacgcaggtgctttgcctcacctggtagttgaggctcagcatgcatttctgctgaagccctcggttcctctgatgggcagtccccagcgccccatgtcctgagctgcttccccactagcaggacttagatgctgcctgtgaaggacacaccatgaagatagcaggtgggacccctgtggagagggagcaccatctctgaggctgcctgcttcctcgggctcagccttgggatttattcatgactgggaactgtagcaggacctggtttgtaaccaccagctgtcgctatagcaactccttataccagcctctacactaaaaatagatcaccttcatccctaggatagaaaaatcaaagaaaatcaaagtgggggagggcccaacctgctcagccaccgggatttcgaggtgcagtgacatagctcctctcggcctctttcttctcccaccagtggcagaaagggcacaggcagggtgcagaccagcccctgtgcagccctgggggccccgggtgctgaggtcttccccacacttcaagtcttatctgtcttctcctgtctggtatgaactgtctgtatataattgaatacaaattataaataattgtatttttgcctaggttttatttggtttcttgatattagctcttctgtggaatggtaaagtgccaccacacccagcctggctctttttttttttttcttcactgcggtaaatatgcataacataaaatttaccaatgtacccatctttaggtgtacagctcagtagcattaagtacacgcacgtggctgtgcagccagccatccatctccggaacccttttcatcctgaagcacttaaactctggcccatcaaccctgactccccatgctcctccccagcccctggaggccacccttctacttcctgtctctatgcattgatgactccagggacctctcgtcagcggaatcagacagtatttgtttgtgactggcctgtttccctcaagcatcatgtccacacagatgtccttcgtgtgtgtgggtggcgggtggcaggatccccctcttttttaaggctgagtaatattctgctgtgcatgtggaccccattttgttcatgcgtcgatggacacgtgggttgcttctcgcctgctctttgtatcatcacacggtagggggatcacaggccctttgaggcagggccgacctcgctcctgttggcccgtgaaggggcaggagtactcacgtcaggcgcggtgaaaggggtcgatgcatccacaggccagggttgggaggcctctcctggactcacggccacagtggcagcctccttgggcaccgaggaggagctgggacgcactgagcagccccgccacgccccgggtccccactgtcggagtttctgaaggtagaaatctaggctcggggggtgctttctggtgccggtgccaccctctgttccactgtcactcccgaggcctctgcaagtcggcacttggagccctagcaggagggagcgtggcgcggagagccgcacttgtggggcgggcaagcggctgctccggctagggagtgtgcaagctctggaatcctgcgcagggtccgagagcacagggtcctttgaaaagagggaagcaagggtgcccaaagcccgggaagtgccgggagggagcgcctgggagggcgacgacgggacctggagacaagtgagccagcaccagctctaccctccaagggcccgcgcagaagttcccatcctcgggctctgagcagcatggcctgtgggaacctccctgccttgggaagtcaccagtcacccccttcctcaggaggggaggacgggagcaggtgcaacctctgagggacagcagggccgacagactctgtggagatgcccatccctgggcttgctgagaggatgacaaaggggctgggagctggaagagccctgcagtctgtctggctgtgtctgtgaaagggccctgtatgcaaagcgacccccaaatgcagaaagagcccagaaaccaaagaacaagacagacaaatccagtgtgttgttatagggtgattttattgggggaacttacgggcagaagtgtagtcttgggcaaccacaagacaggtaggtccccaccagcaccccccggacccagggcttctatacatagggcaaaggtatggtgctccagagggaaggtgtaggaatatgcctaagggcaggatttaccgtggagtttatcaaggttgatttgccgtaagggcaggatttatgacaagtacttgctcttacacagaacagtagatcagctggaaccggggttgatcagaagccgaggtggaggatttgctcccaagatggagctgcttcaggcttcacgggcgggttggctgaaacatggacccaaaggtggcccatgctgaacggagttgaaacaccagaaacgcctgcgtctgctgcagagggaggcatcatggctcagggagactggagaggatttgccagttgagaccaactcacctgccactcacacacctttcaccaagactgtggtgagggagcccagcgcccttgaagagctccctgtaggttggaaatcacagggggacctactgccactgaccagggatcctaaatgaagtgggagtatctgggtcccagcatggcaggggccaagtggaaacaatcaccaaaggcaaggcaggtgcggcccatcggcgaaagcagaggccaagcagccatcaggaccgtcagactcaactccttggggtgggccgcgtgacctagggcgtgggccagttcgccaccatgttcttagaagtgaaatggatgggaagcctactacattctaactcgatctgtataagtagaagtgtaggccaagtgaacaaaagtctagctcgaatgcgtcatggtccttcaatcaattcttaggcttgagccagtttccagacccagaactctttgagtggagggggaggctgggtccccttgaagaaggactccactgcactaccaaaaatgtatactattaacctctctcccgttcttccccaaagggacttatggcttttaccagggcaactgggcattagggaaagggtattggaggtgacagaacactgattctaaactgacattcagcccaggagatgcacaacgtcactgtggtccacctctcagagccggggctgtggacacagaaagagatggtgactagcatagaatttctccagttctcctgcggtggaggggaggagtgggcaggctgcaggggatgtctttcctgtctgcagccttccgttttccactttttgggaggcagagacctaagaaaagaggagccaaggatgtggttgtggggctggggtgctcagaaatggggagcagctggaggattaaaaggcctctggggcagggaagaatgtcctttaatggggacctgccgggcctgtgcctatctaatcagttttgctgtgtgttagtagcacatccataataagaagtgcctgtgacagccgggactgggaatcggtgttgagctgttggctgatggtggggaggcggcggtgcacactctcggcttcccttgcacacgaacctcgcagagcatggggctgcatgtccgtgtgtccccacgggagtctcatggcatttctggagaatagacaggatcctacccccgccactcacctgctaaagtctagcattcctttatcaaagccgagcccttctttcctcagtgagagatgagctccacgaggagacccctggggagggagctggggtaagtgatggtagtcctttcgctggaagttttgatgccaagagtaggagaggaaaggatgccaatggcaagacatccttggctgaaagatggctgctttcacccatcctaatgtttgtaaacttatttacccttttcctaaggtgaggttggcaggcagtgccatgtcaagcaggtaacgaactaacgctcccctgaacatagctcgtcaggaggaagggtgctaggaaaaccagactgcaatgggctgaaccccttttataagatagcaaagtcttggtcacatctgagtctacacctgcattgtaaagaatgtctctgggggtaaatgagagagccaactaatgagaaatacgggttacaggctcactgtgctgtgggcactaggagctatgccaggaggattctacaacatccatcatattcacatgcaggaaacaatagccagctcacccacaagacagaatgccacagccacgcttgaggaattctgcaaggtgattgtgtgggaaggagtagtcagggtgggctgcatggaggaggtggccttgaactgggcctcgagggagtagcagggttgggataggcagataaggggaaagaatctaggacaaggagtatgtgtagtgtttgtacagagtcaccatgggaactaagggacctgggtcagagaggaatggtaaggccagataacgtctatgaaagcaaacataattggctggtacatgcttgatgggacgttggcctgacactgtgaatatccgaggccaaaacatctgtcttctccagacaaactaaatctctactcagattttagaggggcctaccctgctgctccctggccaacagggtagaatgtccttgactgccccagggggtcctagcatatgtcccccactgtcacgggcaggcctggagggggacattaggtgaccatggggcagaggggtggcacgcctcctgtgggaggtggctggtcaccctcggttctgcatgagaggccttggagggaggacgtgctctggggagccaggccctcaggcaccccagctgggccccatagcgctgtgctggcctcggccccggccctggccccggccctggccctggccctgtcttcagccctttcctgttggcattagagctccagttgtaggcagaaggcagctccagagtgaccgaggagatggcagaggaagcaggaaggggcattttcgagatgcagagaggggacaggacccccgcttcaggatgcaggatgggtggctgcagggatgggaccccagaaaagcctgagtgctgggcggctgcagggttctggctcccatgcctgggtaggtggccaggctgccccatccagccctctgacatcctctatccttctgtccccctctgccctctgtgtcccctccatcccctctgcccccttcatgcccctccaccctggtctgtcctttttcacccccctctgttcttcattctcctccattccctccatcccctctgcctgctccatctccttctgttccttctgcccttattaccccgctccatccctctccatccccctccattccccccaccactaccctctgtccccaaccatcccctctgaccctctccctcccgttccattctcctccatgcccttctgtcccctctatcccctccaaaccctccattgccctctctcccctcaatcccctgtccccctccatccctttccatccctctgcccccttcatccccctccatcccctccattctctctgtcctcctttatccccctctgtccccatccatcccctccatccccctccatcccctccattctctcctccttcatccccctctgtccccctctgccatttctgctcatctggacgggctctggagccctgcatgcattttctagagcttgacggtgctttgttttcaaaacagaggctgtcagtgcttgacttcagggtgtcaaggtctgttctatctattttaagaaaattgttttccacaaatagcagtaagaacacagtctgtgttacacccacagagatttaattgcctatagaccgacctcctgagctagcagcctccaccctttctggaaagggccatggtcttgctgtattaggtagactctcctatctagggtgcttttggggctggaagtaacagaaactcaaacgcgaactggcttgaacaacaatgcttgtcccagaccagcaagtctgtgttctttctctctgtgtccatctgggcttccactacctttccttgtggtcacaaacggctgtctgcagccactggaggagtttgtaggtttatgatctggagggagagaaagaagaaagggcatttccccctactgtggaatgagggcccttccctgattctgattggaccatcttggaagggctcgcccctgggccagtgctagtggccaggcctcaccctgacctaagcacatcccctgggggtgctcacagacctggaggagcccaggactgggccagagctgcccctggtctggacctgggcagagcaagcacagccaattgggagagttccatgggaaggtgcagattgaatgtggcggcctcagtgaaataacagaactacctcagtaggcacaggggccagggaaggcgttacttggagccccaacttacaggctgcctggcaaactcagggggaggaggggcaggctccagtttcttgttgagaacagatcagggtgccaggcccacataggctctgggaagccaggtgggagtgacagtgcccatcgcaagacagtggtgctgtgggcgggacccaggcaggaatgcaggtcccttgagaggcaggtgccaggacaggactcaacacacaccagactcactgggggaactgcccgggaaggatgagggtaggaggcagaagacagggggcatcttctttctgacccctgcggccacggtggcagggaagattggacagcgagagtctcagggtgacccagcacccggcgcttaggcattggctgggagcagcccagggcaggggctgagggtgctggcgggtttggggtgggttgggagcatggtctctgtgtgaagggggaagcggaagttatagcccagctcccccagcaggaggcctgagcggtgggtctctgtgactacctccttcataaagtcccacttgcccaagaacttgtatgataagttggaccagggctgagcgtgccggggccgggaagcatgttgcagagaccgggagtggggcaggacctctctcccttctgccatggggctttctgtctgcacttccactgcttccaccgctgagctggttgcaagatacatctcgtctcccggagcaacgctcggggaacagggtggcacacgtctccttcagtcccctccatttccctgagttcggggccttgtacttatcaggggcttaatgaatgtttgtgggtgggttggaaagtctgagcacagagagaacaggaatcatctgagtctaagaaactacttggcaagatgcaggctggcaccctcaggaacacagggaaacaggcagccctttaggtctcagaggccgatgctgaagagagatgaagccagttcttgaacagaagggccaggggaggtgggcagacctgccttctggtttggtggacaagaatgagagaatcccattgagccgtcatctttggactccatggaaggggtccctccagtcagctacgggcccagagattcattctggctggttgtagtggatcccaaaaatgtattaaaagcagtgaatagctcacagagtccccaggatgcaaaaaaaacctgggtttttttgtttgttttgtttttgggtttttttttttttttttgcatcctggggacttcatgagctactcagcacttttactggggactttggtgggtttccgagaggagcccaccatgacttacagagcggggacacggaggcccacgtggcactgggcacagccaccatgacctgcatgcagctggaggactcgtgccgtgctgtggaccagatcgtgtcccccgaattcatacgttgaagccctgaccctcgatgtggcttatttggagatagggctttgaggaggtaattaagggtaaataaagtcataagggtggggctgtaagctgataggactgtggccttacaagaagaggaagagctctacccccccctccacccaccaccatgggaaggcggctgtctgcaagccaggaagagggtcctcaccagaaaccaacagggctggcaccgtgaccttgggctttccagcccccagaaccgtaagaaaatcaacttctgttacgtaagccaccccatctatgtgctctgttctgccagcccaagatgactaagatagtgtctgctctggaaggcaggacctcctgcctggcatctgcttccatgtagcagaagctgagtctggcccaggacgaccctcacatcagagccccttccccccactcccaaggtcaggcatagaggaggtgtaaaaagatgctgcgtgggcagaaagaatgacaagcacctacccatgcagggatagtgaatttgaggcaggtccccagcaaggtcaaggccagctcctttctcatgaggagatgctttcctggtgggtccccaaggctcagggtggctcatcaactttataggctgaaaaaccccactattttcagcacaccaagaacagatttattacctggttcacagaaacttagccagatccaaagctttttcatcccagttggcaggcatagtaggcaaatacgtgggtgggcatggctactcacacatgccaggccctccccatcctgttggcagggccacacgggagccagtccagagctgctgagtggtcactgtaccagccggtgagtctggggccggggcagcccttctcttaaaaggcatctggagccacctgttttctgccctttccttgggacaccacccttctgccattctcttcacctggcgtttctccagaaagttcctgcatatgaaattcaagtcaaatattattcttgcctccctgcaaatgaccccagtcaccttgagtggagttctaggtgtttccaaattctttaaccatgtaattacagtctcttgggtaactctcgtcaatgactgattgcaccctctttttatgcgattttacagctttatgaaggcaacctctttccttctttttttttttttttctttttgacatggggtctcggtctgttgcccaggctggaatgcaatgtcacgatctcagctcactgcaacctccacctcccgggcttaagcaattctcctgcctcaaccttccgagtagctgggattacaggcatgcgtcacccaactcgactaatttttatacttttagtagagacagggttttgccatgttggccaggctggtctcgaactcctgacctcaagtgatccacccaccttggcctcccaaagtgctgggattacaggcgtgagccaccacacccggcccacctctttccctcttttgttgcctcgaatttttgtggggcaagtcgccactgctccccttcctgccaacactcatttccctaaaacgctctggaagctgaaggtgcggggtgtgtacccatctctgctccacgcgggcttgggggctggagcagctgcgtggctcaggcctacgtgctttctgcagggctctgtgtttcagacgctgtttcctttcaggaattcaaaacactgactgctaatttcactggtccccgttctttgcagaatgagtttatatgaagtcccattcttaggttgattatgtctaagcctcagtttccacctctacagaatggggcaacagtgtcccataccctccttcctaagggattattatgcacctgttaagtgcaaggctgggcggggttctgtgcgtgtcaagcatgggaacaagtatgtagctggctggctgccctttgagcctggagtggtgaggccaggacttgtggatccaagccctgcctggacaaggtgggcttgctctgttgggagtccacatacggacccctgcccagcccctgcttctctaacaggtgcccagggtcacaaagggggcttgaacacaaagcattttcacccgatggaggtctctatccattcacttggcaaacatttgcctgacatgtcataatcaacactttcacactcggcctcctctaatctccggttttcttaaaggccaagggcacctcaggttcagcaccacatctgacccatggggctgacatcagcctgtgaacttcctgatttgtgtatagttgtaaatgtttaaacttcttaaacttgtattaggcaaatctccagcacttatcaaagagaaaagagcgtactgaagccctgtgtgtcctctgctcaaccccagactacaaactcaagggcaatcgagctccatccctgcacacacccacctcccctgccccttggattattttgaagcaaatccaagacatatcatttcatctataaatatataaaagtgcctctcgaaaatccttcctggaagcctaagatgccgtgagatgggaccgccgccctgtgagcgaggagagtggagtcccgcaccaaggctccttgccccgccccgccctctctcctgcctttgcctttcgccttgagcacctgttttctgtggtcttggctttcctgttcgctgcctccctggcatgatctttaattcttcagccttccccctatctttctcttcttccactccatcctccctttctagatcacaactcaaattggaatttttaaaaaatttgcttttggccaggcacggtggctcacgcttgtaatcgcagcactttgggaggccgaggcaggtggattacccaaggtcaggagttcgagaccagcctgaccaatatggtgaaaccccgtctctactaaaaatacaaaaaaattagctgggcatggtagtgtgtgcctgtagtcccagcaacttgggaggctgagacaggagaattgctgagacaggagaattggaagtggaggttgcagtgagctgagattgtgccactgcactccagcctgggcaacagacaggaactctgtctcaaaaaaaataataataattttttttttttttttttttttttttgcttttaggccaggtgcagtggctcatgccggtaatcccagcactttgggaggctgaagtgggtggctcacctgaggttaggagttcgagaccagcctggccaacacggcgaaaccccgtctctactaaaaatacaaaagttagttgggcatggtggcacgcacctgtaatcccagctactttggaggctgaggcaggagaatcacttgaacctaggaggcggaggttgcagtgagtcgggatcacaccagtgcactccagcctgggcaacaagagcgaaactccatctcaaaaaaaaaaaaaaattgcttttaattgggtagaatttaacatcacatattcttatttattttttcttatttattatttttttgagatggagtctcgctctgttgcccaggctggagtgcagtggcacgatcttggctcactgcaacctccacctcctgggttcaagcgattctcctgcctcagcctcccgagtagctgggattacaggtgtgtgccatcacacctggctgatttttgtatttttagtagagatgaggtttcgccatgttgtccaggctggtctcaacctcccaacctcaggtgatccacttgcccgagcctcccaaagtgctgggattacagacatgagctactgcgcccggcccacttattcttaatttagaagtagatgtttaacaatttatttcacttttctttataatgaaaggaaacttgctttttactagagtagtttttttctctgttcaccaatggccctgaacagatacacgaagggcaaggccaccagggagaggtggcagggtgtggatgggaggacgtggtgcgtggatgggaggatggcggcatgtggatgggaggacggcgggtcgcggatgggaggacggctctccgggaagccctgccgcctctccacctaggcacggcggggcgcggatgggaggacggcagcgtgcgtgtgggaggatggcagggctgggatgggaggacggctctctcggaagccctgccgcctcccccataccttggcacacattttcctcaaggcttagaagtcaaacgtaagttaggccggtgagtaactgcataggatgtttaatgagcgctgactctgtgctaggtgctcttcttgtgagatcttgtttattccccatgacaaccccgtaaagcccgtactccaatggagatcacctgttcagctacctagctagtaagtggcagggctgggaccccagcccgagttatctaaccgctaccagtgaccccccacacttgactgtctgtgagaatcctttgggggtatgtgccggttcttggacttgaacccccaaattgtgatatatttgatctggggtgagatccaggaaatttgcatttttcataagacttgtaggtgattttgatgcatacgtcatggtagctacatttaaacactgggggtcaggtgcagtggctcatgcctgtaatcctggcactttgggaggccgaggtaggaagatcacttcaggccagaagttcaaggccagcctgggcaacatagaccccttctctatgaaacatttaaaaattaactgggtgtggtggcctgcacctgtaatcccagctactcaggaagctgaggcaggagggtcacttgagcctcctgaggttgtagtgagctgtgttcgcaccactgcactccggcctgggcaacagagcgagactttgtctcaaaaaaaaaaaaaaaattaaaaaagcaaaaacaccatcctcatgagttaatagttgttgaaatggcatgctagaaaaaatggagttcattattctgttctgtctacttttacatatgtgtttaaatttttccatactaaaaaagtaaaaaaagaaaatactgcattacatacatgtgtgagctgtggtaccatatccttttcaaaaaccgctgattcacagcctggcttgcaagccggggtgcgtcctacagcatcagaattaaacaaaagggtctgctttgggtggggggaaagatatcagagcaaaaggaaacaaagtccacaattctcgccattcccagaagacagtgtgagggatgtagatctgcaaactgcatatccattttctaagatgtcaggctcagaattccttcttccatgaccccctgtccttccgggagttttgcccttgagtcttccttctctgttcaccatttcccgtccctctgcctcgatttgacagtgccatacaggagaaatgggaactgcttcagctccgaggaagggccatccactgggcatttgtagggaagcagagagaatgccccaaaccagctcacgcccctctgctcttggcacgttccaagcacacagggctctccatgacaatcctgtctttgctttgcatgctgggaaagtgctgaaaatatcctgcacccaaaatgagtgatggaaaacggaatgaatttgcatggccagagcattttcccctctgaagcatcaggctttgtgtaaatctccacgaggcctcagaacctctcccaggaaagacagagatggaggctggagaggattgtggtgtgttccacaccctccctcagcacagcgtggccccgggtgactgaatgtggttatggggcacactcattttgcttactctgcatgcactcccttttttggcaacaggagcctgattgtgcctgggtgcctcctggacctgcagcccaggagctggtgtccgaggtcaggccagtgggcacctcccatccctgggcttggctctggccgggtgtcagctcatcagggccaacaagagcagatttgttttgttacatcagtggaggaaggggactttccctttcacagtgggccagagcaaggcccctgcagggctgtccctgtggttaccattagcagtctcgtgggtcctgagtgtagagtcactgccagggagtggaggagagggacccagtctcctgcggtggccaccccatctgattctccctccaggccacacaggatgtccaggctttgggtgccaggccccttcctgctgagccagcagagcgtccttcccgggtgagtgagcctgagcccgtcccattgttcacactcctcagagctctcagagggtcgggcggaggctgggtgccaggagggcacgtgagggtgggggccacactgagccgcccagtcatgttacaccacgtgatgcacgtacgcgccgcggaggaaggcctggagtccctggtggcacctgacattctgccgccactgcctccgggcagtcacaccctgacatgggatctgtacacctcctccatcacccgagacacagcccagccacctggggcgcctgggaaacccagaggagggcggcttctgggtgatggtgccaaacccagtcggtggcaggccaccaacactggacctgtgtccccatgtctagagttagcaccaggctgtggctaggaagagtcctggggtccaaagatttctaaattgtagaacttgcatctgagttgagacaggctagcggctctcaggaacctgcatatccgagagtaaccctaacaagtagtttaaacacttctgtgatggagagcctgttctcttcctcgttccttcaacacatttgataaatatctacaggttgcttaactttcctgtgcctcagtttcaccatccataaaatggggataatattgctgtcctccttggtggatggagattaaaggaagcaatagatttaaagtgttgaaatatattaacctatttgaatattaactctttgactattttctgaagtgcatacactaaagtgcttagtcatcactggtactgtgatgcctattactgttactactaagcctagcactgttagtgctctaagcttagcactcttagtactctaagcctagtactcttagtactctaagcttagcaccctcagtactctagcctagcactattagtactctcagcctagcatcctcagtactctaagcctagcaccctcagtactctaaacctagcactcagtactctcagcctagcactcagtactctcagcctagcactcttcatactctcagcctagtactcttagcactttaagcctagcactgttgatcctctaagcctagcaccctcagttctctaagcctagcaccctcagtactctcagcttagcactgtttagtactctcagcctagcactcagcactctcagcctagtactgttgatactctaggcctagcactgttagtactctaagtctagcactctcagtactctaagcctagcactcttagtactctaaccctagcatgttagtactgtattcctagcactcgcaatactctagggctagtactgctggtaccatatgcctagcactgttagtactttgtaagcctagcactcttagtactctggacccagcactgctgacactctctgcctaccactatgagtgctctgtgccaagcaatattctagactctgctgacacagaggtacagagaacaaagtccctggcttcgtggagcctatttgcttgtaggggcaagcagagtgtgttagatgtcatgacatctccatgtgtgtatctgggcggatagtgacaagtgaagagagaaaaatgaagctgaatgagcatgtggcaaatgggggtgtgtgagcggtgccctcttagatggtatgcttagggaggcctcactttgggtggctgcgccctgggagagatgcaagagcagggagagggcagggctcccggggaggggagaacagcacatgcacgggccctgaaggggctgccccttgagtcttcctctaagtgtgatggggtcaccgcagagcttcgagcagaggagtgacggggtcttctcttcccacgaaggttcatgtggcctcagtgtggcagcggagcaaaggggaggggagtcttttgtggtggggagactggtgggtgaccacttggtgtgctgcctcagggcggggggcgagagcgaagcctcggcagctgggggacaggggtgccacgcactgagatagagacaggctgggcggggcacgggtggcagaaagtcccggacttagagttctggtttcaatcctgaagtgagaggtgcctcctgagtctccacctgcctctgccatctctctgctggtgcatccaagcctcagctcaggggagaggcggctcccaaaggccggcccttctgctgaggtggctgctccgacttggaactgagctgaagacaccagtgcagtttctattcactgggctccggccacccttctagactcgagagtgctccgtggggctctactgtaaatgcttttcctcctgaaagccctctggaaggcgaagtggccattgagtcccccaggcactcagtgtcacacgtcactcagtgtcacaatatcacatgtcactgtcactgtcacatcactcaatgtcagtctcacgtcactcgtcactgtcactcaatgtcacacatcactcacagcatcacacatcactgtcaatgttacacatatcacttcacatcactccgtgtcacagtgtaagaaacatccaatatcacaatgtctcacacttcactcagtgtcacgcaatgtcacttgtcagtgtcagtgttatgtgtgtgtcacacaatgtcacatgtgtcattcagtgtcacatatatcatgtcactgacagtcacatgtgtcagtgtcactcgtcattcagtatcacatgtcactgtcacactcaatgttacagaatgtcacaaatatcaaagtcactcaatgtcaccatgtcacacaggtcactcagtgtcaatctcatgtcacagacacataatgtcacagaatgtcacatcactcaatgtcatcactcaacatcaccaagtgtcatgcagggtcacacagtcacaaacagcactcaatatcacatcactcaatgtcactgtcatatagtatacatcaatgtcacacattgcatatcattgtcacacgtcactcaatgtcacacgtcattgtcagtgtcaatgtcatacagtaccatacatccctcatcgtcacacaatgtcacacattgtcacaaatcgatttcacacaatgtcagtgtcacaacactgtgtcacacaatgtcattcagttcatacatcggtgtcacagtgtcactcaatgtcatacagttcacacattgttcattgtcacaatatcacataccatcataaaatgtcatatcactcaatatcacgtgtcagtgtcacacacgtcactcaatgtcatgcactgtgacagtgtcacagtgtcaccatcgcccatcacacagtgtcacacagtgtcatggtttccggcccctctgcttctggtattctcacagaactaggtagctggtctgctgggctctgacgagagcagtggcgtgccctggtggcttcctttcagctctgtccatgggtgccccgagctgaacctgtgctggggtttagtgtcaggtggcagcaccaggctgttggctcacatggaacttaaaaggccctgcctcaccaagggcactccagagaggcagctgccggccactgcacttacccagtgactttgctgtgctcaagttccctgtgaattgctggacattttacctttgtcatcccctctggtcactgcccacattacatggctaacacggggtacgacaggaaagccctccacgtggacagtgtatcctcacttgccaggaccctacaggcatgccatgaggaccctctggctccaaattccctttacctggctggctcggtggctgaaaatccttcgttacaaatgcattcctttgctaaacagagaaggctgtagagtgaaaaccatctttacgctgcatagaagatactggtacatttactatttttattttttgttgcttctattctcttcgatggctggcaggtgccaggttggcatgggggtttgaggggccacacagtgccccactggacgatcattctgagggcaaggcctgacaccaggagttattagagtcccgagttcactaatgcggcctttcagagtctagtaagccaaaaaagaaataataagattcatccgactttcctttcacaatacctcacagtagctggctgcatggagagtttagggtaagaagcaattggaggtttggagcctgacaaccctgggttcaggtccaggtcagccaaatgttgctgggcaagccccttcatctcttcctacttccatttccccagctttcaacggggacagcgccccccttgtggacagcgggggccagttcacacccagtggtcatgtccgggggcctttgcaggtggacagtcagcatgttttctctgtgcgtcctcccctgccccgtctgggttgggccgagagttctctgggtagatgtccaccatgttcgctattgggctttcctgccttggggccggtgctggctcatgcctgggctttctttggccccggtggccccggggtgagttgggcacatcacgggctctgtggctattctgagccccctactgacgtaggcccagctccctggctggccggtttaacttggttcttgaccagccactcaattatttttgtgtcctttgtttgccactgcagcagtggtgaggacccagttctccctcaggactccttctggagatgaggtggtgacatcagatggctgcatttggcttggagaactgagtcaccttcgggagcaccccaccagagaggagagcgggtgatgggtgcgagccagagagcctctggccttcaaattcccattcctctcccccagagccaacagtgtgaccctcccgaggtttggggagctctggaagctgaaatgcaggctcaagggcgggaagaaacatttctaggaatgtcactaaacggtcattatatagcagcttctccgaccaccgtttagtaggagggacctgctaggaatttgcagccacacctcagctaccctgctccacactccattctggggactgccttatcagggacttgccttattgaggtcccctgctcacctgttgaatgaatgggacactgctgttcattctcctgctgccaggatgccgtctagcctggacaacggcagctcaagtttgggcagcgtcggagggaggaggactgggtttcatgacatggtccagttgctatccaggtgcttggacttgtcctctgaccaggtgttaaatgtcctggggacttgtggtcccctgtgagcatttccttctgaaactgagacagggctgagctcagtaaggctggggcacccaggacgcagccgagggggaaggcctcctctgcatgactgcaggcaggtccgaacatttgaggctgacgttgggttgggccagaggcaccctcttccctcatggtagacgcctctggagggtgtatttgagtgccctactccatctagtccctggccaggccaggtggctccaattgggctgagatgcatggggaaccaccgtggcctccggctcaggttggagaagcagaagccattgccggaacgtattctagactcaggctgtgttgagcgtttgctgaagctgctgttactgccacagctaacgcctagtctgggagacagccaaaatgggtttgcatctttcctttgaatacattccttggaagaaagtcagaagatttcagcttgaaattctataaaaaccatcatttgcatttccagtgcacacctgctcaaagcaggaggcaggtcagggtgctggttgctcgtactctggctttctgcaagaagcctcgtggtgggagatctcggtgtcttcctgggacttaatctttacagcaaggcactgtcccaggtggggagatagtcctgacccttttgggaccctagtttcacagtctgggagatgagttggatgtcttggagaatttgacttgttaaaggcagggcgaggcaggagcctgacctcccagtcctgggctatgagtgggtctctctgcagccttgattgcaactagtcattaccacctaggaggaaagattaatttctcctttggtgctacagggcaaagaggcaggaggagacagcagtcaggagcttggtctccagagccagacttcaaggcttggctggagctctgactgacaccagccagctgtgtggccttgggcatgtcccagggtcttctctgtgctgcatatctgctgtgctgagtcacactgaagttgtgttacctaaccttttactccgggaagcattttcaacatgctttgcagggtacaacatggtttcacatacctgtcgtttcatcttaaccctgatgagcaagactcaagagacccaggctcctggcttgaagttctaccctcaacaacagtgaacttgggagttgcaggtgcacagatggggggcggggggatgtgaaatcataaaacatgtgtaggaatgtcaaataaaacgcagcgggtgagatgagatcggctaagaagggccacttatgagatttctacaaggaagtgccaccaacctgcagagggcagtgtaaggaggagtcaacactcttgctctaggaggggaccccagagcctggagagttaagcagggagactgaaattaatttgaagagcagagcaccctccaatcgaacaccctgctctaggaggaccttagtgagctgatcctggacaaatagaattgctttctttatgggcctttgggaaaactgtgcttacctctcacgtctctttctctctgaaaagacgtagccctccccctatctgtctccctaaggagtgtctgtcacagacagtcggctgtcccctcgcccagctgtgtgtgatagacagatgcttgcagccagatgccggctgcgtgttcggcataccggggtgatcctgcttgggaccgagtgcttgccagccaactttcccggctggattaatttccaatccatgtacatctgtgtgtgtgttttacaacccgattgagaaaagagaaaaaacaccataatcccttgtttccttggtgttgctcgagaggaagtgggcttatcagtaggaatgaaaagggagcctgatattctcagccaactctgagaccagaggggtttccagagcagcttgataacctgaacattttatcctgtacgtttcagacaccaggcctctgttcagagcagctggaagtataactcaattgcatttacgttttatcagaaggttgaaaaattctcattaacttgctaatcgtcaaaaatgtgttcagcatttggctggtaatttcagtggtgtctcctatagaagatagtatctgacacaccaaagaaacctcatttcgttcatggctgttttattcccgttgctgaggctagcaggggcaggacttttaagcgctaacattttggggacgtggtctgtccactaaatcataggctttgtagtggttacacttgggttcaaaacctgccgcaccgctgagcagcctcgctctccctgtgcctcccttggcaatactcactctctttctccaagccgtggcgccccgggaggcagagagttgtaaatccccacccggtaggtgccgcgtggattgcagtagatacgcaggcccagcacattgtaggtgttccacaaatgctcagacttgggcccctcccctttcctcatctctctataatgtcttctgtgctgaataaatacattaactaaaagcaagcagcaattctggggaacatatgtatagaatgttcatacagcatcatttataatagccccagagtagacgccgcccagatgcccatcagcagtcgaaatggtaaacacatgatggtagatttgcataatggaacctcctacagcaatgtggagaaacagtctatagccacatgcagcagtgtggctgcatctcacaaccaacactgagcaagagaagcctgaagcaaaagaatacaaaatgtgcagctctgggtcacaaaatacacagccaggcaaaacatatgatgctagaatcatgaagattagttagaaagaataagacctactatttgatagcacagtagggtgactgtagtgaataataacttaattgtatattttaaaataacttaaaaagtgtaattggattgtttgtaactcaaaggataaatgcttgagaggatggatatcccattccccgtgaccagcttatttcacattgcatgcctctttcaaaacagctcaggtaccccataaatatatacacctactatgtacccacatttttttttttgagacagagtctcggtctgtcatccaggctggagtgcaatggcgcaatctcggctcactgcaacctccgccccccaggttcaagtgattctcctgcctcagccgcctgagtagctgggattacaggcacctgccaccatgcctagctaatttgtgtgtgtgtgtgtgtgtgtgtgtgtgtgtgtgtgtgtgtgtgtgtgtgtgtgtgtgtgtgtgttttccagtaaagacagggtttcaccatgttggttaggctggtctcaaactcctgaccttgtgatccactcacctcagcctcccaaagtgctgggattacaggcataagccaccgcgcccagccaaaaaaatttttttaaatagaaaaagaatgatgatgattatctgaggaggcaggtggtgcctggcagggagattgaagggggctgccatgtgggtagtaacattcctttccttctctgggtgctggttacatggatgcatgaactttgtgcaaatttgtcaagctgtacactctcaatgtgtgcacttttctatattatgctccataaaacattttttaaagcccaagtggccagatgatgtgggagaagttccttgagttgttctcatcagtaagacaactgagggcttgacggagccatccagtgctccggccacagcggagagcagaatcgctgctatctgggcagaagacactgcaggggaaacaccagtttatttgctcattggtaaaataaactgaagacacattgaaaagcagctgcaggagctctgaaaacagatttcctttcttagagcacccgcagtcctttgcagggtgccattcactgtgacggagaaggtgcgcttttcctctttccttctttgcttcgcgcgcgctgatgagtgagtcagagaagccatcatggccttgaagaaagatgagctatttgagcagcaggcaatgtgagaggctgaagggctggcagaggtgtcttctgccaggtgttcccttttctccctgggcaggcaggttagggagcccagcatagaggctgggtccctggagagatgagcagaggtgagtagtacatggacggatgcttagaggcaaaatcgtgcccttggcagtttgacattcactctacttgctccagttctcggaactggaaggcgagaggtatcacccccagcttctggcattccagacctacagtcctgaacttggacccttcccaggagagacctttgggctctggtcctcgccctccttgccatcacctcatcccctcaaccaaaactttgctatcctaggggctgtgccccccaggccttcactctgatcattaattcatgctagagtcttattatccaataacaggacttggtgtttctcctgagagtattttaacttgggattcttgggactatgaatgcctccatcctaaggaatgcattgccaactggtgagtgtgaaacttcaaagttgcatttgtctgtgtacagagcggacctggcagtgccctgatgggcttcctggcagatggggagaggagataggggaaggaaggcaagcgggtgggcagggacctggcaagactgccgtgggggctccctctgtgggtgggactctcaggatcagtgtggacctgcatccccatccgtctgctgtcagcatggacgaaagctccggcctgaatgtctaggtggactttctcatgtcagggaagagagtcagtgtgtgcctactgatgtccctttgatgatgaggcctcctctctcttttgggggaccggcactagggatgtaaaggatgtggaagatgcaactgggctaccccagcaactttttctgaaaattaaacttttaacctttgcttctttcttagaaagcattctgcagaacaccaccctccaatcgaactccccgcacagggggaagtgttctgtatccatgctgtccatcttggtagccaccagccacatctggctgttgagcattggaaatacggacagtgcagctggattagcacccagggctaccatacacaacagagcaccacacaccgggtggcttcaaacagcagaaactgactctctcacagttctgccggccagaaggctgaagtcaaggtgtgggaaggttggtttctactgcaggccctgaaggagaacctgctccccacctgcctcctggcctctggcagttctcggcaatccttattcttttttttttttttttgagacagagtctcgctctgtcgcccaggctggagtgcagtggcgcaatctcggctcactgcaacccccgcttcacgggttcacgccattctcctgcctcagcctcccgagtagctggggactacaggtgcccaccaccaggccggctaattttttgtatttttagtagagatggggtttcaccgtgttagccaggatggtctccatctcctgacctctcgatctgcccgtctcggcctcccaaagtgctgggattacaggtgtgagccaccacgcccggccggcaatccttattctttggcttaaaaagatgcaccgctccaatctcagcttccatctccctgtgtatctgtgtccacgtttcctcctccttataaagacaccggccactggatgaggacccaccctagtatgacctcatctcaacttgattatatctgcaatgaccctatgtctaaggtcacatgcacaggtaccagggtgaggttttcattgtatctttttggggagacacatttcaacccataacagcaactaaggagctgaacttgaattttataaagaaatagctatgtgaggccagtggctgcctcttggacagcacaggtagagactggagggagaaggtggctaatttagtgtttctgttcagacctcctcctcccccggcccagtgacgcaggcctcaggtctgggtcaggtgcctgctccagtggggcttccctggggggcagcccctgaggagtgggaggtggaagggggtggactcttgtgcctgacagctgaggggaggagaggacaggcgtctgctgggtgctcgtgtgtgcagcacattgcatgactcagttggcacatcaaggctgcataatgctctgtggtctcgcctgtgtggaaatgcctgggacatcctgtgtgatccctgctcggatttcccgggcaggctggatgggttctgcatggatgtttgacctctaaacgggcaggccaagcactgaggattatttggggttcggcacaaggccaggctccccccgtgtggaggggatgggtgtgggaggttaagggaactatggcctggccacataaggggaagcctggaagctaccgtcagcttctccagggcctgggacgcgtggcggagatagccccagtcttctcccagaactcagatgatctcctacagcaggtggctctcagggtgtgagccccagaccggcaggcctggcattacctggaacctcatcagaaaagccaatttctggacctccatcccagttcccaaatctgaatctctgagggtggggctcagaaatccacagattcacaagcctgcgttaaaaagggggtcctgattcttgccaaaattcggaacccctggcctacagccgcgtatctcaccctgacgtgtctgtcggtcactgaagagtcttgtcaaagggcagattcaggctccgtaggtctggggtgggggcctggaggtctgcgtgtctaacaaacaggctgctggtcctcagaccatactccaaggagccagagtctacaaacctgagctccacgagggctgggctcttctctgtcgtgttcactgtccccagcacccagaacacagcccggcgtataatacgcctctttcttttctagccactcaacttaaaacactgctgcagaaggagctgctaaacgtcacccccgatttcccttgttggggaggaaacatcattttgcaatgatgcaatgacttattcaaagacctgtttcctatgagatgacaggacaaaaaccacattgccgagaactccatcaccagatttcagtggaactatttcattaatcttgtatgcagcaaaatgttggcaggtacacaaggctcctgttgaggctgtttctgcaatgtgggggcacccatctgcggccgcctgtggcagcagagcactgcccctctactcccttcttcctccgctatgtaccccagtttatcttagtcccagtccttcttaaagaccagcctatatcaagaacctccccactgcctcctctgagggcctgagcaccttgctgtgtcccagcctcctcgtcctgctttcaatgattgatgaaaagattgacgtgtcctccatcagatgcttcctgcactgtcttaatggctcatgcatttctttctggcccgtaggctgggttctgttaccccaagcccaggcactgcatatcccacttccagttcttccctgtacagccggtgcccagtgaatacttctcatctcattgattcactgatttatttcaaagcaaaagtagtctgaaaggccctttgccatttcttaatcataaaactaaacatctccaacaggaaggaggggcctcctgtgctggccttcatgataaagtcgccgagatgatctcaatcccagtgaattcacggctccagggccaccttagcgcctctttctcagcagggggctgagatgtaaccggatcgtaaccacacaggcatccggccagcagtcagcatctcccggagatctgctgggactaggcctgcaggcagcctgaccgcagggagggaggcaaccttcgtgggagatcttcagaaatattgttcattcggtttctcaagagtctccaactacagtgcagtttagctttcacagcttacatcccaggtgtcaaagagacacaacttggggcagggatggggacagaggtcagagaaggaaaggtggcctaagggcattgaggggtgctccccagagtttgcagactggctctgcagacttgcaggtcatttcctgtaccctgtcctgaaaccctcccacggcccgtttgagcctatcagtcatttacactgtagcgagaagttacctgatttcaggaccttcttgcagaggtgggttttcctagggttccacgtggcatctcagggtggcttggagtggtccaaagagccaagtccttgcatctggataggtctgcaaggggctgacgctggtatccattgcacccattcccctgcctgtaatgtggattccctcaaaagcagagctggtgacaagggtcagggagttggtttgggagattgtgttagtccatttgtgtcactataaatatctgagtttgggcaaattatgaagaaaggaggttgatttcagttcacaattctgtaggctgtaggagaagcatggtgctggtgtctgctcctggcgaggcctcaggaagcttccagtcatggcagaaggcaaagggggagctgaggtgtcacatggtgagagggcaagagacagggaggaggtgcaagtctccttcaaacaaccaggcctcgtgtgaactcatagagcgagaactcattcactaccacgaggacagcaccacgacattcgcccccatgacccagacttctcccaccaggcccaccttcaactcgggggtcgcatttcaacatgagattcggaggggacaaaacacctaaaccataccagcgatgatcccaggaagcacaggcgagggggtgggggatgggacagtgaagggaaaaaccaggaggaggctcagagggacagtggggacagctgaggcctcacaagggacctggtgaagtgctggctgaatgtgcccccaggggcattagcccaggtggccctgtggggaccaaacccctagttccccaagctggcggcgctcctcccgagggagctcctgggcaccagaggaaactctcaggcagggttgaggtgggtgggaagccccagtgcccacaggaactgcctcccagctgcaggcgaactcagaagtgagacctagggacagggcatcaacagtgcctgcttcccagggggctggcacagaggaaaacagcacaaaaatgcacctccctctgccgtgtcccctgaatgcacccactggcctgtgcacccatggctgtggggaccacacaagagtcctctgtacctgcacacctcaaagcttggattcgccttgacccgttacacccgtccttctttatcctggcagccttgagccactgggtggatgaggttggaaggcagggtggagagaggctcgatttctgtggcattttctgggctctgatgtctgctcccggcacctgcctcctccctgcgtccacaccccctccctgcacccagcgcaccactgtatcccagccgtgcccattctctgtgccccccacagctaaggggttatgtcagacccttgctgacctgtcaccgtccacagtggattggaggcaccctgtcatgtgtggaccttatgagggttgggcatcattgtgtacccagctctccaagccaaggaccaggggctccggggcttcccctttcctgtgaccctcacttccagcggcgggtcctttctgctccaagtccccacagagttcaagctcctcctgctgtcccacaggtggtggcagagcctcctcagagggctcccgggctcggcccactctctacacccctggggaatgatggtacccctgctgggcacccagcatgcccacttgcagcgccccctgatgctcggacacaggtccaccacttctccctgcctgttgggaccccaagagcaggcctggtgggctgcagctggtgcccattctgccttgaccaccccagggtgtgcagctccctacacaccaccccccgttccccagcagctgctcttcctctgccagttatcatgtgtcctaagggaactggctccagctctctccccggggatgctcccgcccaaggcccctcccaggctacacaccccttccccatgccaggcgcctccatcccgctgactcagactggccacctgcctgcctctccctgggcctgcgctctgggggcagggtccactttttctgcctggctctcggggaatctgcggcaggtgaacagggcctgagcctgcaggtggcagcgcctggtcctaaggagcggccttctgtctgctcccaagagctgctgctgccagctccacagggcccctcccagccagaggagacactccgggctgctccccactctccagctctttttcccttcagctgccccttttcaggcctctcctccctggtgtgatcgtttttatctgacttgagaggagaggtttggcctgaccctgccttccgatggatctgaaacctacttttcagacaggggcttcaaatcccagactctctgcttttgaaagtttgatgatggtgggtggaaggttgcggggggcttcctgaaacctctcgtaactgggggtgatttcctcttagccgtaggctatttaggcaaggaaagaggtccttgttctcagtcaaaggagagatgatggcgtcagggctgaggcgccggcaggcctgggcctgcagagacgacctggctctgctcctgagaagcgctcacttcctcacctgccccaggccaccagagcagatgctttgccacatccaccacaaggtcctgtggcgttgcgctgccccggagccccactggggaaccccatactctcctgatgctaccagttgccattggagctgggagctgcccaggcggctgcacgatggctgtgagaaggccccgggcgcgccacgttttcctctgaaagtgctgtgagctgcggctgaagcttgccagtatcatgcgctgaattttaacgaataaggagaagggaggaggaggaggtatttggttggggtgaaatagaacaaaggccggctgagctcctggcagccctggcaggggctgcagaggaggcactgataggaggctaagccactgggcttccggggatgtgttggcgattctagctggcaacatcaaaccttatgccggcatcaggcccgccccctcggacccctgaagagctggtgtcgtgtaaacacagggtggggtctgcttcctctgcccggatgaacaccagactgttcttgctgtgctgaggtctggaggacacagtgcctacggtttccacctgtctacagagaattcagaccaccaagagtgattagttcaaaggtctgtaggccagggacagctaagaacaaggccagggcctagccttacagcttctgctcagaccacaaagaagagagccggctttaagcacaccttggaagcaacgccaccctgctgcccaggggaggtggcccattcaagagttcctatttgatttgtccatttcactgatggctgaactgaggctctgctcataagtgagcagctctagttagttgtgctagaatgtgttcctgaagtccttgcaaaatcagttgaaagagggcagggatggtgtctgctaccactgtgctcccagcccccaacacagcttcctgcacaatgccggcacttagggcacccacacgagaaagtttgtgtgcacaagtgcacagaaaggccatcacaaatgcctacttctggctgggctcatgctctctggactctctcaaaagaatgcacctgagggcatttggccttctccccctgcaggaagtggatgggtgtttatcaagtagctttattcagaaggaagacagaagagtcccaaagatcaaggtgacaggcggtgtgattttatggtcacataagaggaaacaggtttgagccatgacttagagaaacaggtgactgtcgcttcaatttacacaacacagtgtcatcagactctgccgggctgcaggctctgtgcccagagacacacccccaacccccctgttatgtcactgggcagccccaccaggcatcatgtaaatgtcacattacccttggcaggattcctccaacagcacatcggaaacttggctgcaggaaggcaggaatgtctggcgttgtcccgggctccctccctgcccgggcctgctgacccaagtcctgtgaccgtggcccagaaggaagggacaggcatgggcacaggctgacagattctgacccggagggactggggcatccccaggaaacgtgtgggtgcggtgtttgcatcggatgtccttactccttgctctggccctcggtgttgggggcacatggggacaccaggccatgcaggcagcaaccatagttgctgtcaccacaggaaagggaagctgcagacctaggaggggcagcgatctcttgggagacacagagcaatagcaaagcgatggcaaagccgggagggaattgtgagagaaagccctccgtgctgtgtgtagatgtggtggaatagtattcagccttcaaaaggaaggagattctgacaggtgctgccttgtggatgaaccttgagggcattgtgctgagtgagagaacgcagtcatgaagggacagacactgccagattttactcatatgaggtccctagagtggccagattcccagatacaggaagtagaagatggttgccaggggttgcaggtggggagaaatgagttatttttatgaggacagagtttcagtgttgtactatgaaatggttctggagatggtggtggtgggggctgcacagcagtgtggttaatgctgctgaactgtgcgcttgaagatggtcaattttaggttgtgtgcattttaacaaaatcaaaaataaatgtttaaaaagagtggactgtttggatcaacaaattagctaactcagcgtcttcgtctgtttaggctgccgtaatcataccatagactgggtggcttataaagaacagaaattgtggctgggcactgtggctcacgcctgtaatcccaatactttgggaggctgaggcgggcagatcactcgaggtcgggagttcaagaccagcctggccaacatggtaaaaccctgtctctactaaaaatagaaaaaaattagctgggtgtggtggtgagcaactgtaatcccagctgctcaggaggctgaggcagaagaattgcttgaacccaggggtcacaagttgcagtgagccgagatcacaccactgcattccagcctaggcaacagtgcgagactccgtctcaaaacaaaaaaagaacagaaatttctttctcacagttctggaggctagagtccaagaccaaggtgctggtagattctgtgtctgctgaggacctgcttcagctcctcctggctgcgtcctcacatggtggaaggaggaggggtctctctgcggtccctcttgtaagggcatggggcaccaccctcctcacctcccaaggcccggcctcctaacaccatcaccttgcgggtagaattcaacataaggacttggcagggacccacacattcagaccacagccttcagaaagttttactaacatatttcttggatatttgtaaatatttttatactcagtatatagatgtctttaaaacacaacttttaaagctaaaaataaagcaagctctcaaggtgcagccattgcatagaaccctctcgtgggcctagcgtggctgctgatggcccggggaggtgatgggcctggaggagggacgggtggggcatattcaggcctgcaaactcctctctgggatgagtagccacctggtgagggcctcaccttctcacttttccctggaacccctcgtgcgcccctcggagggccttgggtctccttatggccgccttgggcctcctgtgctgcgggtctcaggcctgccctgggcagcaggacatcatcaggctttctgcatgttcggacctgtgccaagagccgctgtagagaagactcattgacctgtccacacctttcagggatatgcagagatataccaaagacccctgtcctcaggagcgccgggtgactgagtctggtggaaggtgagggcgggtgaaggagtgggatctccctttctgctcccagcctaacctttcagctctctcctgccccctccccttctcccaacagcaggggaaggcagggtacaggctgtgtgagcacagctgtctccaggaggggagggagttgtctgggtgacagggcccaggttgcctgagcctctgagacctcgctccttccccctcgcactcccccgccccctggtagtggctccattctgtcaccttcaggagatgacctttgggccagagggagagggaattcagctgctatttttatgtgagcaggtcttgggccccaaggcggaggcaaggtttccaccatcatgctgaggcgtctccatccgagccctgcctgtccctccttcaaggcccaggggaaaagcacctgcttcccccattgcagagacaacccccccgaactcatgttagggcactgttgtaaaagtcaggattatttagctataagttacgtagagtaaaactcacccttttaaaaaaaaatgtgctattctgagagttttgagaaacatctgcagttgtgtaatcagcaccaccgtcaagacatagaacaattccaacacccaaagaaatttccgcatccctttttatagtcaatttctcccctcatcctcagcaaacactgacttttttttctgtccgctataattttgctttttccagaatgttgtataaatggaaatatatagtatgtatatatttggacctggcttccttcacttagaaaaatgcatttgagattaattcattgtgttgcatatattaagagttctttcctttttattactgagtagtgttctattgtatagatgcaccagttttttggtttgtttttcatttttttttgtttttttgttgttttgagacagggtctcactttgtcgcccaggctgtagtgctgtggcgcagtcatgactcactgcagccttgaactcccagacttaagtaatcctcacacctcagcctcccaagcagccgggacaacaggagtgtgccactgcacccagccaacttttttaattttttgtagagatggggtcccactatgttgcctaggctggtcttgaactcctggcttcaaatgatcctcctgcttcaacctcccaaagtgctgtaccagtttattaattcaccagttgaaggatgtttgaattgtctccagtttggggcaactatgaatagagccactgaaaacattgcattcaggattttgtgtgaacaaggtttcatatcttctaagagtggcatcgctaggttgtatggtaaatgtatgtttaactacagaagaaactgtcaaactattttccaaaatggctatactagtttgtatttccaccagtgacaaatgagagttcctgttgttccaaatcattgtcagcacttagtattgtcaggtttttgtagacgttagctggtctagtaggtgtagtgatgtttcattgtagttttaatgtatatagccctaaagattaatgatggtgaatatcatatcattatttgtcatctgtatatcttctttgctgaagtatgtgtttaaatcttctgtccactttttttttttttttactgagttttttttgttgttgttgttactgagttttgagagttctttatatactctgctacaagtcctttatcatatatgtgttttgcaatacggtcagccctccatatctgcaggtttcacctcctcagcttcaaccaattcagatcaaaaatattcaggggaaaaaataataaaaataataatacaacaataaaaatacagatgaaaaaccaacacagcataataattacttgcatagcatttccattatattaggtattataagtgatccagagataatttaaagtatacaggagggtgtgtataggtcatatgcacgtattacaccattttatatcggggacttgcacatcctagactttggtgcctgagaggggttctggaatcaattccctgcagacacagagggatagctgtgttttctctctgtcatgtttcttgtttcattttcttaacggcgtattttaaagagcttaagatttaaagttagatttgtctacttgttgagcactatgtacaaagcaagctccacaaatctttcttgagctgggacagtgcaccaggccccatgggatagcgataagcgagactcactgccattcacgcttagtggaagacccgaggtgcatcaggaaacaacccagcactctatcatttgataacattggaatgtgctaagtgcatgaaaaggaggaatgattcactctagaaaccagtgagggcttcacagaagatgagcttagctgacaatagatgctgaagctgtggagtgaatcagaagtggaaaaaacccggctcccctaagcaccgtattcagatatcatttttcatgcactgattctagaaacctggcactaaagagaaaattgcatggaggcaacatgtatgatgtggtacaattgaatccgggaaccctggtcctgtccttccctcccagccttgcaccttcctaacggctgctcctctcttgggtcctttgtggagtatccggcctgccttctgcagattgaccaagaataacagagcaggaacctttcggggaagagcaatgtgtagaaaggggaggcagggcatcttggaagtttgtcaagtagatgaggtatctggaagggggcagggggctttccagagcctcagatcatgcaaacagagggctgagttctccctccccgcgaagcgagctctaccaggggtaggtactgtccatcagacacaggcagcattaggaattccaagctccctagcaagagggctcctttcccacctccctcgggatgagtggttacctgtctattaaaaacactagcagcaattcaggtgtgatgctgtcattttttatcatggccctgaactcccagaattgttgttgccatcgaggggcagaggtaaaccctaggtttgagattccagatcgtctttgaaaggatgcaaccaatacttttgtttccaccacgagacgcttatttccctttcatctgcagctttccttcctcttctcttcctcctccgtggagaatcgtaccaattaatcactggaggcagacaaccactagagctcacgatccctgcctctcccttcatgatgtgaatgaggagagctcctggagctgggaacggcaccatggaaacgagctctggggcagaggcggcagtctggacaccgtcccagcctccccaacccgtctcactggcacctgacacccagagggcctgccggggtggcgtcagatgatgtgttgagtcaacagaaccccaggagagccctggttggagtcccatggcagccggctgcagccagcaccccaggaagggagtgtctgccaccggctgcagccgccacctggcctcctgggagacctggcgggaaggggaaagccgggcaggaaccacactcacagacggtctccccatccccgcctctgccgccttctcctgcttcgctgtacgtggctctccaaagtggaggtttgggaatgtgcttctgtggcccataccccacgtggcccacaccccatcgtgccaggtagaacaatgcattcttgtctcccctgagagctgtacacctggaaatggcttgggatacacttccaggaggggatggtgactgaaagccctccctgcatcacccacagcccttcccacctgtgcctcatccagagccgtgagcctggatgatcagagggagccctccagagtgaggataaacagctcaggaatgggaccattgtgggaggccactggagccccccaggaggggatctgttcatgagcagtgagctaccaccaagggttcagagcagactcaaagagctgaattatagaaagcacaggaaaaaactccaggtactattacagattttaaaaacgactatgctctggaagctttagtgtgacagggtcccagcgaggcgtgatcttgatttggttatcacactgattttccacttcattttcagccacattttctcctattcagggctcctcagagacttctgagtttggaggttcagggtgcaaaatgggtatagctcctctcagaagatggaacagggaggccggccaccctggaggagaggggaaccacgtgaacattttgagacccctcggaatacagattcctaaaacctgacttttggggagttagaagggccccgaagtgatttgagagacagagaaatctgtgtacccatgcttcattcatcagtttcgtcagatgatccaagtgtcctgagattcaagaaagttgaagaactacttcttccccagtttttaggaagtttcctcaagagctagaataataaacaaattgtcaacaaccaggaatttcaagagggactggaaacactccgcggcaagcagtgtccgaatcccgggcacagtgggggagcccgccgcggagttccctggccagcacagggcagggacgttgcagacggaagctctgatgatggaggcctccctgaaagaggcatgcttccagggcctcgcagccactggaccctccccacaccgcatctcatcggggtaaattccaagtttaccctcacatgagatctgctgttttacatcatagcgatagccgtgtataccggctttgccagacaattggcatgaacgatgctgtgttataaacaggcatctcgaagagatcaaggttagaatgacatttctgaaatctcgaactctagtcctgacctaagaacatgttcagacatgctcaggcaggatgggccacctgggggggctcctgcccaggaatattctggccccatcctgccgccagggccaggaagcctttcccctgctcactgggcaccctggcatcagctgagagtatgaaagtcccccaggtctcctattgaattggtgtccttcccttatttccttctaggaaatgacagtagtcaccatgctgactcagcaaggagcccgggggggggcctcatttcctcctcctcctcctcctcctccctccccttccaaacccaaagtgccaagtcttggccttccactacccgctccaccctatacacccttggcagctggccgagggagccccgttggggaggagggtggacacggagaggcagcccaaggcagatacacctctgacctgaggcacccacctcgcctggtgcgaccgtgtgctttttcctgtcgcccatacaaacggtcttctccccaacattccacagggatgaggtcaccgtcagaaacctcctggaatggagcaaggccctgggctgcggcctgaagacctgagtcatggctgtggacctgcttctggggtggggggtagatcctcggccacacacttcacctctcagagcctgcacttcctccaccgaaaatgaggttctgagatgtttgtccaaggtcatgcccattcttaccacctatgattctcatgctggcccattccagactatcacattcggcagagttcatctccacagcaccaaacaatgcctgttgcttttgtgattccacaaatactgataattagagggactgaggctgctaacatttccctttcattgacaaattattagcaaattgtttttccgaaaccattgtatatgggaaaagttctgtggcagaatttctctctctcacaaagcagcagaggggcctcccctgtgcctccccaggactgctttctaagtggcaacatcaagatgcatatctgctgttgtcttttgcccaagcgaagtatctagggttacgttttgggtccatgatgtagaactctgacctccaagcaagcgtgaagaaggaacagggcagacagcagaggctgggaccacattgtcagagttgggacagatttaaaattagcccctgtgagattctcctttccttcccctgcaccaccatttctgttttgttttgttagttcccatgtaaatacccatatgctagagccaactatttcataactaggtgcagaatgttattgggtatacaaagccctataagactggatattttccggattccttttaggagaataaccttggaaaaattcctgaaagttttttttttaaatagaaatattttttcaccttccatattaccatgatgctttgacttgaagatcactcagatattttccaacatattttgaacagtttcaatgacaaaagatcataaaacagattcttagagcctagaaccgaaatctgcagcctgaaaccttactccagattgaaatatgaattgagagtgagctcagctagggccagggccattcagctataaaggggccagagtccagaaactcctgctgagagagggggtcctgcaggggcagggctggagtggggtggggaggacaccaggcgggtgtgaaacttgtcttttaggaacattcagagcaaggtctcaaagcagctggctggaaaggagcagcagagctcaggagagctggcctggccggcagctgcataaacgcctggtacccggggacgaggcatcattccagggcgtttctgcatgaggctgaccttggctgcagggagagtcattcctatcagagtccaagcaggtggctgggaactcagaaggaagggaatttgctcttccatagaagggagctgtgagacaggatggaggcactcggaccacatgaccataaagaatgggaactaacaattactttagaagtttcctatctgtgaaatagggagattggattaaatgaatggttccaaaacatgtccaaccacccgcgtcacctggggaacgtcacacagctcacatccccaggctcctcctggccccatcggtcaggatcttccggtcctatgggcacatgtgttctcaatgctcccaggtgacttttggcccagccaggtttgagaactgaagcctgagaagcatcctaactgtctctgtggctcagatgctctactcagcatgtcgggttagactcagtggggacagggactggggactgcccagacaagggtttagagcaaaaccgtctcacagggaaagagggcactagcagatacataaacctagcatcttcgattaagccagctattcaagacatttgcaaaaagtaaaaatgccacttattttttgttttgttttaaaaaatatagattgctgagaagttacttttaaaaaaatgaggatcccaaggagcttttatttctgtgggtcatatgaatcaatattcaccatattagaatttttttttttttttttagagacagggtctttctgtcacccagattggagtccagcggcgcagttgtggctcattgcaaccgcaacctctcaggcttaagcaatcctccctcctcagcctcctgagtagctggggccaagggcacaggccaccatgcccagctaattttttattttttgtagaaatgggggtctcactatgttgcccaggctgatcttgaactcctgagctcccagcccctcccttctcggcctcccaaagtgctgggattataggcctaagccaccgaacctagcctatattagaaattaaaactgagaaaattttaaacattaattcatttataaatgacaaccataaactcattatatgttaaacaccctatttttcaagagtgtaaaggggtgctgaagctgaaatatttgtctaccacagcagttctcaaagagaagctgagcatgggataggggtgttggtggggtggccctgaggacaggcttctttcagagaagtattgggcagctggggctgtgggaggtagaatagttcaggttgaatggatcattctggaatgcatccaccaacacggagggtggagaatggtagaatggtcttgaagatgacctcgccactcccaccctgggctggggggaaagagaagaaatggctgaaggctcaggcaggcccgctctgtgtagggtattcctgcctctgtgcaaatgaaacagcagcctgcagtgggttatagaggaagtggactcctgggcctaagtggtactgatacctaaagtcaccctggtccaggcgctgttcaatgaactgacgtgtggcacctggagcttgtcttgggggtgaccagctttttccaatttcttacgtctccaggtgatgagaaaccagggactggcctccacgccctcaggaacagcttccagagtgcattgtggctgactgtggctgggggcactgggatggctatggccaggactgcctggaggagaccccaacttgtcagagagggctcagctgggatttctcacctccacactgagcctgtgtggaggggccgcagggtggagtcagccaggggtgagctgcagcttgaacttcaggtgtgtcacactcctgtcccccaggcaaggcagaagctagagctggctctgagcttccgaccagcagggtcttctcccggagacgtcacctgctatcaatggcagctgcccatactgaatacgggccttatcattcagtgtcctagggtgctttgcttcttacctcttactcatcacacaaagcccacgggcagctcagatgttcaaagaatgaagcaagcctctgagctgactcctctgaggccacatagctggcgagtggtgacttagggtccagcccaggtttctggccccagagctcagctgcttccacggtgctggccagtccttatcctggtttgggagtggaggctggaaactgtatcgttgggggcaggaaacaaggacattcagctggggttctgaaggggcttttcccaggggtgtgggcagggtttcaggagtcattaccgcccaggcctggagcgacgaggggaagaggagttgctggaggcatggcaggcagggtccctgaggatactgcccctctattccctggctcccccagcctcctgcagttgcctgcactgcccagagccattctggagtcagagggctgggcactcagctccagcggccctggagggtagggctctggaatgaggggtggaaggtaaaacctgcgggcaataggggccgtgcggggagagggtgtaggagccaggccagagggcacctgagaaagggccaaaacattgaagcagtgggtttgctccttgagaaaacagagtcctaagcagacatcagaggctgggttctgggtcacctgcctggcctgaacttgtgtcacacagggtctcgcgccgcccagggtctccgcctgcctgctggttgcatccctctgtgtgctacagctactcagcacaggtactcctgtccctctctggctgtggcactttcgttgggcacctccctgggccaccgttccccctcacggcgctcgccatcctccctccaaagtagggaacaacacctggcccctcactctgatgagtggtaggaggtttcaaaaccctgtataagcaaagcctccctccagtgtcaatggaaatgttgctcttctcacttcatggctcttgtaacaacagtcagcagaatacattacttccttcttgtcgttccgttcctcaggcaggaatgaggctctagctcattccatttacgcagtggaggggccggattgcaccagataggcatctggtctacctggtttatttttaccaaggcaaggggtggatttgtcccagagcccatggcaacttagtggtaaaaccagacctagagcttggggcttctgagggccaggcctctgtttccacccagcacagctattccgttccagcagggctcagttccctttggtggcacctctgttctcctcctcctcctctccagcgcctgccagcagggccaggccctgtgaagtcaccagcccatggctccccagtgtctggaccccctttcgtggtgttctgtgtggctgccaggagcagtttctgttccctcgctgggctgttcactgggcctggctgccgccctgggagaatcaaaggcattgttcactgcagaggctggcggcgtcctaaacaaagtccttaaggagcaggaaaaaggaggagatgtcttctcagaaggaacagaaagggggcacctgtctgtcctttggccagagccttcttgggtgactttggccatggcccagttctgcctgggcccttaggagaggcccctgggccggggcagacctgtgtcctcctccaggatcggggcccagctctttcctggggtttctgagccaccgtcccacccccaccctcaggccctctcctcttccctgagctcccccctgctttcctggttctcgactttattgcatggtggtgttggggctgattttttggttttgtccccatttctcctacagactacagggacttgctctaatccatcttagcacctccttcctcaacacccccagcatacttggcccgtggaagctgtccaggaactattcatttactgatcagacccaaggttgagttcagcagttgaccttatgattaagaaatacattggtctatttaaaagtaatggggggccaggcatggcggttcacacctatattcccagcactttgggaggctgaggcaggaggtgacttgataccaggagttcaagaccagcctgggcaacatagtaagatgccatctctacaaaaataaaaaaattagctggtgtaatggtatttgcctggagttccggctactcaggagactgaggtgggaggatcacttgagcccaggagtttgaggctgcagtgagccgtgatcataccattgtaccccagcctgggccacagagtgagaccttgtctcaaaaaaagtaatgagggattgtgtcagcattgcccattttcccttttatttatgaatagtgataccaacattgaaaagaaaaaaagcttaggaatcattcttactacccaccttacctgactcataagacagttgtttctctactgattgaatagcataaacctgagtagaagtcacttctttgttggtctacccttcctggctggcatggaagaaaaccctctttgggggaagcctgtccctccctacatggggctgtcccaccttaggaagcacatggggtcccaagctcactccgtctctgtgcccttctctcttctgtggcacctcttctttccctctgcagtcacccagtgtcatccaagctctccttcctgttggccccgtgaagccccacttctgggagagtaattcatacagctaaaatgtaattttaagtcttcatgttctttctctcggtgataccccagtttgattgtggcagaaagtgtctgggttatagagtcaggacagtggagctgaggtgtggtccctgccatttattcgctaaaggaccatggataagtagctgaactttctccagctaccagtttcttcatctgtgaggggcagagggggccagagtgtgtaagccctctgtaaacagggtggcatcgtgcaaaaaacaaaaaaaaagtgttgatgctgcaagactctaccccctcttaaaaacatttcgggtatcagtcaacagatagggcatatgttaggttccaggagggttcactccccatgcccctaactacacacatatccctaatgcacacactgtgagtctcagcatttcacctgtcccttcctctaaaagtttcccttccccctctgtagtccagagtgccacctgttttccccacaggagtcaccagctctggaaggaacaggaaggccaggtggaaagatgggagcagcttctgaacttggaaagatggcaatgatagagaatcattcagccccaccagaaatgaggtgttcccacccccaaatgaacagtccaccttctcatctcctcggccccagaggttcactcctgcatcccgccacctctctcacctcctttgggactgggttaggatcattccagtactcacacgggggtggcctgcaaggggacagggccatgggaggagcggacaccgtggtttgtgctcttaagagctctcggcagggggtggggaggggcttggtcacagttgcattctctttaaactgtttacttgaaagatgaacgttctgtacccaaagaactagcaaggagttttcatgggctgtgaacatcccttgcacaacagtgactaagcttcatccctgaagaatgttggaagtggaaaaacttctcgaagagaaagagcaagggagaggacagctcaggaaggcacagccatggccctgattctagtgggagacaggacagaggtcctggtcctggtcctcgtgggagacacccctgcacagagctggggggcgcgtcggggcaggcagggcaggaagcaggtcagtgcttaaatatggccttcgccagcctcttggctcaaaagcaaagcagtggctgaaaagaagtaattttctgaatggataatccattctcatgatagaaagtttgaaaaatcaaaaaggggatatgatgaaagtcctccctgccagttgttcccttccctggagacagccagtgtttccagatcctgccagagatagtctaggcaaaatcagacaggcagaatatagatactttctttccttttttcaaaactacaaatggtatcattcgatacagatggctctgcagttggctttcttcacttaccgctccatcttggagatgaaaggaacgaggatccctgtcatgttccgacaggaatggtggctgcctgtgcctgcagatgggccatgatttatctaacctcttcttgacgagcctctgcgtctccaggctctgcttttaaaagcaccatggtaatgaataagccgacacttagtacagtcgacacttagcaattacacaaataagtctatggccccagaaatggaattactgggtccaggaacatgcgcgtttgtggttttgatcagtggtgcctagataggcaccacagagtacctgtttcctctgggcctttgcccaatgcctgcatgggtgcagtttgggctcattttgttgtgttgtgttttgtgagataggatcttgctgtgtcacccaggctggagtgcagtggtgcagtcctagctcactgcagccttgaactcctgggctcaagcaatctcgccatgtagctgagactacaggcatatgtcaccatatctggccaatttttttttttttaatagagacagggtcttgccatgttgccctaggtggtctcaaactcctgggctcaagtgatccttctccctcagcctcccaaagtgccggggctacaggcatgagccaccgcacctggccagggctagttttgatcatgccctgctcagggatggacatagctacttttcagcattgtccatggaggaggctttagagatctctgtggctggccccttcctttacacacgaagaccccagccccccagaggggtttctctgcagggctgtcacaggtcatgaggatgtggggggtggcacaggtttttgaacctaaaacgccccccaccacatcctattcagctctgccccatcaggtccctgcacatgcctacaggaagcaggggcacagcccccgggaagtgccactgaaggggccctgtgtccagtggggaaaggggctgggagaggaggatgagaacattccctcttgactctcaggagaggagatagcctgtcctaggtgcattgtgggaccaggacgagcccctgctggagactttgttgctgcaggaaccactgaaggatatgactctggggtctaaggccccaggcagtgccccacactacacacaaaatagcacacaggcttctttgctctgcccctgcagatccccctgagaggccccgggcaggcctccccgagccctggctactgtctctatttctcagtgccaagcagctggagcctggccctgagaagggtccggatgggccggcagcccttttgtggtcctgcctgctgacacacccccatctctgaagagctgctaaaccacatcaggaccttcccactcttcctcttccctctccttcctccccaccccacctcaaagcagggttttcttctcaagacctttgggggaaaatattctacttttcttttttttctttttttttgagacagagtctcactctgtcacccaggctggaatggaatgcagtggcacaatctcagctcactgcaacctccgcctcttgggttcaagcgattctcctgcctcagcctctggagtggctgggactacaggcgcgcgccactacgcctagctaatatttgtatttttagtagagatggggttttgccatgttggccagtctggtcttgaactcctaacctcaggtggtccacccacttcagcctcctgaaatgctgagattataggcatgagccactgcacctggcctctatttttcaagagtttgggactttgttgtgagggccttttacattttaagtttcgggtcctaaccctctcctcctgcttccacccagagctgcctcccaagtgccagcccggggcttccagagggctttccactcacactgctcagtctcctgaagggactccctggaaaagggggctccttctctaataggtgacttcctaaacctcccccggacacacaaaacaaaacatgcgccccactctccacagagaggaacagattcaccctgaccttgagccggtcctctcactgttctttctgttccttgcctggtggcagcaggcatttgccagaccccttggctcaggacagcactgggtgccctggggcccagagggagtggcaggacccccgtccccaagacagacggtagatcttggtggggagaggggacttacatacttttatgtttggtttgaacgttaaacagtttgtcattaagtggtaacatacaggacagtgaaaaggctttatgagtttggtgacacgagggacaggaggacaggtccttccccatgaggatggagcaggagggacacgggtggttctgggagctgcgaggaggaggaacccagcagagatgcctggggagagtgaaccaggcctgtggctctgtaggtgacgcagccttgtccagaccagaaacagtgactggtggctctaggacctgataaaaggaaaacgtctgccgaattatgtttaaaggagtttgactgagcaatgaacgattcgcaaatcgagcagccttctgagccagagtagactccgagagcccagctctcagccatgtggtggaagaagattgatggacagaaaaaggaaagtgaccacagaaagcggaagtaaggcacagaaacacctggattggttacagctcagcatttgtcttacttgaacacggttggaacagttggctacatgtgattgccaaaactctggctggcacgaatgtaggctatggtctgttacagttcacaatgtacagaaaaccctttaggccaaacttaaaatatttaaggaggcagctctaggctacatgtaatttaacagggcatgttcactgacatctttggtttgacttgcataattcaaattttattttaaaattttatttttctacctgtaagatgtaagatatcagagggtgagtgtgatggctcatgcctgcaatcccagcactttgggaggccggggcaggcagatcacttgaggtcaggagttcgaaagcagcttgcccaacatggtgaaaccccatgtctactaaaaatatttttaaaagattagccaggcctggtggcaggtgcctgtaatcccagctactcaggatgctaaggcaggagaatcgcttgaacccgggaggcagaggttgcagtgagctgagatcacaccacagcactgcagcctgggcgacaagagtgaaaactctgtctcaaaaaaaaaagaaaaagagatttgagatatcagacccaaagccagattctgcttctcttagaacacaatccatgcattgcatcagtctcctcaggctgttataacaaagtgccaccgactgagtggcttaaaacaactaaaatttagccctgtcctgaaggccagaagttcaaaatcgaggtgttggcagcgccacgctctctctgaaacctgtaggggaggattcctctttgcctcgccctggcttctgggtttgccagcaatccccatcgcgccttggctgcagctgcattgctccgatcgctgcctctgccagcacgaggccttccctctgggtatccgtttctgtgtctcttttcctcttcttataaggacaccagtcacattgcattagggcccaccctagtccagcaaaatctcatctagacttggttgatctgaaaagaccctgtttccaaataaggtcacattcacaggtcacatcctacctgtgcactgtgccatgatttatttaacctcttcttgacgagcctctgcatctccagctctgctttcaaaagcaccatggtaatgaattaggtgtacactcgccacttaaaaattacataaataagtctatggaagaaatagagttgtttctgttagttagaaataagtcaaagtggagaacctttaactcccagaagattcatgtctccagtcttcctacaatcctccactaacaccgttgcccctcccattatttgccccctcccttttcctgaccatctaaatctgtttcactttttagaccccattccagtcccaccctttccctgaagtctccttgggtatttatcttcgcagtgaagtcttgctactgggaacttacagtggtgatgttcatgttgcacgttttggtaggaataacacatccatcccctcccctcccctcccctcccgtcccctccccctccccctcctcagatacatggtcccatggcttctgcagcattggcctgcatctctgctgcacattttccgaacttccccatgttttacctcaataaataaggcaccactgcgtttgctcttggcgccatgctggggaaagaaggagaggagatcaaatgatatttggctgaatggaggaaaatagcctctggagggtgtgtgtaaaagttcaccagataactcgggaccgtgtgagcaccccgttcccaatgaggggatgctgcccacaaccgagcgtggatagtgaggcgtttctggaaacagctgattctaagagactagaaattggtttttaaagcttttcctcaacattcagaataatttggcttcttgccatttgaggttttgggcaccaggaatggtgagagcctccctctgccatggcgggacctctgaccacctccaatgtcccttcctggaggccggacctctgactgcccccgacgtcccttcctggaggccggacctctgacctctccccatctcccttcctggagaccagacctctgaccacccccgacgtcccttcctggaagccggacctctgaccgtccttggtgtttcttctgcagcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgtaagtctgggcccttctgtgggtggggctgccgggtggcagagggagggcagagcagttattgccccaagctgagcagtctatctgcagccgaggctgaggtcgtgtgctcccgacatcttcaggatattgtaccataaatcacaggctgagggagaaatggtgagggcacaatagcaaatggaaatacacaaaaaatagctgggtgcggtggctcacacctgtagtcccagcactttgggaggccaagataggcagatcacttgaggccaggagttcgagaccagcctggccaacatggcaaaaccctgtctctaccaaaactgcaaaaattagctgggtgtggtggcgtgcacctgtatcccaactactcgggaggctgaggcataagaattgcttaaacctagatggcagacactgcagtgagctgagatcatgacaccgcactccagcccctatgtaacagagcagactctgtctgaaaaaaaaaagaaaaaaagaaacaaaatgaaaaatggtaacatctgggacatgaccaggaggaggtttttttcccctcagcttcttaaaaatcattcattgaaagctttatttgaatttaccttgcttgggatactacagtattcataaaatgtcataggtaaagcaaaaaaaaaaagtaaaacagaagtgttattctagaggtttaagattttgagtctgatgacatcatcagacttaggatgccctctttggaaggggagcatttcatagaggagtgggatggagcgacagacgtgtgcagcctccagcacttcctgagaccgaggcagcgaatctccgtggcttcactaagcacttaagcactctctgtttcaacacagtgggccctactgagaccccagctgtcactgctggtttaattaccgcaggtacccagtattattcccgtgcccagcgacactgtgagagccacatccctgggtctacctgtatggctggaaccactccattcagttgtcacattagtgtcgcatgtcactggggcatgacatagtgccacacactggatggcttaaaacaatagaaatgtactgtctcactgttctggaggccaaaagtccaaagtcaaggtgttggcagggctacactctcttcaaagcctctagggagagttcttccttgccttctccagcttcagcttgtgacagtgttactccagtctctgtcccgttctcacatagccatcttccctttgtctttctttgcatcccaatttccttcttataagaatacaaggccaggtgcggtggctcatgcctgtaaacccagcactttggaaggccaaggtgggtggatcacttgaggccaggagttccagaccagcctggccagcatggtgaaaccctgtctttactaaaaatacaaaaaattatcttggcgtggtggtgggcacctgtaatcccaactagtcaggagactgaggcatgagaaccgtgggaacccagaggcagaggttgcagtgagccgagattgcaccactgcactccggcctgggtgacagagcgagacactgtctcaaaaaaaaaaaaaaaaaaaaaagaacacaagctacattggatgagggcccacccctatcatcttaacctgattatatctacaaagaccctatttccaaaagtcacattcacaggtactgggacttagaacttcaacatctctttttaggagatacggtccaatctgtaacagttgttatcttttaggagaagatgcgttgccatgctgagaacatactattcctattcttgttcattcagttattttattaaacacaggtgtagcaaagtattatttcaggtgccaaaggttaaactgcaagttattgttcctgccttctagagcttacaatctgattgggaactgaacagtactggggcaaaacagctcagtaaagggggagagcggtttcgccgggataatgagtggcacagtcggccctacaggagggagaaacggaaaaccgctggtctgataagggcaatgacagcttcaaggcacgtcacctgctgggctgagcctggagtactgtcagtgtttacattaagggagagggaagggagaaccttctagaaaagaaaattaggctttgactagggatcatggattagaataaccccatttaagaagagacagtggtttgacgagaaaaccacgatttatttgagatcatttgaagggatagtgacagacacagacgcagggctcttccacgagtccctgatgtttgacggcagcagctttgtgctggggacaagcccagagccttcccagttgaaagaaaagagaatacagggagtgctctgggtttgctgtcagcttcctccccgcgagtgtaacaggaaagtggtgttcttatctccttataacccaactgtttataccccacacaaccacgcagcccttggtcaaggccaacaagtataggtccttccaggcttgccacggtgatcagagagggagtgtcctggggtcagagagagagtgagtatgctcagctgtgtcccatactcagcagctgacccagagcacgtgccctgtgcccagcacgcggctggcagcaggagtgtgcagtcgagtgggatttcaacaacaatccaaatgtcgtgaatggataaacaaatgtggtgtatacagatgatggaatagtacccagccttaaaaagagaggaagttccgacgcagggagtgacacggaggggccctgaggaccttgtgctgagtgaaataagccagtcacaaaaggacgcatactgcataatgccacttataggagtccctagagtcatccaaatagagacggaatgtagaatggtgggtaccgggggctggggggaggggaaaagatgagttagtgtttgacggagacagagtttcagtttggaaaagtgaaagagttggggcaatgaatggtggtgatggctgaacaacagtatgaatgtacttgctgcaactgaactgtacacttgaaaatcgttcgaatggtggctgggcgcagtggctcacgcctgtaatcccagcactttgggaggccgaagtgggtggatcacgagagatcgagaccatcctggctaatacggtgaagccccgtctctcctaaaaatacaaaaaattacccgggcgtgatggcagacacctgtaatcccagctacttgggaggctgaggcaggggaatcgcttgaacgcaggaggcagagcttgcagtgagccgagatggcgccactgcactccagcctgggcgacagagcgagactccttctcaaaaaaaaatagttcaaatggtggccgggagaggtggctcacgcctgtaatcccagggcaacaagagtgaaactccatctcaaaaaaaaaaaaaaaagttcaaatggtaacttttatgtatatttatcaccataaaccaaaaagaggaatgatctggtcaagactccaatttttatgtcatttgagcttctgaaaatcaggctgatggcccaaggctccccacttacattttgaaagggtgtatttcaaggaatggaagagaatgtccccattggttacctgatggtaagcaagcccctcaccccacttgtaagtttcagccctcaggccagcaagggctgccttcacctgcgtcattcacagcctctgtggccaaggtttggctcaagccctttctgctttcagcatcctggcagcaggttaacctgattactcagcaaagactctgcttccaaataaggttgcagtcacaggtaccagggcttagaacctcaacctcttttcagaggacgctattcaacccaaaacagttgttatcttttgggagaagatatgtttggcatgcagagaacatatcattacattctggcagcagggtgggtggtagtttcaagttcgtagaaatttgctcctttataattggattttattgagtatctttatgtgctaagttccttatgtgcttggctgattctgttaatttggctaccaggataatctctgtggaggaatgtgagttacttaaagacttttgatggtctgaaaatatttggatgtaatttatctctgccttttgtaataaaaagatactttctgtaaacatcgaccatgaagatcatttttataaaatctgttcccatgaattttattctaaaatagggaatggaatggagaaaattagtctttagaagacagcactcctttttttttttttttttttttttttttgagacagtctagctctgtcacccaggctggagtgccttgccgcgatctcagctcactgcaacctctgccttctgggttcaagcaattctcctgcctcggcctctcaagtagctggggctacaggcatgcaccaccacacccagctaatttttatatttttagtagagacggggttttgccatgttggccaggctggtcttgaactcttgacctcaggtgaatccgcccaccttggcctcccaaagtgctgggattataggcgtgagccaaccacgcgcggccaacagcactcattttatcatgtatttattcagcaaatacctattaagcaacttatgtgcctaaaactgctagcatgggtaataggatgacaaatatgtgagccctgctaatgggaaaaggccaatgtttgttttatttaccatttgattaacagctccgtgcattatgcataggaaggtgtcagtgaatatctactaattgaacaaaggaaggagcttttgtttctttgggaagaacagacaggtaattcattacaatggagtgtgatagaacccgttccgttattgtgggaggaaaccccatcctatcttgatgagtggaagagctgatcccagaggaagtcgaaattcttttcaacagggaaaagcaataatcagctgtgcattttagggtgatcccctaactggttatggaaattagattggaggtggttagaacaggagcccagacgagatgcagtgtgaagtaatctaggcccaggttgcagctgaaggtagaaagaaatggaatcgtgtttaaaagtagagggcaattttgaaggtaaaattgaaaggaatttggaaggtagtggttgattaattgaaggggaaggagacaaatcaggggtgattccaaaggttttgccatggaaaagtggatggatgatagttccagctctgggggtatggagcagaggaggaagagggcagggtgtatatgtgagtgcatgtgtgtgggtgtatgtgggcatgcatgcaggtgtgtgcacaggtgtgtgtgcatgcaagtgtgtgtgcatgcaggtgtatgtgcatgcaggtatgtgtgcatgcaggtgagtgtgcatgcgggtatgtgcacaggtgtgtgtgcatgcaggtgtgtgtgcatgcaggtgtgtgcacaggtgtgtatgcatgcaagtgtgtgtgcacaggtgtgtgcaggtgtgtgacaagttgtacatgcaagtgtgtgcacaggtgtgtgtgcatgcaggtatgtgcatgcaggtgtgtgtgcatgcaactgtgtgtgcaagtatgtatgcatgcaggtgtgtgcacaggtgtgtgcctgcaggtgcacaggtgtgtgtgtgtgcaagtgtgtgcacaggtgtgtgcgtgcaagtgtgtgcacaggtgtgtgtgcatgcaggtgtgtgcacaggtgtgtgtgtaggtggtggtagtccaataaggcgcctgtggcacatttaagtcgaggtgcccaaagggcaagtggatattgagtctggagctggaacttcaatttgaaaatcattcagatataagtggcaattggtgctataatagtaggtgaaataattcatagaaatgtatggcaggtgaaaagagaaccagaaaacacgtggacatctaagggacaatcgaaaaaaacggattctgaattccctggaaatgaggcagaaatccaagtgaacacagcatcacaggagcaaagggaatgtgtgtaatcgtgtttcacatactaagagtgttgagtgacatcaaatgcagccaactagttgtgtaacataaggtcgttgtgacttcggcaaggatacttttagtggcagggtcgacagcagaagccatgtaatgtgagttgatgattaagggataaagaagtggtgatctctagtgtagatagctcaagtatcctgatgtgagagagaggacaggggctgtagctagaagaatggaggtgatggcatcttcctacaaagaggaatagactcaaaccctactggggaaagagtgagtgcagggagaaattaaagattggagagaaaagaaagtgtcattcccgtcttacaaaggaaaggagtgcgtttccttataggcagtgggagcacatcaagcacttgcgatggagacgtttgtcttggaccaatgggaggagagtcatcttctattggtttgaaaacttctactgcaaaggtgttaggatgatcagcgcttttccaatttccttccacagcagtcactcccatgctccccatctttttctcctaggaattcacttttgatttattggaagcagagcctgagctggggtttcaggagcaagtttgtttgtttattaagggagtgctctcggaaggaacctgtaagagggtgagagaaaggaagaagaagctgagcaaagatgtggttgcagatgagatccactctcagcctgtgacagcagaggagattggtgctgtaaattgccccagaatttgccctaccttgaggcaagacagctggattttgtgccctcacacaagacaggctttagttataggatgtcccaggacaagggagatgcacctccagctgagatggctttgatcacccaagaacgatcctgctaaaaaggttgcaggtgtgagccatcggtagcagcttctgcagcagctgggtgcaccagagcccattaaaatgaatcgaggacatattctatagtctgaattctctatgctcttcttttgccagctgattcatgtatccagcagatttgagtcttgtctgtttaatgttgctgtaacaatatacctgaggctgggtagtttataaagagaagaggtttaattgattcatgattctggaggctggaaagctcaagatggagcagctgcatctgatgaaggcctcatgcctcttccactcatggaaagcagaaagggagcagacatgtgcaaagagatcacctggcaagagagagaaactgaggaagacaggcactttttaacaacctgctctcaagggaactaatccattcctgtgagatacccctgcagtagggtattaatctattcatgagggacctgcccccatggcccaaacacctcccactaggccccacctctcaacactgccacattgggggatcaaattgcaacatgggttttgacaggaacaaaccacatccaaaccatagctgatactacatcagtttttctattgctgcatagcaataacctccccaaaacttaacataaccaccatttacttaactcacaattctgtgggtcagcaatttgggtgggcattcttctggtcttgactgtgcttattcatactacatctttggtcacctaccaggttacttggggactggctggaccagagtgacctcggcaggaacagctaacttgtctcaattccacatggtctcttttccagcaggctagccccagctcgttcaaatgcctgtgacagggttccaagagagacagaagtatatgcaaggtcccttgaggcctaggctcagaacaggcacacggtagttcctcctatccaaggtagaatctgtttcctcctccccagatctgggttggccttatgatttgctttggccaacaaaatgaagcagaagtggcagtcacattacagagggagtggatacaggaagaagtggaggattaggcacacctctatctctaccaagacaatctaccttatcacttggtttcaacagctaggtctgcagttgaacacatgatgtactagatagaatctggaggttcatttggctatttttagatggttgacagctctgagaataatcttcctgtaaagtagattgttgcggtttgcatcccctcagatacaaactctaagaagagattggtgtgcaggatgtttatcatgaagtgctctgaggattgacacctgtgggagaagggaaggcaggaagattgggcagagggtgaagttgtgatgcaatgcagtctcaacaaaggcctcagctaacccacagggaggactaagctggggcggctcatcagagttatcccaggttggtgcaaagaaactaggcctttatactctgacaccagccagtcagtagacgacagctgtcctgggcagggagctgaccttgggcaaggcagctctctttagccaagggcaatcccggctaatagttgaaggttgtcagttggcagggttctcaacagctgggaaaatacccttcatttctgaaaggggatctgggtagtgcaccatggaaaatacatgggatttttctccccttcatttttaaatttatggtaccaaaatcctgacaggagaaaataagggctgtcctatttcttcttattatatatttaatatataactaaactaaagggaaggctgcaggatggttggttaggactgaatgaagaagtttcattaggcccaggcagggaggaactacggccccttgccaacagccatcactagcttgccagccatgggagggcataccatggaagtggatcatccagccccagtcaagccttcagattaggcagccccagctatacccaactgagagacctcataaaagaccatgaaccaggattgtccaactgaactggtcatgaattcctgacccacggaaaccataagagatactatattagtttgctgggactatcataacagaataccacagactgggcagcttaaacaacagaagttgatgtgtcacggttctggaggctggaagtccaagatcaaggtgttggcaggttcagtttctcctgaggcctctctccttggcttacagaggcatcactgtgctttcatccttggcagctcctctccttcttttaaggacacaagtcctattggactagggcctaccctatggcctcacttaattacctctttaaaggctctgtctgcaaatacagtcacattggaggttagggatccagcatatgaattttggggaaacacataacacataaattcagtccataacagataataaattattgttgtctgaagccactgagtttttggtgatttgttatggatcagtagataactaatacttgtttcatccggtgtgaggggaggtagcatagctcagtgaattgagccatggataataaactcaagagctttgggttgtttttaaaaatggactgtcttttgccattcagtcagtctccaagacccctagttctcctattatgaaaatctgggagaagatcactgaccagtctttcaaggttgttatgtgaaataattaccttttctttcaaagatagaaaggcacttaaaaaatctataaatatctcaaatcgcttgacattaaggaacagttaaagactttatatgcaccactttgctcttatattcctgactgccattttaaatacccttacaacctcatcaggtcttgatgttaaagctgtctgcccagaaatggtaaactagcagctctatagtctgtgactcacaacagattagatactttaaaaatagtttggaaaaatttcacattgggtcaaggagtaggagctacagagagaactgattctcagcgggattggttatcacgagagctggcgcttagacaagtgctgcctgtgtgctgaagagacaggcagagtgtgtctattctcccagctgtcaaaaaaatattataattggcattcttcctatgttcctgcactgttggaatcatgactcaatgaacagaaagaaggcagagagagagacacacacgactgggagcgtggcccttttttctgagcagtggccggggtctttgggattcttactcattctgttccccagggtagctgagctccaaagaaaagctgttggatctttttaatgtgataaactccctgcctctgtcgtctccccagggacccatgaggggactcacttgttcagtggtcatttcctatctgcttggcactgtcctaggcactgagcactcagagacagttgagatcattcctctctttgagagtctccccagcaaaaagggggtgcatcctgtagaagcagaactctggagctaaagccattgaagggtgcatcctgcctcttcactcacggggcagcaaaactaacagatgaaatacctactcctacagatgcacagattgcatggccttggattagcatcattttggtcacagggatgcaagtgtagggtgaaaaatggaaatgtccagtagtgtattattttgctctcttggttgatagagttctcaagataaaatctgcatcccttaaccatgacgatggccactttagggttcatattgaatttttccatcctagagaggcaaccctgccttcacctgggtgaggccagggctcaaatattggtgttgtagagttgagatgttcactagagtgaatcacaggtaacctacatatagcacctctattgggaggcagagtgcaccgtgattatctttttccctaacttgggctggcaatgtcaataaaggacatcacctaggtatgcagtagaccttaaatatgtgtatttcttgtctaagaaaccatcatgataaaactgtcaccaatttcaaagccagggacagaagccagttgcagagggttgcaaagtgagtgtgagatgacaaagtaagggtggaggatgtggacagctttatcaagaagcttggtgtgaagaggagatgtgagtgagggcttggctggaggaggagggggacccaggcagggagggcacctcttttaaaagatgagagtgactcggcatgtccctgtgctaatgggaagttcctgcaccttggatcccactgtacccgggcctctgttaaatgggaatatcggatttatctcacagggttgctgtgaggctcaaatgagataaaattgtgtaaagttactcccccaaaggctcaatggctagcaaacgctaaagccaagatttgaaccaaggcagctgggctccagaatccgtgttctcagcatggttgtccgtcacctctggagagatccgagattctcagctgatccaaggttgacgcagcatcttagctcatatacctgattaggggtttggcacatggtgtctcatgggtcaagtctggcccaccacctggttttgtgattaaagttttattggcacacagctacgtgcattcatttatttattgtccttgccgttttcatgctgcaacagcagagtgagttgctgcaacagagactatatggctcacaaagccgaaatatttctatctgggcttttttcagaaagtttgccaatctgtgactaatctgtgccagagcttccctttatactgctagccagttgcttgttggaacatccaatgcaaaggggcagattgagtctcatccccagaaaggcaagggacaaacagtagtgctttgcctcactaaagacgtggagtgcattccactggagagggcagtggaattagttatttgtcctgcccttaaggaggatcagactggccactaagctggcaaagtgggccagacgtggtggcttacgcctgtaatcccagcggtctaggaggccgaggtgggcagatcacttgagcccaggagttcgagaccagcctcaacacggcaaaaccccatctctcttaaaaatacaaaaaattagctgggctggtggtgcacgcctgtagtcccagctacttgggaggctgaggtgggagaatcatctgagcctgggaggtcgaggctgcagtgagccatgattttgcctgggcgagaggactgagaccctgtttgaaaaacaaaaacaaaaagaaaatgttggccaagtggtaaataatccagcagagttaggacttgaagattatactccttgccttcagagcgttatagaattacacactctgcttttgggctgattgaggagatttggagtaacataaagtgaaggtggaagggtctttgttcttccccttaacctccttgagtaaggaagggctgcacatttgaagtggcacagacaaacagcataaacttgcccttccctcccttgccatgatttccagaggagggacttgttcagatttgtgtcgtttttttgttttgttttgttttttaaattttggaagagaccagcgttttgccatgttggccaggctggtcttgaactcctgacctcaggtgatccacccacctcagcctcccaaagattcccaaagtaatcccaaatccaaagggattacaagtgtgagccactgtgccaagcccagacttgtgttttatgtatttgtttgtttttagagatagattctccctctgtcactcatgctggagtgtgatcatagctcactgcagcctcaaactcctgggctcaagctatcctgagtagcctcctaagtagctgggattaccagcacacaccaccatgcccgactaattttttttctgttgttgaagagataggttctccctgtgttgcccaggctggtcttgaacttctgggctcaagccatcctccttccttggcctcccaaagtgctgggagccaccacgcccagcaacagacttgcattttatggaatgattactctagtaacaggctagaggctggaatttatgcggaaaagactaaaccagaaaaccagtaaagtgctgcagtagcccagtgagaggtgacaaaaggctgaattacagccacaggagtggagattcagaggaaggaattcattataaaagtgcagcctggatatgtggcgtgtgggaagaggactctagggggactctccagtttctggcatgaaaggaaggatgacagtgtcattaaattagaaaaacactggacggagaagtagagctgggatgaaacctcagttccatctggggcacattttctttcattcctttgggacatcaaatagaaatggcacggacgtggatttagaagtctgatgtggagaagcagaggttaggaaaatgattctctttgtccattttatttcccatgccttaagtcaaccaaatcaagactctgaacactttctacctatgtaacagccggtgcggggaagaaagcaaatgtcgtttaattctaataagggatacttctttaccaatagagttgtgtgaaaatgcatttggggggctgaacattaaatggtggaaaaattactgtacctatttatgcatcctagacaggcttgtcttgatttgcatttagatgagaattccttcagctcagaaccgggactgtcccctaattcataagcacttagaaaagcattaactttagctggcgaggtatccttggtacaactgtgacacaaaacctaataccagtgttcccttaatgactcaggagaaagtagccattgaaatggtggaaaagtttagaacaagcttcctttgccatctctttgagaaggaacgcataccctgttaatcaatgaccgcccagcctctctcaccgtgcttgagtaaacctgtttcgaagggttgtgtattttttccactcttttggaggcttcgtgcaggactctaaagcattattattctaagtcctgagtaagaatgtcagctgctcatcgtagcgtgattacagacagaggtatattttatttttttaaaaaatggaaattgaaacaggtggttcaatgaaaagctttctaaggaactacacagatgaaattctaatacgatttctacagctctgcccgtgatttcctcttcatgtgctgaatcaaaagccctttgggaggccaaggtggggggttggatcatatgaggtcaggagttcaagaccagcctgaccaatatggtgaaatcccgtctctaccaaaaacataaaaattagccgggtgcggtggcttgtgcctgtagtcccagctattcaggaggctgaggcaggagaattgcttgaggcggaagttgcagtgagccaagattgcaccactgcactccagcctgggtgacagagcaagactccgtctcagaaaaacaaaaacaaaaacaaaaaaagacagtgaaaggcccatggctagttctttcacgaattggtcaggctattcaattatggtggttcggtctgattaagccattacttactttgcatttgatttttcaaaacacatacatctggagaagtatttggttctctcttttaaaaacaacattcctgtaagatgaagaagttctggagattggttacaccacagtgtgagcatgcttaatgctactgactgtctactgaaaaatggttaagatggcaaactatgctatgtgtattacaccacaactcaaaccttttaaaaatgacattcctctgattataaaaggaaaaacataaaaaagaaaattaaaacttcctggaatcccgcctctttgagacaaatggataaattccggtgtcacattttcgtctaacttttgttgttcctttatacacaaatacagaaatggacagataacagatgtagaccctgctagagactgttcagcaacttagcttttcacttaatagtataatcaggtccctgtcttcaatttacatggtttcattgttggaggaatgtcatcttttcaagtcttattttcataaaatctagtagacacacagtataagtattgctttatacaattcaaattataaagcaaactactggttctaatatagtaaacaacgaatgttacatatagcctggagagcatttattatataccaaaagccattggatagaggttgtattgctatttggatacaaatcgtgcaatttcagtagaatggctcactatgaatcagattcttttaagaaactaagtatacagtactttagtaccagggagaccataaacgtttctgagtcatttgcctgctcaagactcagctacgggtttgagaagctgggagattgaaagaaaggagattttccttcttaagatctgtccacgttcctggacttgaatctgccctttcacttttattatgtctaacaattaaagattgatttggggaatctctgaataccagtctatgtgttcactactcagatctaataatactagcattgggatgtggtattaatatggtttattcttttccggaatgtaggaatgaattgtggaaataactttttttggagacagggtctcactctgtcacccaggctggagtacagtggcatgatcatagctcactgtaacctcgaactcccagcctcaagcagtcctcccacctcggcctcccgagtagctgggactacaggcatgcactaccacgcctggcagagaaataatttcgcatgagccgtgagtgatgtgttcagacacagctagtgggaaaatatatacttaatccattccgaattttttctagcggagcctccaagaggctatctatagccctccatgctgaaataatcaaagacattatcttcaaactaaagcctttgtcttagcttaagaatgtgtgatcctttctgttcccaagacacacgtctatagatggggctgtgtttacactctgcctgcctacttattcaatcttacaaatgggcaattaaaggaaaattctgtttcccaccaggcattaactgtatattgcatttagtctacacattagtttcacacgcatctgtctgcccggtcaccatgtgtgaacccctgtgttaagatatctgcgtggtgtgagaagaaaagcctcaaggtcaacacaaatactgatccatgcctttttataaggtggtaaagcaaatacaaagggcttttagaaccagtagactcagtgcatcgtcagcatttaccctgttaacctgacttaaatgggagtggtggacatgccatggactcccctgaacaaagcaaagtcaattttctatttttctgagaaacagaagcaggaggcaaaaagagcagtagagcaggaatctatggcctggataaaacaaacacaaattttttttaagtctatgcaaaacaaaatcataaagacccagctttttaaataaaccgcctagatccaatgtcagaagatggaattgtatttacaaatatattttgttgagtggcttgggtgcatagaaaaaggtcaaattttatttctgttcaaacagcactgtagcaagttactatgaatcatggttgattgctcaggcaccagatcccctcacttctcaagaaagtcagcaaaatcttcctgcagctcaacacagtaccagcaatactgtacccatccattatattgcattcccttcccctccaatcttactgaatcacattctgacttgactcagcagatcattgtcatcagtaattaggaaattctttgcctcttttccatcttagtcctttaatacaaatgggcaccagtcaaataatagaaactggcttttcgtttgtctacaccagaaataacctgatagaacgcttataatgtgttctgctagatgcttagtgatagagctgcagattagtttaaaatcatcttataacatgttcttcattaatgtgcttgggataagcctatttttgtactgtttcggcgtgtgttcgcaccccaatactgaattagatcaggcacatttggtggcaaataatttttgaaaatgttattttcagtcttaaaataattttcaatggatttggcaaatgcataaaacaactcttactttgtaggtgctctgggatctgtgaaatactttttttttttttttttttgcgacaatcttgctctgtcacccaggctggagtgcaatggcgtgatcttggcttactgcaacctttgcctcccaggttcaagcgattcttctgcctcagcctcctgagtagctgggattacgggcacgcgccaccacgcctggctaattttgtatttttagtagagacggggtttcaccatgttggtcaggctgttctcaaactcctgacctcatgatccgcccgcctcagcctcccaaagtgctgggattacatgcatgagccactgcacccagccctattattcttatttatttatttatttatttatttatttatttatttatgagacggactcttgctctgtcaccaggctggagtacagtggcgcaatctcggctcactgcaatctccgcctcccgggttcacgccattctcctgcctcagcctcctgagtaggtgggactacatgcgtgcgccaccatgcccagctaatttttgtatttttagtagagatggggtttcactgtgttagccaggctggtctcaaactcctgacctcaagtgatccacccgccttggcctcccaaagtgctgggattacaggcatgagccactgcacctgccctccatcattctttaaacacaatattgtttatgtgtcttactttacaaataaaaacaagcatttgacacatttgacttctcaaagtagatggagctgcttttttgtctcatcctcacagcccaaagcagttagtctcttctgcctggtgtctagactatgaaggtaggggcttggattcaaacccacttgttgatgcctgttatgggccagccacacacaagttcagttcattctcacaacagtcctgcaaagaagatattattatctctattttgcaagttaagaaccaaggtttagaaaaataaaatctactggagattgtatgactagtaaatgattgagataggattcaaattgagacctacctttggaatccatgttcttttcattttaccaaatggcactccccactcccaaaccaacaacagcatttattgccacctagcctgagccaagacctataccaggcacacagtggacattggcacgaggcttagagactgacacacagaacagtccagcagtgagtcagtggcatagctgggactcagagccagaactaccgagagaggaaaggtgcaagctttgagcccaacctatgtcttcttccataggcgatgtttgctgtcttcattttatatacactatggtcacacaatttgactttgagaatattcttcaaaatcttaattaaaatcagttaacagctgatgaataaccaccccccctttttttttttgagatggagtctcactgtgtcgcccaggctggagtgcagtggcacaatctcagctcattgcaacctccgcctcccaggttcaagccatcctcctgtctcagcctccccagtaactgggattccaggcgcctgccaccatgcccagctaatttttgtatttttagtagagatggggtttcaccatgttggccaggctggtctcgaactcctgacctcaagtgatccacctgcttcggcctcccaaagtgctggaattacaggcgtgagccaccgagcctggcctaaatatgcttttgaggttttacctttgcacttttgaattccacgatgttacttgaatcaaactactgatccaatacaatcaagttacctttcattcttaaatcaggaaacaacaacatcaaaagagaaaacacattttttatttatttacacatgctacctaagacattggcatccctctacctgcatcctaataaatggattcaatccttcaaaggtttatgtttagctaaatatattgttggattaagatatttgcatatggaataaatcctggggtttgttgttgttattgttttgagatgcagtcttgctctgttgcccaggcttgagggcaatggcgcagtcttggctcactgtaacctccacctcctggattcaagcgattcttctgcctcagcctcccgagtagctgggattacaggtgcacaccaccatgtgcagctaatgtttgtattattagtagagatggggtttcaccatgttggccaggctcatcttgaactcctgacctcaggtgattcgcccaacctcaacctcccaaattgctgggatcacaggcataagccaccatgcccggccaaattctgggttttcttattgtcgtgaaacgtagtttgtattgtcatccttttaaaattgttggttatttccagtttttcgtgactcattcattagataacaaatttatagttatcaatggctatgataaatgaatatgtacttataatttttaaaacttaactacaataaagcacaatatagtgctactcaggtttcaggtttaaaaaaattagactgagtttttgtttactgataaaaattccagggtttcaaacagctgtattgctgttaatgaaatttacaaattaagtttgcctgtttgacttttaccatgtcacagagaaataactaaatgaattttcaccagatttgggtagtatgtttgagatggcctgactcaaagtgtaggctatgtggggtgtgataataatttactgagctcttactaagtgctggcactcttataagtgctgtctgtgtaattaactcacatattccttaccgctctatgaggtaggtgctgctacgatcccattttacagatgaggaaactgaggcacgagcagcttcatggatgtttcacagcacacagggccctgtgtttagatgagtcccatccttgatttgatgctctattgtcatagtctggaaattcccaatttttgaacaagggacctctcattttctttttgctctggatctggcaaattatgtagccagtcctggagcaatttaataaattgctcaagccagggttaagcccaggtagtatgtccagaatccatactccttaccattgctaaactacccttggaaactgagttttagtcctagagaggctgccaagccaccaagcagctgtgggcttcttgcccagggtgctacttcacacacaggtgattctgcatgggctgtgttagggtccagcagcagagagattaaggagggctcacgattcttaggagcgatcagctcatatctaataggctattttgaagaggaaaatggaaaaagcaatgccgcacagagtacttttgggccaaatacctttgaatggcagtgtagggctgtccagagatggcgtaccctttcatttctctgatgtggtgtccttcaagaatacaaaactattgctgtttctttctgaaagaatacccaagaaataacaagtaaaaaaataaaaatataatgacttgttcacatatttcccgagtaatacttgtcatttgagtccctctcctcaggttaaatttgggaatatttcattttcaagagtgaattcaacaacaacgtatcccagccgggcatggtggctcatgtctgtaatcccagcactttgagaggccaaggtgggtggattacttgaggccaggatttcgagaccagcctggccaacatggcaaaaccccgttgctactaaaaatacaaaaattagccaggcgtggtggcacatgcctgtagccccagctacttgggaagctggggcatgagaacagctcgaatccaggagatggaggttgcagcaagccaagatcacaccactgcaccccagcctgggccatagagcgagactctgtctcaaaaaagaaaaacccagcatatcctgagctactttgacatttctcctcctcctctactttgtctccctttactgtctctggcactttctccaatatcagactgagcatagtaaaagcacaggagaaaaatgacaaaaaggaaggtgaactatagtacactatatggtttggctcaggtatcagtagtatttgcatagtcgtaataagttgaaaccttgaatattgacatagcaaaagaattcataactatatggacagtgggaggaagggtttgggggcaaggtgcatttgtgagaggtagtcttgataggcatagagaaaaaatagaaatgactaacatcagtgagccatatgagttaaggaggggaagctagcaatgctgtgattgtgtctggggtgcaagaagactgcagcacagaaggcgggccaggggatggcttgctgcaagcctcgtcctcatccttcaccatgggacatcctgtagacacgtttctttgaagacaaagttaaatggaagaaaggctttcctggttggcatatctatgatcagccaatgaacactgtatgactatttcaaaaggatgggtttgtctgtccaaaaacagataaagaaaaccccagcatctataaaacacaaagaaattatcctcattttgaaaacaccatgatttaaaacatctaaaataattatgataatttttaaacaagtaaaattatattgcatataagggtatttatcaacttaagtagggttcagtctcttttgaggaatagaaatttgacagatttctgtcattatgagtatatgaaaggattgggcttatctgcagcgagacgtgtaccaagtctgtaagatttttgttcgttttgagatggagtctcgctctgtcactcaggctagagtgcagtgacacaatctcagctcactgcaacctccagctccagggttcaagtgattctcctgcctcagcctcccaagtagctgggattacaggcatccgtcaccatgcttggctaatttttgtatttctagtagagacttggtttcaccatgctggccaggctgatctcaaacccctaacctcaggtgatcggcccgcctcagactcacaaagtgctggaattagaggcatgagccactgcacccagccccaagtctgtaacatgttaaaaaagaattttcaacccattcctgtttgcttctctgttgcatttccaacccatgatttggattctagtagcctgaggttatccaggttgtcgtatcggtgggtgagaataactaaattatgtacattttgttaattatccagtactcataaggacaaattttttcctgttttcgatctaaaggggactgaagctatattaatcagcactagaatagtctaaaaccccttgcactttaaaatatgtatgtggtatttaggcaaaaagctaacgtatttttttttaacaagcaaatttaatgataattttttcacactgaaaacactactaatgatgtggttgagataaagggaacaggacctcttggtttatagaaggtagtagaaatttggattatagctgtactaggctctgctatgatgattaaagttttttctgttgatacctcacacaattctagggcattaagttcagagaaaaggaggaaagggatatttcctttaactttcattagcgcctgagttatttctgagcttgaggtcttgctgtacggcagttcagtagttatcaaatcagttggtctcaggacccctgtgtactcataattattgagacccaaacaagccgggtgtggtggcttccatctgtaatcctgacactctgggaggctgaggcgggcagatcgcttgagcccaggagttcaagcccagcctggacaacgtggtgaaaccccatcactacagaaaaattagccaggtgtggtggctcacatctgtagtcccagccactcatgagaaggaccacttgagcctgggggtgaagaggttgcagtgagcccgatcatgccattgtactctagcctgggtgaccccatctcaaaaagaaaaaagagacccaatgggcttttttggatattgggttccatctactaatatttaccatattgtgtgcctgctttgacagcacatatactaaaactgggatgatacagagaagattagcaaaacaagaaaagaaaaaagaaaaagaatttaccatattataaattaaaactttttaaatattaatttatctgaaaagatcagtaataaactcattacatattagcataaatccatctttgtgaaaaagaactccttttacattgctgcaaagctttttcatgtctgggttagaagaattcggtggaattctcagatctgcttcagcacccggtctgttgccatatgttgttttggttgaagcacatgaagaaaatcgagcctcagacagataggcggttggaaaaaaagagaggagtgtattggtttacctcttcagataattgtggatagccttcttgacaagtggtggggttttttaaatatttaactgctaaataaaaatcgtatataattatggggtacactgtgatgctgtgatatgtgtatacaatacagaatgattaaaccgagctaattaacgtatctgtcacctcacatacctatcatttctttgtgagaacacttaaaatctacacttagcagtctttattattaactgtagtcacagtgctgtgcgatacatcagaacttatttctcccatgaaactgaaactttgtacactttggccagcctcctgcctttccccatccaaccccagccccagtctctggaacctccattctactcgctgcctttatgagtttcactgtttataatctacaagtgagctcatgcagtacttgtctttccgtgcttggcttatttcacttagcctgatgtcatctgtgacaacatggatgaacccagaggacaagtggtagtttcttgaaggttagccgcagtgtgtaatctgacaccatatcattgaacttttcggagcctacttacctagagtctattatgttagaatctgtccatctatcttgcatttttggttttttgtttgtttttaggtggagtctcgccctgttgcctaggctggagtgcagtggcgcaatctcagctcactgcaacctccacctcccgggttcaagagattctcctacctcagcctctcgaacagctgggattacaggcactcgccaccaagcccagctaatttttgtatttttagtagagacggggtttcactatgttggccaggatggtctcgaactgctgacctcaagtgatctgcccaccttggcctcccaaagtgctgggattacaggcatgagccaccgtgcccagccctatcttgtatttcgaatggatctttcacccatgcatgattttataataccatgcattagtcatctggaaaatattggctcactgactaatgcagatcttccaaataggaacacattttgttacacaataactaaaaagcatttcttaataacaccactaatctccccagagaaatctctaagtatggggaaattgtcaagctcatcgtggcagacacaaggtttccaaaattctaatttttgcttgaaaactcaaactttatcattgacaacaaatatgtcagttgttttccttgcagtgacaggctcagtttattcattttgaaaaaaaactgtctaccaaatacccaggtccaaataactacaatttttcagggttttaaaagcagctcaattgcacatgttttcctcaagaacatcatcataatttgcaacggaaaagttatatgtgcacctctcatttcatcacacagaatattaaaaagacacatactcaagagctgagatttgacaaaatgaataaatgtatggcattatcaaagaccttcttaagtgacactggccttctcccctggagtaggaggttgtcacagtttgccactgccttgttgatgtgaattaaggcaccagaatttgccacggtgctgacattgatggggaaaagcaatggtgggtaaaaagcaaatgacgccttagtgttggcacaaaaagtttccacctgtagactccctgaaaaggtttcatggaccctcaggagtcctctggccagttttcaaactgctagtatagcgtgtcagcatatgtcactgttgtcaagcattactgtcatccacagatctttaggaacacagcgacaggaactgctgagtttggtaggatttaggaccataaccccttcccctgctctggttccaatcttaacatgcaaaccattccctagaggtaaagtttgcgtaattgcccacttctcagcagaaaaatcattaaccattaccatttttcttctaaattttttttttttttgagactgggtttcgctatcacccaggcccacttctcagcaggaaaatagtcaaccattaccatttttctcttaaacttttttgttgagacaggctctctcactctgtcactcaggctggagtgcagtgatgtgatcacagctcactgcagcctccacctcccaggcaatcctcccgcctcaggctcctgagtagctgggactataggcgcgtgccaccgtgtccggctaattttctttttaatttttgctgtttaaaaagaaaatagaaataccaagtagtcattacgctttgcaacacatacaggggtgtgtgtcggggaggtgagggggacatttcctccagatatgtagaattagatacctgcatatccctttaaaaagcactgtatgagtccattctctcattgctataaatacctgagactgggtaatttataaaggaaagaggtttaattggctcacagttctgcaggctgtacaggaagcatgatgctggtatccgctcggcttctctggaggcttcagtaaaattataatcatggcagaaggtgaaggggccgcacatacctcacgtggcgggagcaggagcaagaaggaggggaggcactgcatgcttttgaacaaccagctctcatgaaaattcactgactatcacgaggacagcactgaggggattgtgctaaaccattcatgagaaaccgcccccatgatccaatcacctcctaccagccccacatccaacactggagattacaattgggcatgagatttgggtggggacacagatccaaaccatatcaagcacaaccaacatgacaaaagttggtacacactaatttttcaccatattacttgcaacttaaaaatgcagtcttggccaggcacggtggttcacacctgtaatcccagcactttgggaggccaaggtgagaggatcacttgagatcaggagttcaagaccagcctggacaacatggtgaaactccatctctgctaaacatacacaacttagccaggtgtggtggtaggtgcctgcaatcccagctactcaggaggctgaggcaggagaatcgtttgaacctgggaggtggaggttgcagtgagccaagatcacaccactgcactccaacctcggcaacagaatgagactccgtctcaaataaaataaaataaaataaaataaaataatcattccttccctcaggtctaacttagtacagacactggctacttgctcttcgggtgaagggaaatttgagcacatttagtgacaagaacattcctttaactcatatcccatatgaatgactacgtctttcggtcaagaggcatccgaagatgtacactctatttctttattatgtagtctctgatcataaaaaggaaaaaaaaaaaatcctggtcctctctcacatacctgatttttcccctttctttctgttttttaaagagacgggggtctcactatgttgccttgggttaaaactcctgggttccagccatcctcctgcctcaccctcccacgtagctgggactacagacatggaccactgcacccagccctctattacatttcattttaaagtaaactattattttacagtacttgactcataattgatttcatgacccatgagtgggtcacagtttacagttttaaaaacactggtttagattttcattccctaaagcctggtttctcagcttccaattatagcaaatgcctttgtgttgcagctactagggctgcttgttaaatcgatgtctcttccctttcaccctttgagaagacaccggcccctcctagcaatgtctccgtgcttttcccgggtgccccagcccttcatgctgactccgcttgttctcacacaccagttttcccaaagcagggggcatgaggaccacggtgggatgcaagatgctttcaggcggtacaaggatgaacgttttcatagcgacatttttgtatatcatggaaaaatatatctgaaacagcaaaacctatgatttcatggaattgttgcctaagggaagacttgggggtttaagtcaatttaaataactgtgtaggttgtatggggatatgatagaatgacacctgtccaaagtttgggaggcatagctgatgaatcaaaaatctctgtcattcttcctcagcatgatccacaccacccacccctcctctccgccaaatgacactggaagctactctagttacacaccaaaggtacttttttggacagccttgtaatagctgaagtttaacagattgattgcagcattccccctttattacctcacacaggcccattcaatccctgttccctgacattcccaatctctttcctatttacttcctaatccacaaagtcgaaactgttcttatctctgcagtacctctgacctgctcgcttaatttttacattcattgtaaagacgtcttcaatgtccccgctgactccaggctctcctgcagccaaccctctctactgtatgcagatattaggatttttttatattgccaaaaacgatttgagattatctacattcacttcttacatgcaatcctaagaaatccaattccattcctttcactcccagtggtctccaatctttctttcacttctctacaagaatgttctactctcagataaagaccatcagcacatcctgaccttcaggctcttcctctgccacagccgccacccgaatgtccacctttccttgctcccttcaaaatctgcctctgcacatctctgtaggaagccttcctctcaaaggtttccttagcatttgtgcccacaatgcagtcgctatagctttttattatttaaattactttgtaattttttacagtgtgacatatgcagaaatctgatttccccaattataactgtcacctaattagaatataaccttctgagggccgggcctgtatctcattgaatacccaaatgttacctaggctgtttctggctgcaaagcagcagagaattccaactcaaactggcttgaaggataaggacatctattgtatcatccatacaggtacagaagcaggccaggccccaggcaaggtgagatacagccctgctcaatgctgtcacctaggacccacgttcttctctctctctgcaatggcttcatctgaaggctgtttctcaatagcagtcagggctgcatgcttgcttgtggcaagaacaggggatggacggggctgtgcacacatgcatgtgcggtctggctctctccaaccctgagtcctccctggtagcccagggtagctcgagagagcttgtcactatcatgaaagcatatatactgcaacagcatttgggttattctaggaaggaaggtagaggaagaggaatggatgccaagtaggcagccatgagtacccgctccagctggctccagtgtgcacacgtcaaatggtggataccactactgaggttgtgcacgtgagctgaaagcagcagatatccatctatccatgtgtaatatgacataggtaatctgtaatattacatatatgtgtaacatatagtacatattttatatgtatgagccaaggaataactaaaatgatacattttgataagaatcagagttatgtataatacactgaacacatagctaaaattatacagtatcggggaattgcaaaataatttaagaggcagtagatgatgtgattacttatgcagaaaaatcctaagaaatctacaaaattaccactagaacttacaagtgaatttagcaaggtcacaggatacaaggttaatgtatgaaaatccactgtatttttatatgctaacagcaaacaattgggaaatgaaattttataagcaatttcatttatgagagcatcaaaaaataaatacttaggaataaatttaacaaaagatatgtaagacctccatggtgaaaactacaaaagattgctgagagaaatcaaagggctaaacaaatggaaagatatgccatgatcatggattggaacacttaatactgttgtcatttcttcccaaattgatctgtagatcaaatgccgtcccagccaagattccagtaggttttatttttaattctggaatgtatatagaaacataaggaacttaaaggactcacagccattttttaaatgaagaacaaagttggagaatgtccactacctgattttaaggcctattatagagctacagtaatcaaaacagtgtggtcatgatgaaagtatagatataaatcaatgaacaaaatagagaatccagaaatagatccccatatatggtcaattgattttaaataaaggtaccaagggaatccagtgaggcagcaaaatcttttcaacaagcaatgtggaacaattggatttcagtatggaaaatatgaacctcaacccttgccacatatcataatttaaaaattaaatcaaaatggatcctaggcctagtaaaaggaaaatgtaaaacttctagaaggaaacatttaagacaatcctcacaaccttggaagaagaggaggcaaagatttcttagctaggacagaaaaagcatgagtcataatataataaataggatcttatcaaaattaaaaacttgctctttgaaagacatgactaggaatatgaaaaggcaagccacagaaggagagaaaatattcactattcacagtacatgtgtctgacaaaggacttacatcctaaatgcatttttttaaaacccattgtattatctagttgtgtaagagattaccacaaacttagtggctgaaatcatgcattgattatctcatagcttctgtaggtcagaagttcaggtacagcttagttgagtcctctgcctcaggctcttttgtgaagcttgcaatcaagatgttggccaggaccagggtctcatccgaaggctcagctggggaaggatccctttccaagctcatgtggttagtggcagtgtttagttccttgcaagcggttagactgagagccttagttcattgacatgggcctctcccgcatggcagcttgcttcaccaaagccagcaagatagtgatctgctagaaagacaagccacagtcttatgtatatagacagaagcttaataatggaagtggtgtcccatcacctgtgctgaatactgttggctagaagtaagtcactaggtcctgctcacactcaagaagagggatacacaagtacatgaatgccaggaggtggggatcatgcattgggggccatctcagagtctgcttgccatattcatacaactcaataagaacaaaaactctaataaataaatagacaaaagatgtgtacagtcacttcacaaaagaaaacacattaattaccaataaacacaaaaagatattgtcctcaaggaaatgcaaattaaactcacagcaagaaacctatacacccactagaatgactaaaatgataaaaaatgttaagagaccataccaagcattgatgaggacatgaagcaactggaactctcaaccactttgggcagaaatgtaaaatggtacagccagtctgtgaaatgggtggtttctcatattaaacacacacctaccaaatgactcagccattctactccttggtatttgcccaagagaaatgaaagcatgttcctacaaagacttgaccacacatgttcacagctttattcccaatggtcaaaaagtgaaaatatcccacatgtccatcaactggtgaatgaatagacaaaatggggtctatccatagaatgggatgctacttagcaatagaaatgaacaaactactggtatactgagcgacatgaatgaatggcaaaataattatgctaagtgaaataatccaggagcaaaagcacatatactgtatgattccatatacacaaaattctaggaaatatttatagtgacatagtgataaaaagtagatcagtggttgccttgaagaaggggtgaaccacaaaggagcatgagcaaacttttggagtgataaaaaaattttctctatattttatttttttaattttctctttaacatttatttactttttaaattttatttttccataagttattggcatacaggtggtatttggttacatgaacttacatgagtaagttatttagtggagatttgtaagatcctggtgcatccatcacccgagcagtatactctgcaccatgtttgtagtcttttatcccttgccccgcttccgctcttccctccaagtccccacagtctattgtatcattcttatgcctttgcgtcctcatagcttagctcccacatatcagtgagaacacacaatgtttcgttttccattcctgaattacttcacttggaataatagtctctagtcttatccaggtcattgcaaatgctgttaatttattgctttttatgactgaatagtattccatcgtataattgtactgatgatttcatcctagctcatcaaattgtacacttggaatagaaatcgtttattgttggtaaattacacacaacaaaaagggacactacaaatcattctttaaaggatttgcattatgaggtatgaaggtcctgcttctccatttccttggctctgtgtctgcagttcactctaatccaccataagtggctatgtaacactgtggatagtaaatgaagaccactgaagtctccagaatgtagaagatgtggtggaggcattagtgggtccctttaatttcagctggaatattgtacttccttttgatcacgttatgtagagcagaactgaagtggaagtagtctgtctcaatcatgtttgtaatttttcaccaatttaggaatagagcttccacccaatatgggatttaaaggggctgaaaaacagttaacagtgatctgttctagaaagggttaatgaataggtcagttgcaggggagggagcagagaatagaaaacagagactgccttgtgacactatatcattctgtacattgcattctaatataaatacaacatatttcaaagtttgtgacttggctgcattaagaattgaaaggttagatgaacttggtgagcattacttatttttttatttgcaatgtattataagacaatactaagagttatcaacctataagagaatataaatattccgctcccaataactcatgttaaacacaaagctaataataaaatattttgattggcaaaaaaatggatttatttgtgaaaggcaagagatgtatgcatttcagactgtaacgaatgaatttgaagggtagcaaggcaatcatgctgattctccatgttccttgagctccttcttcatatcttctatgccaatttctagtcatgctagcacatgttcgttcaacagatattttattaaccaactaccctggttctgggcacatagcccatattaagtaagtatttgctgaatgaatgactgtcttcaaaagcttaccattgtctcctattttggaaattcgaagataatttaacatagagaatccaaaggactttttgggttaatcaattttcttcaccttttgtttaacaatacttcctttgaaacaggttttcagctgacttgagctggacaaattggttgctactctctctgaaaagatactgtggaataaattatctttaaagaaatcatgaatgttagggaggaactaatatttatagcatctgaaattgttattcagaaagctgtcaaaatgaacaaaaccttctctccaaatatattgattaaaagcaatcagcagaattaatacacttctttttggggagtggggtggtctcagtttgttgcccgggttggagggcagtggtgtgatcacagctcactgcagccttgaactcgtggagtcaagcagtcctcccacctcagcctcctgtgtagctagctgggactacaggcatgagccactatgcccagctaccttttgttttgtttgtttgttgtttgtttgtttgagatggagtctcgctctgtcgcccaggctggagtgcagtggcgcgatcttggctcactgcaagctctgcttcccatgttcacaccattctcctgcctcagcctcctgagtagctgggactacaggtgcctgccaccatgcctggctaattttttttttttctgtatttttagcagagacagtgtttcaccgtgttagccaggatggtctcgatctcctgacctcgtgatccacccgcctcggcctcccaaagtgctgggattataggtgtgagccaccacgcctggcccctttttttttttttttttttttttaaagatggggtctccctatgttgcccaggctggtctcaaactcctgggctcaagtgatcctcccacctcaacctcccaacatgctaggattacagaccgagctactgcatgtggccaagaattaatactcatagtgttgaatatatatttgagatttttttcaaatttctacactacttttaaaaatcaattgtcttcccttaacagaaactaaaattggccaggtgatgtcactcatgcctataatcccagtgctttgggaggctgaggcaagaggatcacttgagcactggagtttcagaccagcctgggcaacattagccaggtatggtggcacgtgctggcactcccaggtacttgggaggctgagatgggaaaatcacttgagcccaggagttcaaggttacagtgagctatgattgtgccactgcaccagcctaggtgacagagcaagacccagtctcttaaaaaagaaagaaagggccggttctggtggctcctgcctgtcatcccagcactttgggaggctgaggtgggtggatcacttgaggtcaagagtttcagaccagcctggccaacatggtgaaaccttgtctctactaaaatacaaaaaatttgctgggtgtggtggtgtgcgcctgtagtcccagctacttgggaggctgaggcaggggaatcacttgaaccagggaggtggagattgcagtgagccgagatcgtgccactgcactccagcctggcaacagagcgagactccatctcaaaaaaaaaaaaaaaaaaaaaaggaaaaaagaagggaacaaaaaagctgaaattgtagggtggtggcaagagctggcaaagctctcagccagtatccatgccaggatctcatactgccagcgaactttggtcctcagatagaatctattacaataaaaactaccctgccatcatttcttggcacagtcactttttttccttcaaaatgttaattccaacactaaagggaaagtgactataatgatttccaaacagcaatgaggtccaagggaagcatgagtaaattgagtgaaataacttctaaacccatttatgctactaaaatcaactgtttccctaccaagttttaatggatgtctgaatgaacaattcatttcactcaaatattttttgaatgcctactatgtgtcacacacaggcaatacaaggatgatgagtcattcgttcccttcagagagcaatgtgggactcagaggaaacagaaaagtaaatcccaagccagtgtgttaaatgccatatggaagcatgtgggttcagagaagtaattaaccaggcaagttgtgagaaaaggtcgtgaatcggggaaggaaggaaggaaggaaggcggtgggggaaggaggaaaagcagactgaaagaaaagaatcgggaaaggctttcagagaaagattgatctgaatctttaaaaatagtaagaactggccaaggaaaggaggaagaaacaaggaggccagaatgctcagaaacccttacagcagggagtgtatggtctattccaggacaatgccttaaggtttaggtgtggggtacacagagggacatggcaagagaaggtgaataaatgatcaggcccttccccccagctcaggagtttgccaagaaaatcctaaagattgccgagagccactgaatggttctaagttagtgaataataagtctgttttgtttttgtttttgttgagacagagtctcactctgtcactcaggcaagagtgcagtggcaggatctcagtttactgcaacctccgcctcccaggttcaaacaattcttgtgtctcagcctcccaagtagctggaattacaggtgcatgccccatacccggctaatttttgtttttttcatagagacattgtttcaccatgttgcccaggctggtcttgaactcctgacctcaggtgatccacctgcctcgtcctcccaaagtgctgggattacacatgtgagccactgtgcctggccaagactacatttttaaaatgtcactcttatcagtcagggttcttcagagagacagagccaataggtgatagatagatgatagaaacggatggaggtaggtagatagataatagatgattgattgattgattgattgactgactgatagatggatgagaggggatttattgggggaattgcctcatgggattatggaggctgagaagtcccacaacaggccatctccaagctggagtccctgggatgcaggtaatggtagcgtggctcagtccaagtctgaaagcctcagaactagagaagccagtggcgtaattctcagtccaaggccaaaggcctgaaaaccagagggctgctgctgttaagtcccagtgtcaaggcaggagagcctggagttctgatgcccaagagcaggaagaggaaagtgtcccagctccaggagaaagagcaaggaaatcctctgtcacctttattgttctctccaggcccccagctaattagatggcgcccgcccacactggaggcagatcttccccactcagtccactgacccacatgccagtctctggaaactcctgcacggacacacccagaaataatgctttaccggttgtctaggtgttccttaatccagtcaagatgactggattcaaatttaaccatcataggcactctggctacacggaaggaaatagactggaaagcgggcaagactggaggagctcaagctgcccggctggccaaccctgagaaaatggaagcctgaaacaggggaggtgtagcagggatggagacaagtgggttgtctcaaaagaaaccaagacggcaagacccagaggactggggcacagttttagatgaagtgcatctgcgttggtgtagaaaactccagtggagatgatggcagtgtggagctcaggagagggctgggctgggactgagacctggacatgtcaggcacagtggtgggttggagctgcctggagaatgcccagtgggaacgggagcagagtgcatgtgcagctcctgtccagcatccagggggtttcacgtcgttctttactctttggaggacgcccttgcagagcagagtggagctcaaggaagacagcaggatgcacagaaactaagagttctgtatgctaaattattcaggagctccttacccagtatttgaggttgatttatttcttgcaggagctatttaagacttcttttaagaggcagagcaaactcatatccgacctctgtgcgtaaaggagtgcttttttggcaattgttttatgattaagttttcaggctgaagttttcccttctgatagtcattcaaaatacagtgttttgctgcacctgggcacaattatgtaagacacaacttaataatttagcttttttttttgagacagagtctcactctgtcgccaagctggagtgcagtggtgcaatcttggctcactccaagttccgcctcctgggttcaagcgattctcctgcctcagcctcccgagtagctgggactacaggtgtgcgcaaccatgcccggctaatttttgtatttttagtagagacggggttttcaccatgttggccaggatggtctcgatctcctgaccttgtgatccgcccgcctcggcctcccaaagtgctgggattacaggcatgagccaccatgccgggataataatttagcattttttaccaaccaagaagtcacacttgtgatggctccatgtttctcaggcattctctccataaagtccaacttgggtccctctgttccctcccaccacactagagtccagtaacctcagactggctgatgtgatataaatggaaatgttccctgtggtggaactgtgccaggctgttagcagaacccagttcctccctgccatggttggcccattttgttctccctggggagatcggtctggattatcaggagggtttgggtggtggatttggtctgtttttgctacatcaaacatccctgatgctgatggactgagagaggagtcggtgtcacaagtgcacgccccttccctttgcttgcatgacattgcccacgcccttcccctcccttcgcctcttctcccggctttccctgcctgcctgaaacagctaaaattaagtctggcataagtctgttgagactttaagaaaacattgccataaaagggcaacgacgaccaccagcttcaagttctgtgtgctgacaaattcgtctgtcttttgaccctgtgcacattaatgtacatacctaaactgtaaaagccctcaaattcctgaaattgacttagtgtgttataaaaaaaaaaaaaaaacctcatgactttttctgttgttccatgagtagcctcctttctaaggaagaaaacataagatttcttactaagtaaaaaacctgtagaaataaattcaatcccactagcatattacataaaaacatttttattttaggctactcctgtacacccattcattatcaagtggagttgcataaaacattaattgttagaatttctactctctaccaacttctgtagtgatggtttataggtcttttcagtctgtgaaccacttttgcggtcctcctgacgtacatactgccatttgttgcccatttctgcctcccaaaaaacaacccctcacgattacaggtgaaattgatggtgcttatcataaacaccggtaagaatttttttaaattattgcaagagacaaaagcatagacttagaacgagagatacttcctgtgtaccttggctcactccaagtttttttaaaaaactttttttaaaaattaaactttttattttgagataattgtatattcacatatagttgtaagaaataatgcagagagatcctgtgcaccctttacctagttccccgcagtggtaacatcttgcaaaactaaacagtacaggagaaacttgaatcctcatacattgctggtaaaaatgtaaaatggtgcagccaccttgaaaacagttcagcaggtcctcaaaatattaaatgtagagaggccaggtgtggtggctcatgcctgtaatcccagcactttgggaggctgaggcgggtggatcacctgaggtcaggagttcgagaccaacctggccaacatggtgaaaccccatctctactaaaaatatgaaaattagccgagcatggttgtgcgcacctgtagtcccagctactcgggaggctgaggcaggagaatcacttgaacccaggaggcagaggttgcagtgagctgaaatcgcgctactgcactccagcctgggtgacagagtgagactccatttcaaaactaaatttaaaatatatatatattaaacatagggttaccctgtggcccagcaattccactcctgtatatatgaaatgaaacacatgtccacacaaacacttgcacaggaatgtccataggagcattttcaccacagccaaaaagtggaaaccacctgagtgcccatcagctgacgaaaggataaacaaggtgtgtgtgtccacacaacagagtatcgttcagcagtcaacagaaatgaagtgctgatccgtgttacaatgtgaatgggccctgacattaagcggaagctagtcacaaaagaccacctattgtatgatcccattgatgagaaatacccagcatcggcaaatccatagagacaggaaatagttgcctagggatgggtgtgagggttgagcaggtaatgggacgtgactgctaatgggtacaagctgtctctttgggatgatgaaaatgtaaacttagatagttgcacaattctgaatattccaaaaatcactgggctgcacactttaaatgggtgagttattttatggtatgtgaattatatttcagtaaagatttttttggctgggcgcggtggctcatgcctgtaatcccagcactttgggagtctgaggcgggtggatcacgaggtcaggagatcgagaccatcttggctaacacggtgaaacccagtctctactaaaaaaaatacaaaaaattagcctgtagtcctagctactccggaggctaaggcaggagaatggcgtgaacccgggaggtggagctggcagtgagctgagatggcaccactgcactccagcctgggggacaaagcgagactccgtctcaaaaaaaaaaaaaaaaaaatttattgtcatttcctccacagaattaaatcagcttggcctgactcatagggaaaaatacagggtgatatcacaagcaggatattgacattgatacagtcaagatgtagaacagttcggtcaccacaaggatctcttacattatcctcttatagccataggcacctctggccccctaccccagcccctgatccccggcatccactaatctgttctccatttcgaccattttatttcaagactataatataaatggaatcatacagtatatgacgttttaggactggctttttccccctcagcataattccctggagatctatccaagttgttgtatgtgtcagtagttccttcctttttcttgctgagtagtattttacggtatagatggacctaccacagcccgcttcaccattcatccattgaacgacatctgttatttcgtttgcactgttgcaaaaaagctgctatgaatattcatgtacaagtttttgtgtaaatgtaagttttcatttccctgggataaatgcccaagagtgtaactgatgtgttacatggtagttgcatgtttagttttataaaaaactgccaaattgtttttaagagtggtggttcctgaccaggcacagtggctcacgcctgtaatcccagcactttgggaggccaaggcaggcagatcacctgaggtcgggagttcaagaccagcctgaccaatatggtgaaacctcatctctactaaaaatacaaaaattagctgacctgtggtagcatgtgcctgtaatcctagctactcaggaggctgagacaggaaaattgcctgaacctgggaggtagaggttgcagtgagttgagataggtccactgcgctccagcctgggccacagagggagaccctgtctcaaaaaaaaaagaaaaaaaaaaaaaaaaacagtggttccattttgcattcccaccagcagtgtagaagtaatcctgtctgtctctctacatccttaccagcatttgatgttgttactattgtgattttagccattttaacagttgtgtagtagtatctcattgtggttttaattcgcatttatataatggctaatgactttgaacatcttttcatgcactaatttgccatctgtatatctttcttggtgaaacagctctgtgtcatttgcctatgttctaattggattattttctccattttctgtttaatattggtagtgtttatgtattccagacatttttattttattttatttttgctattccttggagagcagggctaaccctataggcagtgtgctagtaatttgttggctatgtgatttgcaagtattttctcctactgtgtagcttttcttttcatcctcttaacagggtctttcgcagagcaaaaattcttaattttaatgaggtccatttatgtttttccttttatggactgtgtttttggtgtcaagtctaacttttgccttgccccagttcccaaatattttctccaaaaagtttcatagttttaagttcacgatccaatgtgagctaatttttgtgtaaaacgcaaggcttaggttggggtttgtttttgtctttttaccttttgatatccaattactccagttctattgcttttacacctccatcaaaaattggtttgccatgtttgcatgggtctatttctgggttttctatttatttctattgattattatatccattcttctgccaataccattgtcttgattgctgtatctatatagtttgctttaatattaagcgacttcaagattaaagaattctactgtagtcccagctacttgggaggctgaggcaggagaatggcgtgaacccaggaagcagagcttgcagtgagccgaggttgcgccactgcactccagcctgggtgacagagcgagactccgtctcaaaaaaataataaataaataaatagaattctagagcttgcacctttccatataaattttagaataagcttatttatgtctttaaaaaaaaccctaatttggtagcaattgcattaaaccaaaagattaatctgggggagaattgtcatttttactatgttggggcttccagctcaggactgtctctccatttattagctcgtctttcatctacagtttgtgattttcagcatacagctactatacatggtttcttgagtttatgcctaagtattaattttctttgaagtgattgtattaagtgatattgttttatatatttttccatgtgttcattgttagtttatagaaatgtgattgatttttgtgtgttgatcttgtatgctatgaccttaccaaactcactaattccaggtgagttttttctttcttttgtagattctttgatattttgtatgtagataacatgttatctacacaggtgtttttcttcctttccaatctgtatgcgttttctttccttttcttgccttattgcagggcctagtacttctagaaccatgttgaataggattagtgagagcagacaccctggcctggtttctgaacttcatagggaaaacagtctttcactatgaagtatggtatctgctgtagctttttaccatgaaacatcttagttttgttttctttttctctccccaccccttttctttttttaagaggtttaagacttagggattggcgcaagtaagatgacaaagctaaacgagaggcattttcaggacttcctctttcaggcccggcttgcaagagcgctagggccaagctcctttcagccctaatcggtactggagctaatcgcattcgcggcgcccgtgcactctgcagggatgggccgtggggccagggacctcagtcccctctcggcctgtcctgcccttccaggaggctagcggctgctggccgcgcagcctgccaacctgagttggccatagtagagtctcagatacccagctcctgagcggccagggccagattcagggtgtgtacgtttttggcagcggctccccaaccgagaagacactcggctgcgaagagaggacgcgaattaagagttccatgctggaaaaaaaaaaatggatagcgacaaagtgcatctacaatacgtgtagcccacggaacgatttttgttaagggggccgaggatgggcagttacatctaaaatttggaaagggaagaggaaagcgagaaaggatcccctagctggcgccccggggcgttctgcagcctccagcccctctccccctccccgcgccgcggagcccacacctgcgcaggtggagcctgccgagcgcggccgccggtgctgggaaggtgagcggcgccggggggcggagtgggggcgggccgcgggcctctcccaatggcggcacggcggggaggacgcgggccacggccggaggggggcgccccgggcccaggcgctgccgccctcgagctcccgggtcccttcccacgcttcctcccgggcgggccgtaccaaggcgcgggggggagcggcgcgtcccactcgcggaggggcacgcgggccgcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaaggtgagtgcgccccgcccgctgccggcccggcgctcccacggcccggccgcccgaggaccgggacccgcggggaccccgcgccccatctccggcgctgccccacggcgagctgcgtcctgcggaagcccaggggccggggcgggaaccggggcggggatgcgggcgccggcgagctcgggctgcggggtaccgggcgtccgcggaggggacgcgagccaggctcccagagcgcagccctgagcccggcatccacacggacgggcggcccttttgtccttactcgccgaactcgaattacagcaaggtgtcagggagcgctaattgtttgtgcttgtcaccatgcactcggaggcaaccccgaatcatacccacagtccagaccctttaatcatagactggtgcccttatctgcgcctgtgaagatatgaccggtagggtgtgtcttcttttttaatggggaaagttaaataggaaaacctgaagaggttattgaatcggtgttgagttcaggcgaccctctcactccgtcatttctgtcgcctctcctctcacttggttgttttttttccctctcctgtcttcttcttgtatcttacaggtaaataacttggatcttatttggaggctgttaacatttgaaaggcatgagctcgttctttggcaaaattaatatttaaaatggaatgtgacgagctttcaccaggatcttattttgaagctgttaacatttgaacgggatgagcttgctcttacgcaaaattaatatgtaaaatgaaatgtgatgagctcagagtcgggaaagaactttatataagatgcttgacaattcgaggacttgaaaaggcgttcacactgtcttgtgtgcttccattatttatttagcaacttctcttttttccaggagtattgatagaataaagctctcgaaacaaagaacgtgccatgtggatgctgtcccttgtgccaactttactttaatacctctgttcattcacagtcaggcaattacttaaataagcctgcacagccagcatggacgtgttaacccaatagaattagccgggtgcctgttatctttgagattcactgcagcatttcacaaacatgttagctggaagagaacgcgttcatagtcattgtcattaaaagtgtttgtctgtatttattggtaacaaatggtgcatttcagaattttaccggacttaatttgcatttcatcctacagaaaaataatccagggtcttcattcgaacccatctcactattcctcagttttattatattgcaggccaaatcttggccgctgtccacagggtggaatggtgtgcccgttccataagactttgaatgtctaaatcaccagggttttgtctcttatattagtaagaatgagagtcttttacagttacaatttttgcaaattagcagggaggcaagaagaactagagagcagcttctgttcgagaggaatcgctactacttatttagctgtgtgaccttggacaagttacttaacctctctgtgccttggttttctcatttctaaaatagagctaatatcaggtgttttgaggattaaatgagccaatccgtatcatggcatttaaaaacagtgtaaacccatagtgagtacttcataaatgttagttactattatcgcttaagtgccattaagcattgtactgaattcatgagctttttaagatttttattaatgaaacccaacacagagattcttctcaacacagatttggtgtcctgtcccttttcttcttcttacttgagatttattaatttaattatgcatttctctaagcagatatacactcttttttttcttttcattgtgtctgccaatgtaatgaatgtaaagtattaaacctaagtgtctaagagaggaatttcccctcttcacccatctatttttatctatattgctgtcattcctttaaagcacaccgaatcccacgaataaccctgtcaaacttttctagattcttaaggaggcagaatgttaaacagtgactttgaggctgagctgagctggaagaaagaacagtgttggcgtggtagtccaaatgcagctttgtttcttttgaactttaaattgcttattcatccaaaatacaggaaaattgaatatcaagcagaatctcacacttatttagcagggacaaaagtcccagcagtaagacattacacctctaaatatcctacataatagggagcccttgacgagatcctcatttcatctttcagcatccagcataccctgttaacgtcttcatgtatgcattgatgtctagaggcattgcttcaaccgagatatattcgctgtacgtggaaacacatgattactcatattttcattaccaagatttttctatttcctaataagttataactgatactatatttgttagaaacatcttggaagcactggtgaggttaggaagaaagattgagttctaccctgcctagttgggtcgtctttggcctgggttatgacaggagctgccatcccttttctgctgtcaacccttcttaccacgacaagagggacatggtacgggtgggtttgatggcctcactcctctatgggaaggtcttgaccacgttcctctgtccgtatatccgacaggtgcagacttctcttactccgcaggctcagtgcccctccctctctgtgcataagaatagccacagatctttttgaaaggcagattccagttctctaggtctggggtgggacttgcctagcacaggggccgctcctgctgccggttcacagacccctcttggaataacaggacatgggccggccaactttttctgtaaagggtcagatagtaaatattttagcctttgcgggtgttatggtctcagtttctgtcacaaccactcaatttgcccttgtagcaagaaagcagaaagcagctaacacaatccaaggggcggggctcggctccagtaaaacttctttaccaaaacccagatttggccctcaggcatagtgtgccagccccctgctctgtgtctccctcactgtgcctgtgccttagggggtggcacgtgatgagggctgcatgctttccatgccacaccgatcttagtaagacttcaaggctcagctcaagtctcatctggtctccgaggccttctctgaataccctctgtacttctctggcattcacctttctctcccccgtgcctgctaccacagctggcacatagcaagttctcagcagtgctttggatctcaatgatttcattaagtgtttgtagttactttgtgggcatattgggggaggaaatgattttgtgtatgagaagccttgcccatagcaatttttccctccctccctccctcagggtctcactcttacctggggtgaagtacagtgatgcgatctcagctcactgcagcctcaacctcctgggctcaagtggtgcttccgcctcccaagtagctgggactacaggcgcatgccaccatgcctggctaatttttgtactttagtagagatggggtttcactatgatggccaagctggtctcaaactcctgggctcaagtgatctgccggctgcagtctccctaactactgggacctacaggcatgaaccacggtgcccagccagcaatccctttctgtgtttgctttttacatttgtaattgttacaccgaccacgtctttgctgtgtttgtgtttatctatattaactgccttgaactaacttactggccaggaccaagcacaaagtactttgtaagcacctaaacacaactcatgaatgctttttgaagtaggtaattattcagcagttttatccgtgattaataaacctgctctactctggtaccacttcatgaagtctgcagcctctttagagcggtccgcattctctcccagctgccggaggagctgggctctttcaagtttttgataacttgctgtggtgattttacccgcttcttagcagagagtgtcttgccagactgactgtctctcctcttcctcctcatttgccgcttatttcatcccagttcagccattctgtcctattcttcttcacttgcaaagattttccaaagtagaatccaggccgggcgtggcggctcaccattgtaatcccagcactttgggaggcagaggcaggaagattgcttaaggccaggagttcaagaccagcctgggaaacatggtgagaccccgtctttataaaaaattttaaaaattagctaggcatggtggtgcacgcctgtggttccggctacttgggaggctgaggtgggaggatcacccgagcgcatgtggttgcaccactgtacttcagcctggagtaatttcatgtctccaaaaaacaaaaacaaaatgacaacaacgaaatagaatcttctttccagaacgtgcctcaatcttgctttatttttctctctttttatttttgtctcgctctgttgcccaggctggagtgcagtggtacaatctcggttcacggcaacctctgcctcccaggctcaagtaattctcatgcctcagcctcctgagtagctaggattacaggcatgcaccagcatgcctggctaatttttgtatttttagtagagatggggtttcaccatggtgcccaggctggtctcgaactcctggcctcaagcgatctgcctgcctcggcctcccaaagtgctgggattataggtgtgagccactgcacccagccaatcttgcttgtttctagcaaaactggtcagcctcacctacagtgatcaaaataggtaaaagtaggggccacttttcgtaggagggaaagaaagcattgtctttcagtgaggcatctcgggattcaggcccagatctgtgatgaagggcctgtatttccttggacaacccgtgaggcctctccgggctttgttttgttgttattgctgtcgttaagagttttctctataaaaccagggggccggcacttggtgatcttttgctttttctctctcgcttaaaaatcagaccccaaagcaaccaataatcactctttacaaataaacaaaacaaaaatgtgtgttcactcaaaactcattcattctcaactggagtgagtaacaccctgagtaagtgaagatcggttcttgttgggagacaaaaaaattgcagctgttacagtggattttggccacccaaagggccacggcacatgaacaaatacacagtatatctgtgctattaaaatgtcgtgggggtaggacagttgggggagaatgtataaaaaagactcagggaggggagtataatgaaaacaaggcttagaagctgctggaacttgcttaagggagaattgcctccctgtgtatttgtggtcatctattgaattattcccttgtcccttgactctcacagccaagcgtcaacttgcaggtttcttgactctactgcggggcactgacctctgctggtggagatatcaaagtggcaggtgtgtgggcacagtctggtacttgtcgatcattacttagggcacgagaaggctcgggtgattatctgctttccaaactctacccttccctgctgagttcacacactcctcgtagataagagacttattgtttctggattatgagtagttacaattgtatgaaatccctgtaattaaagttgttcctctggagctggcgccatatgtaacatattgccctattctgtagggtctaggtacacatttcagtatctctgaagtcaggacgtgacttcacatttggtggtgtctccgacttggtgaggtagggttgttgtcttggagtagatagaggttttgtcaccggaagatccctgactagtttaagcagaggacaatgctgggaggattcgggggtattggtaagtgggactcgtcaccagtcttcgcaagtaactggaaccagctggaaagtcatcagggcccagggcattgagcacctctggccattgctctagggccatgtgacctcccatctcagaactttctctgcttcctggtggatgtgttgaagaatggcctcttggccctacagctgttcagctccaaccccacagccagctgtgctgagtccttacccatgcttcggacccctgtgatataactcacatcccatacgattcccctccctcctggagcactggatatgggcttctcgctgccctgtctgaggcctacatctcatcctgtgccttcagcctggaggtcgtgccctcctccacggctcagattcccctgacactgatctctctgtgcccatctccttccttccccttccttcttcggtttgttttctttctttttaaccagcctgattccataaatgcccgcatcctcccagctgttttaacaggaaagctgcttgactccaggtccaagagaacagctccttgctgctgcttccggcttgttcacctctctccctcactcccggccagtgtcatcttcctatggaccgttccagcagccaagctctcccagcacctgctctgccccctccaattaatttgccatgctgctgttggagatatttccttcaaacatatttctaatcccatcgctttcatttctaaagcctccggtacttttcctttgcctgtaggagtccgcacttcccggcacgccctccttgcccccttctcctccctccccagcctcacctggtgcctctttcctccctgcatttccctccagctactctggccttcatcagcttcctcaaactgccttgctcctccaggcctgccagactttacacagacagctcctgctccttgaatcattccttcctctcctttggccacctgctcgttttctccaagtctcaggttagatgtcgcttcctcagggaagccttcccagaagccccgatgaagacttcccatgctatctcatgatccctcacaattgataggtgctgttagggggacgcacttctttgtgtttcccagtagcccctcccatttatttgccattacattgtaagctctgtgaggatggagactgaaatcttaatatttgccaggtcttgaggccactgggatgagtgaaacttggttttcagtaaacatttgtcacacaaatgaacgtatgtattttggagcttatgcttttactgtggcacctaggcttgccatacttcaggtggtcaatgttatttcttacaaagacataaggcatttctatttgaggcattggagaaatgagaggaattgcatttgccatgttgatggtgcgctaatcaaagagcagtgagggcggagcaacggaggaagtgaaatgactgagtgaaccctggaggtgtgaaaggcttctccacccgacggtgggtgacatcagggcttgtgacgtttgcagttgaataactgaaggcagtagcaagtgggtagagtgggatggctcgcctgcggaatctggcatccgaggaaatcgccttgacaccttcctttcatggccgtgattacacttgtgctaaggttagggggaacagagccaggttcatctctgatatgaaaagggaagagcgattttgggggaagggaactagtctgggaaccttttggctaaattttagtcactttttaatctgtttaatatgctgccacggccgggtgctgtggctcaccccgtaatcccagcactttgggaggccaaggtggatggatcatttgagtccaggagttcgagatcggcctgggcaacatggcgaaaccctctctctataaaaataaataaataatacagaaaattagccagacatgggaggtgagtcccatgcctcctgagtccaggaggttgaggctgtgctgaaccatgagggcatcactgcattctagctggggcaacagagcaagaccttatctgaaaaaaaaaatatatatatatgtacacacacacacacacacacacacacacacgctgccttctgtcccacttggagctgtttcccatgtatctgaatttatataacatcaatgaggtttctgaacatcatgctaactgattcattttattttaggttgtactttggtcatttgtaactgacaggaagttgctagcaataagttgttattttatgaatcattttccacattttcttggaagtggaatgtttcattgttccgtcaagacctcctccccagtacacacatgcgcattgtaagacgcttatttaccctctttccttggctctcagtcttcacgttgacttctctagctttgaagcttatacatacatacgatgtaacccccctttttttaatgcatgtgtaattagagccatagcaattaagagcatgagtcagattcaccttagagtctcatttcttctacttaataactgtgagaactttagtaagtttcttaaagctttggtttcttcatatgtaacttggaaataataatagtacctagccaggaggattatatgtggattaaataacatgggcatgatatccactagagcaggggtccccaaccccctagccacagaccactactgttaggaatcggcccacacggcaggtgagcagcaggcgagcgagcattacctcccgagctccgcctcctatcagatcaacagcagcattagattctcataggagcgcgaaccctattgtgaactgcacaagcaagggatctaggttgcacactctttatgagcttttttttttttttttttttttttttttgagacagagtcttgctctgttgcccaggctggagtgcagtggcgcaatctcggctcactgcaagctccacctcccaggttccagcgattctcctgcctcagcctctcaagtaactgggattacagacacttgccaccatgcccaaccaatttttgtatttttgtagagacggggttttaccatgttggccaggctggtctcaaactcctgacctcgtgatctgcctgcctcagcctcccaaagtgctgggattacaggcgtgagccaccgtgcccagccttccttatgagactctaactcatgccaaatgatctgaggtggaacaatttcatgctgaaaccatccccctgctcccccatccatggaaaaattgtcttccatgaaactggtccctcccaaaaaggttggggaccactgcattagagggcctgggatgtagtatggggaccgctgcattagagggcctgggatgtagtacagtctccatcagcagtaactgcgatgatgactaggaagacaagaagaaaccgagcaaaaatttaaagtgattccagcgattctgttcttctgcactgtcagactttgccccatgtggacacaggtatgtatgccacatatagttggcagcttttgcgattggatgtttgtgcttatccctgttcctgagaaatgctctcaggaaagatggtgtgtcaccattttacaaatgaagaaattcaggctcaagggtatcaatttgttcaagctcacaagaaaggcagtaacaattctgacctagggttggtctagatgcttctgtcttctccattgcctcccatttgaactgggagtaccttgagtagtccccattggtgaacactggcttgctacctgacatcttctattggtgacttattgtaatggctctgccaatggtttttttgtgttttgatttgcagtagtaattcttgtcagtgctgtcacacagtgtaaaaacaatggcacgccatagtagaaactgtcagaggacgcacaacagaaagatccattatattgcaaaaccccaaagaggtgcacacatttatggacgtatgtgtaatctctgcgaaactccagtgtttcattgtgagttaggatagccttttgtcagagtctcaaacttcaggacacttgcggggacttggatgaagtgcccatcttgaattcatcagaatgaattcaccaaattgctctgccactcttgtgactcagcggtttgctgaatatattcacttacctctcttccctcctaaagtctactgaaatgacatagatcagtgaaatcaactacaaaggtagtcatgcttaataaaaacaaaaacttagttcttggataagtcagtaaagtggataaacctttgtcaagtctgttcaggaaaaaatgggagaaaatgcaaagctttagaaagaagagaagcttcttaactataaatgcagagatctttaaaagtaacgttgatcaaagcacaccggccgggcatggtggttcacgcctgtaatcccagcacttcgggagactgaagtgggaggatcccttgagcccagcagttcaagaccagcctgggcaccatggcgaaaccccatctcaacaaaaaaaatacaaaaactatccgggtgtggtggtgcacgcctgtggtcccaactacttgggaggctgagataggaggattgcttgagcctgggaggtggaggtggcagagagccaggatcacaccactgcactccagcctgggcaacagagatggtacactttaaattggcgaacctgtgaatgtgaattatatctcaaactatttttgttggttttttgttttgttttgttttgttttgtgacagggtctcactctgtcacccaggttggtctgcaactcctaggctcaagccatccttccacatcagcctcccgaagtgctgagattacaggcgtgagctattgcacccagccccaacaaagctattttttaaataagataatgaaaggtcttattcctcttctgctacagaagagcataccattctattcagcctgtttatggatgaattctgtaaaacttttcaggaacagttaatgccttatttaaattattttagaacataggaaaatatggagcacttcccagctccttccgtaaggctagcttgatcttgaaatcaaagccagaggaagatagcacacaaagaagaaaacaagcgatcagtcttacatttaaaatgtggccaaagctcctaaacaaacactagctatgcaggattaaaagccgaatatattgtggtcaagtaaggtttatcttagaaatgcaagtattcttctgttgattaagaaatctaggctgggcaaggtagctcttgccggtaatcccaggcctttgggaggccaaggtgggcggctcaggtaatcccagccctttgggaagtcaagatgggtggatcgggtaatcccaggcctttgggaagccaaggtgggtgaatcacttgagcccaggagttcgagaccaacctgggcaacatgacaaaaccccatctttaatttttttaattaaaaaaaaatttttttaatctattaaggagctggatgtggtggctaacacctgtaatcccaacactttgggaggccaaggtggaaggatcacttgaagccaggagttcaagaccagcctggacaacatagcgagactcccatctctacaaacaataaaaaaaattagccaggtatggtagcggatgcctgtagtcccagccactcaggaggctgagacaggaggattgcttgagcctggccatttgaggttgcagtgagcagtgatcatgccactgcactctagcctgggcaacagagtgagaccttatctcaaaaaaaaaacaaaacaaaaaaacaaagccatctattgagaaatctagtcccagcttcttgggaggccatggtaggaggatctcttgagcccaggagtttgaggccagtctgggcaacataatgtgatcctatctctaaagaaagaaagaaagaatgagagagagaaagaaaaagaagaaattgcctaaggaattaatgttgttgataaaggagagaaactggtagtcatctcagtagatactgaaatagcaattaataaaattcaacatatgttcctttttaaaaatcgttaataaaccagggatatgaggaaacttctttaagtagctaaaagtatacctcatgacagccagcgggggcagcagctgtataattcctggtgcaggttgagtctcccaaatgcgtggaactggaaatgtttaggttttctgatttatttatttatttttatttttatttttattttttatttttgagacggagtctcgctctgtcacccaggctagagtacagtggcgcgatctcggctcactgcaacctctgcctcctggattcaagtgattctcctgcctcagcctcccgagtagctgggattacaggcatgcgccaccatgcccagctaatttttgtatttttagtagagatggggtttcgccatgttggccaggctggtcttgaactcctgacctcaggtgatcctcccacctcggcccctccaaagtgctaggatttcacaggcatgagccaccgcgtctagccggttttctgatttttttcagattttggaatatttgcatatacataatgagatatcttggggatgaggactcaattttaaacacgaaattcatgtttcatatataccttatatacatagtctgaagttattttatacaattttttaataactttgtgcatgaaacaaagtttgtacagattgaaccatcagaaagcaaaggtgccactgtctcagccacccttgtggacagtctggcatcaccatcgttcctgactctgtatttctatgctactgataaatacagtgaaaaaccgatgtgttcagggtaacttatggcattgtgttggcactcggaaagttttgcattttggagcatttgggattttacgtttttggattatggatgctccactgtacctgccaaggtgggtctcactcttctggcctggctggtgcttgctgcttcatccctgtgagctctccttggccatcaccgttctccagcttcatcactgggttttcttccctgagaaaggaatcattggctgtggtagatgctttaattatgtattaatagttcctagaattctatgcaaaaccattttaaaattctgacaggagccacatacaatttcaaggtcattgctttgtccgtgactttccttaggcatcgattgcaactcactttgaactaattgggcaaactctgccttgatcctgcctgtgctttttcttctttcctaataactcttttactgcccccttatttagaagagtgtgtgcattttctcgcccgtgtacacatttgcccccacacacaaaaccaaatgcaaaaagcatggaaaggggaaaaaaagtaacagacttcatttattctgccaccttataattgtaaatcctgtaaaattatgtttaagatttgcctttgtttctgttcatgtttctaggcactttagaaaaacttaggggtttttattttattttattttttgagacggaatctctctctgtcgtccaggctagagtgcaatggtgcgatctcagctcactgcaaaccccgcctcctaggttcaagcaattctcctgcctcagcctcccaagtagctgggattacaggtgcccaccaccatgcctggctgatttttgtatttttagtagagacggggtttcaccatgttgaccaggctggtttcaaactcccgacctcaaatgacccacctgcttcggcctcccaaagtgctgggattacaggcatgagccaccaccacacccggcctattttattttattttattttattttgagacggagtcttgctcttattgcccaggctagagtgcagtggcatgatctcggctgactgcagcctccgcctcctcggttcaagcgattctcctgcctcaggctcctgagtagctgggattacaggcacccaccaccatgcccggctaatttttgtacttttagtagagatggggtttcgccatgttggccaggctgatctcgaactcctgacctcaagtgatctgcctgcctcggcctcccaaagtgttggaattacaggcatgagccaccacgcccgaccttatttttttaaatagagatgaggttttactgtgttgcctaggctggtcttgaactcctgagctcaagcgattctcccatctttgcctctcaaagtactaggattacagccatgagccaccgcacccagccaacttatgagtttaattttttctcttccatatacttttgactgtcacattcctcttctttgcttatttcttactcagatattttttaacagttttctaaaaagagaaaacactatataaatatagtaaacttgtatttctaaatgcagaataaagtataaaagatacattttaacactgataattttttgtggaattataatgaaattcagcatattaagttaaaattgtgaataaggagtcagggtttttttcggtttggggagtttttaagtgaagtttgggacagtgtaaattttgttttaaaatgcatttcattcttatacacttagtctttaagacaagttttgaatatgttactatgacctgtgattaatgaatatgggggtttttttctgttaacatgattattttaaaaaaactcaacaatgctattaacaacaataataaaagtattctaatattatgtaacaacaaagaatgtccttgcataagatgatgatattttttgtttcaaaattgtattatgaaaatttccaaacatatgaaatggtagagagaatggttcaatgcattccaaatagccaccatccaccttcaatgcatcaattcctgagacagccttgtttcatcaacaccctcacccacttccccacactcggattatttgcaggtgaatcccgggtctagtgacgccttggtgctacacgaagcaatgtgccctccctctctccctccctccctccccccctccctctttccctccctccctccttccctcgctccttcccttgctcttgttgccagactggagtgcaacagcgtgatcttggctcactgcaacctccgcctccaggttcaagtgattctcctacctcagcctccccaaatagcttggattacaggcacccaccaccaagcccggctaattttgtattcttttagtagagacagggtttctccacgttggtcaggctggtcttgtactcttgacctcaggcgatctgccaacctcggcctcccaaagtgctgggatttgaggcgtgagcccccgcgcccggcctagtagtgtgcgtttctaaaggcccttggcgatctggtcctgagtaactttcctgtcgcatctccagccatatcccatgagtgctagactccagctgtttcaggctaagatacggctacatcatttttcaaacatgccatgttctttgggacctctgtctttgtatatgctattacgtcttcctagaatgtttcttcttctcttctctctcaaacacttcttctttcaggatccagctcacatccccttggccgtgaaggctcctctggctcctcctgtgtatgttcctttagcactttgcagtacttcacccacagtgcttatcacactgcacagtccaaacactcctgcagggcggggaccagcctgccacggggcagtgtttggtgtgtctcctgggtcctgcagaagcaatctgccttcttcaagggtctgtggattctctcagctttcctggcctattcctgcagtagttctggaagacaggttcatgatgcaagttgccacacgctgctctgtccgtctgagtgggagctgcattccagtcctgcttcctatccactattttcccttgaatatgtgttttaaaatataatagtcagtggtcgtgataaaagagagaggggtttaacttggtatcaggtgtatgagtgtgtgtgcatgtgtgtgtgtgcctgtgtgcatatgtgcatgtgtgcatgcatgtgcacctgcttcctcccgccctcgttgcctgcctggccaagcagagcctctctctggtggtagctggacagcagctccaaaagcccaccctgaggagaagccactgcaccctccaaggcacacatgcattccgcctttgcttcacgcccccaccacccacagcactgttaaaatgaaccctctgaccagtggcaaaatttgcttgccaaggaggacgtcagtaattgactaagtcagggccccacaactacaggagctggtgtgggtgagcagttactctcttctgtacacagaggctctaatcatgctttgtgtttatactgccggtgtgcaaatggtagaccagggcatttggcttgcagcaggcagagttcccagtggtgttgaaggtgcagcaacatcattagagaatcaagggttttgatttgcatttctctaatgagcagtagtgttgagctttttttcatattcttgttagccatgtgtatgtcttcttttgaaaaatgtccattcatgtcctttgcccactttttaattgggttgtttgattttttcttgtcaatttgtttaagttccttattgatcctggatattggacctttgttggatgcatcctttgtaaatattttctcccattctgtaggttgtctcttcactctgttgatagtttattttgccgtgcagaagctcttaagtttacttagatcccacttgtcaatttttgcctttgttgcaattgcttttggcatcttcatcacgaaatctgtgcccatttgtatgtccagaatggtatttcctaggtcatcttccaggttattataattttcaattttacatttaagtctttaatcctgccatttgacctagcaatcccattaccgggtggatacccaaaggaatataaattgttctaccataaaggcacatgcatgtgtatgtccattgcagcactattcacaatagcaaagacatggaatcaaactaaatgcccatcagtggtggattggataaagaaaatgtggtacatatacaccatggaatactatataggcataaaaaagaatgagatcatgccctttccaggaacatgggtggagctggaagccattgtctttagcaaactaatgcaggaacaaaaaacagctcctttctcggggttctctctggatctgcacagctcctctctgggggttccctctggatccacacggcttctgtctcgaggttccctctggatccacacggcttctgtctcggggttccctctggatccacacggctcctctctcgaggttccctctggatccatacggctcctctctcgaggttccctctagatccacacggctcctctctcgaggttccctctggatccacatggcccctttgaggctcttttgttccagtgtaaaggtgaggagactggggctgagagcccagtgccaagtgatcagtggtcggcaaggagtttgcagaaaagccattgtgattagtgccaggtggttgctggtgatggggactcagaaggcccaggtggagtcccattccatggtgctgaactggagcggtcctggcaaagtgggcttagggccacagatcatcactgcgagctgtttgctctgaaagaaaggcagtggagtggagtgaaccaccacaaggtcaagtggagatggggagagagagcgggaagcaagctggtgaggggcggaggtgaaggagagcacgcagggatgggacggagagtcacgatggagggagcagggtctcagagacgtccactgactgctctgcctcttttctcctctgactgagcgtccacgcagccctgattttttcagcctcctgtgtgagcccctgtgtggcttctggtcacctccaggataaagtagtacagagcacatgccaagcgcccaacgtaaccgaccccatggcctccctgccaccctgctgctgctcccccatcgccatggggtgccagcccctgccccatgtcccctgcgagctcctgaggataccctcagatctgaggggctcaggcctctgcctggaatcccttttcctgccttcaagacacagctggagacagcgtcacctcccctgacaggccgtgttggagtgctggctggggcgctcagcatagccgtgggaacggggcacctcctggtcggctccagtgagaccagagagttggtcactggagcgggggtgtctgagttggaggtaaggtggatcacctgaggtcagaagttcgagaccagcctgaccaacatagcgaaagcctgtctctaccaaaaatatgaaacttagccaggggtggtggtgtgcgcctgtaatcccagctacttgggaggctgaggcaggagaatcgcttgaacccgggagatagaggttgcagtgagccgagatcgtccactgcactccagcctgggcaacagagcgagactccatctcaaaaaaaaaaaaaaaatgcttgggactgctgccgggcacagtggctcacacctgtaagcactttgggaggccaagctgggcagatcacctgaggtcaggagttcaagaccagcctgaccaacgtggcgaaaccccatcactactaaaaatacaaaaattagccaggcgtggtggtgggtgcctgtaatcccagctgcttgggaggctgagtcaggagaatcacttgaacccagaagccagaggttgcagtgagcctagatcctaccactgcactccagcctgggtgacagaacgagactccatctcaaacatatataaaataaaaaccaaaatgctcgggactgggaatgtttcagatttagtattttttcagatttttgagtatttgcatcatacataccagttgagcattcctaattcaaaaatccaaaatctgaaatgctctgatgagcttttcccttgagtgtagtatggatgctcaaaaaaatttggattttggagcatttcagatttcaggttttcagatttgggatgctcaacctgtgtatatcactgttgttatttttggaaaacatgttcatgccttttattgctattacaaataataatttctgaaaacaaagtttaagttatttcaggcgttattgtagaagatactgcgtcaaccccaactgtctttcttccatctgcccagtcttagagtgccgcaggtagctcctgtttgcccccaggtcccattttcaccctgcctcacctgtctttctcaccagggaggctgagtgtgggacacatcggctgggctcccgtattctggggtcctgttgagcttagccagtgaggagcccccagaggaggcaggtggttactcctgtagctccctcatcctgggaggctgccgctacctggctggactgctcgaatgaaggtcgctgccccacccaaggggactggctctacctgaaactctctccttccaggttttgtaactgttcctcaccccaggtctagggctggtaacagcttcaggttattgcactatttcttggggttccccatgcacctgtgcctttgggaatggtcccatagacggtcactcgctgagcatcatcttagaaatggggctgtgcactatgaaggtgagcaggcagaggtgggtacgctggtcagacccctggactggtgacaaccgccaggcagtgcacagagttggagtgatggggggcagaaccagaccatggcagcagcccctacgcctgctgatgggacagaacaggtggaagcagggggttccccaggttgcttcacagtgagcagcagtggcagtgtcttgcctaggcagggctctgtgcttggggcctccaactctgtcccctacctgtgtgggtcagtaggggagaggcacactgcaggtctctgcagtgtgattttagagttgacaagccttatacctaaaagctctctagcaaggcataaaccttccatttcacaagtacagataaggattaaactaggaacaccctgcaagaagggactgtggtagctgacgctcactctgcagtgcactcagcggctcccaaacctgcgggcaggttcagcagaggatgggcatcctggggagagacaggctgagcatgttactcaactctcctctttctctctgcatgtaagtccaaagtcaaaagcactgcatttaattcagctcctttagtgatgctggtgtcgctgtcctcccacaaaagggagcacagaaagtgctgaagggagtaacacattggtgctgacggagtctcactgtgtcgtccaggctggagtgcggtgacacaatctcagctcactgcatcctccgcctcccaggttcaagacattctcaagcctcagtctctcgagtagctgggaccacaggtgtgcaccaccacgtccagctaatttttgtatcttagctgaggtttcatgttggcctgactggtctcgaactcctgacctcaagtaatctgcccgcctcgtcctcccaaagtgctgggattacaggtatgggccaccgtgcccggcccgagactgcttttttaccatcttaatgttgtctgagatgatgagtgtgagatctggaccaccccacgtaagtgcgccaacgtcttttctaagaaagctgttgtgtttccagctttccctgcggttcctgccacttgtcctggtgggatggggtgggctcggctctgctggatccacgcctcactcatggatcagatcattcctttctcagtctgtgctcactaacctggcctccatctctttaccacttaattgatatttcagtttcctcatcacttactgatttatttcacttgaatcaccaagtccctagaagactgatggttacaaaattaagcatgaagctgaggaacggatcctggaacagggcggcctctggcaagcgctgcaccgccctggatctgagcacctttgaaaccgcagcaagcattgcttagtaaacgaaggtggttctgtggacaaaatcttcgcataatgggtatagaatacagagaggaagatgccgaggggtgtaaccatcgatcagcactccgctgctctctgtgtgtgggttccagatggggaagtcctccttggcattctgaccccagtgtgctctgctcccaccctgcacgcatctcttctctgttccttcttttgacttaaaagcagagaatataaaaaatgacttatttagagctccctgtggccattttctcaactttgaattgaaaatattggctgggtgtggtggctcacgcctgtaatcccagcactttgggaggccaaggtggacggatcacctgcggtcagaggttcaaaaccagcctggccaacatggtgaaaccccatctctaccaaaaaaagtacaaaaattagttaggcatgggggtgggcgcctgaaatcccagctactcaggaagctaaggcaggagaatcacttaaacccaggagatggaggttgcaccactcccaggagaaggcaaaattgcaccactgcactgcagcctgggtgacagagcaagactccatctcaaaaaaaaaaaaaaaaaaagaaaagaaaaaatatttataatatgctaacacactaaggctttgttttttgttttttgtttttgagatggagtctcgctctgtcccccaggctggagtgcagtggcgcgatatcagttcactgcaacttctgcctcctgggttcaagcaattctcctgcctcagcctccagagtagctgagactacaggtgcgcaccaccacgcccagctaatttttgtattttcagttgacacagggtttcaccatgttggtcaggatggtctcaatcttttgacctcgtgatccgcctgcctcggtctcccaaagtgctgggattacagccgtaagccaccgcgcccagcccacactaaaatgtttgtttgtttgttttgaaatgaagactcgctctgtcgcccaggctggagtgcagtggcgcaatctcggcttgctgcaagctccgcctcccaggttgacgccattctcccgtctcagtctcccaagtagctgggactacaggcacccgccaccatgcccggataattttggttttgtatttttagtagagacggggtttcaccgtgttagccaggatggtctcgatctcctgacctcgtgttccgcccacctcggcctccgaaagtgctgggattacagatgtgagccacactaaggttcttatagtctggaaagtaagcagcagtccctgtgtatgttgacatattaaaatgtggagcatgagataaaggtggtgttggcagcctccggggtagagccagctacacaggtgataggactaggtcagcaagttcgtgctgctcatggcaggagaggtgtgtctgcagtcagtcacccagatcgtgtggtgagggagccccaaatggtgggcacggaaccgctaagcctggactgttttctcagaaggtcttcttttcttctcacgttagaagcttccttttctagttgaggccaaccccttctgaaattggagtaaccattcccaggagtgatgggacaatcctccttctagactaaacaagagttccaggactggaccaaaagaagtgtggaacttgagggtgggaagtgagtcctcacgctctgcttctcggggcgtctattccctcactgtgtgggtgttgccagtatcagtggggagagaacctgggacgggcagattgatggtaactgtctggttagtagtggattattttagcagttgttatttttataaataggacacgttgaaatccattttgagtcactatcctgctcttagtttgattaaggtgtataagtaaaatgaatttcatactggtatgtgtctgttaaattatcctttagtatttttgcctgactaataaatgattagtgatagtctgtcttgttcattttcatagaattaaggccaagaagaccaaagaattacaccgtcttacaacacattttttttatataaattctttctaaattaaaattctgtgtaaatgggtttcagaaaaagtaattgatgactgtagtgcttatctctgaaacatacttgtccagttgtttgctgtatttgcaggtgtttttaaaatgtgtatggtagaatgaacatttgaaggtcttctgcaatcttattcaattcaactgcatttttttgtctaatagaattagaaaatagcttcaatataaaatatacttgtaaacatgttaaagctttatttagatcaatgctgtttcacttaaaaaaacaaaaattgcagtggtgtatgcctatagtcccagctatgtgggaggctgaggtgggagaatcccttgaaccaaggagtttgaggccaggctgggcaacatagtgtgcgaccccatcttgaacaaaaaagaaagaaagaaagagaaaaaaatcacatgaggcactttcataggtgcattatttctcttacaaaaaaaaaaatccatgtctaatcctttaatcttataaaggaatataaaggtaatcctttaatcttataaaggtatataaaggtttttgttttgttttgtttttttatactggttattaaatctagattcaccagtgttcttttaaacctgcgtgcttcatttgctgacatttcctctctgaggtcaggaacacaatatagtcatctcagatccgtacttgcccctctcaaatttgatctgtgcttcttcagtgacttgcaagataccaggcattaactcatgcctgatatctacaatgaaccttccaggggcctggattatagagaagagcaagggacgtccactgctgccccccggtgcgcatgtctaagggaagaacagacctgtaacttcagtacaaggtgtgtgtgactcacgaagcattaacaggcatgtcaaaactggagcagttaattccgacctgaggggctcaaagggaaggttttatgggaggaagtagcctttgaactgaactttgaaggcctattagtttcccaggatgccacaacttggtggcttagacaacagaagtttatttccttgtagttctggaggccagaagtctggagtaagtcatcagcagggttggttcctaagtcctcagcaggggtggttccttctggaggctgagggagaatccgccccacgctgccctcagctcctgctgttgccggcagtccttggcatccttggcttgtcgctgcgtcgccccagcctccacctgtcttcacgtggccctcccctccgtgccgcgctgcatcttctctctctctcttataaggacacttgtcattggatttagggcccaccctaatccgggataacctcatctccagatcctcaccttagttacatctgcagagacccttattgcaaataaggtctcattctgatgtttccagtggacctgtctttttgcggaggccactgttcagcccactgcagaaaggcaagcaggatgtcaggtgaccataggagaacagggaaggcactgttgaggaagaaagaatagtgtgtgcagaggcacagaacagaagcatgaggaacgcattctcaaaactggatttcccaaagttcaaacccttcctttgaaaaggatatgttgaaatgatcctagagatgagattcctaggggatgtgataggagatgaggctggaaaggtaggttagagttcgagttctagaaccttgaatgatacagggtatattgtgtaggtagggaggacacgagcagccaggcacagtgactcatgcttataaccacagtgctttggaaggctgaggcttgaggccaaaagtgcaagaccagcctggtcaacatagtgagaccccatcactacaaaaaaaaaaatacagaataaaaaagttagccagatgtaatggcaggcatctgtagtctcagctgctaggattgcttgagcctgagagttcaaggctgcagtgagccatgatcgcaccactgcagtccatcctgggtggcagagtgagaccctgtctcaaaaaaacaaacaaaggtaccaaacaagcatattatgtaatcagatttgtttttaataggagaaatacttccaatatttcaatttagtgtttataattgcttgcatttaaacttagatgttgcatttgtaaaagtttgttattaacctttatgaattaaacactttaatataaacttgctacttactcatattcttctttagcaactcccttgcataataatgttgggttggcatctgtttaaagagtagtgagatttaacatcagtctgcaaacaggtttcttccttttgtagagcagtaactcaagtcccagtgtgatactctgtaattatgcttctatcctataacactgaaaatatcaaaagcaagaagggagcattgtgttaatatcttaacctcagttagcttttgaatatggagttggaacttcttgccctctcaggaattttgataatttattttattttatttatttttttgagacggagtcttgctctgttgcacagactggagtgcagtggtaggatctcggctcactgcagcctccacctcccgggttccagccgttcctctacctcagcctcccaggtagctgggattacaggcacatgtcaccacgcccggctgatttttgtatttttcatagagatggggattcaccatgttgcccaggctggtctcgaattcctgacctcaggtgatccacccagctcagcctcccaaaatgctgggattacaggcgtgagccaccgcacgcggccaaggaattttgataatatattttaaacagcctgttgttgaacaatttgggtgggttttgttgttgttgttgtataactccaaattacactcattttcactctgtttcaatttatttcttcctccaagtacaatgtgagacttcaccataatgtaactaacacagatggtgccacctataatcgtaaagtttatactaaaagtagaaaagcgacattaaaaaggaacgttttatattttactgtattttcctagcttaaaaagcttatacttttgttgtgattgatgttgttttattacatcagtaataatctgtccttattcccactcaacagaaattttattataatttgtaggtggctcacgcctgtaatcccagaagtttgggaagccaaggcaggtggatcacttgagcctgggagtttgagaccagcttgggcaacatagtaagacctcatctctatttaaaattaattattatttttctttttttgaggcagagtaccattctgttccccaggctggagtgtagtagcacaatctcagctcactgcaacctccatgtcctgggttgaagcaattcttttttttttttttttttttgagacggagtctcgctctgtcgccaggctggagtgcagtggcacaatctcagttcactgcaacctccgcctccagggttcaagcgattcttctgcctcagcctcctgtgtggctgggattacaggtgcgtgctatcatgccaggctaatttttctatttttagtagagacagggtttcaccatgttggctaggatggtctcgatctcatgaccttgtgatccacccacctcggcctcccaaagtgctgggattacaggtgtgagccactgcacctggcctgaagcaattcttgtgcctcagcctgccaagtagctgggattacaggcatgcaccactatgcacagctaatttttgtatttttagtagagacggggtttcgccatgttgcccaggatagtctcaaactcctggcctctcaagcaatccacccgccttggcctcccaaagtgctgggattacaggcgtgagccactgcacccagccataaaatttaatttaaaaaaattttttaaagaaattttattataaattttatttttgtttttaaaattatttttaactggttttacacattcaaagagggtttattataatttattttaaatatttaaccttttacggctgggtgtgatggctcacacctgtaatcccagcactttgggaggctcaggcaggcagatcacttgaggtcaggagtttgagaccagcctggccaacatggtgaaaccccgtctctactaaaaatacaaggattagccaggcttgttttcccacacctataatccaagctactcaggaggctgaggaacaagaattgcttgaaccctggaggtggaggttgcgatgagttgagattgtgccactgcactccagcctgggtgacagagcgagaccctgtctccaaaataaataaataagtaaatatttaacatgttactttgtttggtcgagtgctttatatttttaaaaaatgtcgtagatcctcccccaaacctggaacccagttacagaggttctaatcttgagaaaagcatgagacctcttccagccaatgggcatcctccaaagtgcctcatcagaacttcaaagcttccaaggccatcacaacaaggagggtctgagaaactgtcgcagccaggaggagcccgaggagatgctcccgaccatcatgtggaatcctggacgggatcgtgagacagacacagggcattaaggaaaaaataaggaaatctgaataatgtggagacttttgttaatacattgttggggtgtgtgtgtatgtgtgtgtgtatgtgtgtgtgacagagtcttgctctgtcacccaggctggagggcagtagcacaatcacagctcactgcagcctcaacctcctggctcaagagaccctcccacctcagcctcctgagtaggctggggccataggtgtgcaccaccacacctggctaattttttttatgttttgtagaaacgggatctcactatgttgcccaggctggtctcaaactcctagcctccagggctcctcctgcctcggcctcccaaagtgctggaattacaggtgggagccactgtacctagacacattcattatgattttcttggctgcttaactataaccgctgcaccatgctaatgcaagatgttgatgatggggaaacacatttccagctgccctggaggctgtgtgcatgcaggacagaggcaggagagcccagctctgcacacctccctggatgacggaggaagcccacgcagggagcaccaagccacactcccacagctccccagccaactagggggctgcctgtgtgtgaaggcagtgctggaggacctgccagaaagtctaagccatggcaggcttggaaactgtcttaactaggagagggctccacaagccacccaccagtccatcagccacaggtgggtgcctgactggctggggcacagcctctgaccgctcctaacctaggattggattatacctaggttgaagtaaatatccatgagtctacactgatatgaataaatgatcagataaataaataactctcctgtacataattattttaaacaaggaggtagggcataactccttgccattaagtgaggggtcctagtgaccttcttaaaaagattacagtacataaaggaggagggaaagagtacctctacttggagaaacctgacaaatatgacttcactcaggtgattaaggtgatgagtcacgttgattttaggcaccctggataggatgggatgagaaggcatgtgtaccctcagtatgatgatgaggacggagcgggtccctccgtgtgcggtgaggacggagcgtgtccctccgtgtgcggtgaggacggagcgtgtccctccgtgtgcggtgaggacggagcgggtgcctccgtgtgcggtgaggacggagcgtgtccctccgtgtgcggtgaggacggagcgggtgcctccgtgtgcggtgaggacggagcgtgtccctccgtgtgcggtgaggatggagcgtgtccctccgtgtgcggtgaggacggagcgtgtccctccgtgtgcggtgaggacggagcgggtgcctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgaggacggagcgtgtccctccgtgtgcggtgagtatggagcgtgtgcctccgtgtgtggtgagtatggagcgggtgcctccgtgtgatgatgagaatgaaactgtgtaacccaaagactgagaaaaaccgtgtgttctcacactgctttaaataggctacctgagactgggtgggtaatttataaaggaaagcggtttaattgactcacagttctgcatggctggaggggcctcaggaaacttacaatcatggctgaacgggaagaggcacgtctttcgtggtagcaggcaacagagagagcgagggcagagaaaactgccttataaaactctcagatctcctgaaaactcaggcactatcacaagaacagcatggaggaaactgcccccatgatccaatcacctcccagcaggtcctgcccttggcacgtggggattatgggaactacaattcaagatgagatttgggtggggacacgaagccaaaccatatcaataacgtaagatgataaacttgggggaacctgatatggagtatataggaactgttccagctttgcaacttttttgtaaatctggaacatatatttattcaaaatacaatgttcattgaaataatttagaaatcaacacattaaaatggtatattaaaaatataatctaacaccaaacttacagattttcaaaaattctgtaagtttgaacattcctgccctatattattttcaattatttcacatattcatatagtaatactaacatgtataatatgtctataatatgtgtacctcttttatgaaaattcttgatttaatgaatgaacaaaattatcttctgagatttcctttctgggagatggtttgttacattttactatacttagcctccctcttgatttcttgcttttgaattttaggatgttagatttggcaggcaatttgtaacttaaatactggctgaatgtatgcttgactgccctgatctttggcttttgttttgcgccaattccacactcagtaggcatgaggagactgcgcatgcggctgcgcgaggagcgtcatccttagcagcgatggcggacacggaccagatctctctgtgccgctctcatgagagcttgctgtttcaggcctttcttaagcagggccctcactgtctagtctatcagtgttttgagaaacatgggagcacaccaactgaaacttcatctgtccatccgttccctccctgacagccgctgctattcattcacgaaccccgagcttgtccttggtagtgctggtggcagtgtgatgacagtcactgtcccctccattggtttgcagtgtctgtaaggacaagggttgtgtttgttgtcttccctgcggcatccccgcctctcgcacagtggatgctgcgggtgcctcaccagaatcctgtctcatccaagttctcatatttcaacatctctgccccaggacattctttggcaactgggcttgtgggtagaaatgacgggggtgatgtcccaggaattacctggaacccaggcagggcaggagtggtcctcccacgagacagttctgaggtctgtacagcctcagagcatcctccctcatagcttcactccagggtcacgaaggtataacctgcttactgggcaccctttcttttgaatttttcctcccctaactttccatggtctcaggatcagctttgggaggaatgcacactagacaatatgcaataaatatttatagactgaattaatgtatggattacttgagtaagatactgatcattcaaataaattatcacccaggaaggaaaaaaatattagaaatacacagtcactgttaacgagatagaaggtaataactgatgagacagaagtaaaatgctgttggcgttcaggggaagaagtcattttagatttccttaccctttccaggtcagggttggtgacccacctgtgtgttctcaggtgatccagtgctcaccctgggctgatgcataagctttgagggtggataaccggtcattgtgtccccctgtgggtaaccccaggacagggcccaggacacaggggtcctccccaggtgcgctcagatgagcgcaccgttgagtgagggaagtgagtttaataaggagctactggagcctgggacagagcttcaaatcccgcttgggtcactacttcaccgtctgatttggggcaagtgacgcagcttctcctagcctcggtttcctcagaggtaaaatgaaaaaatgaagctgtattcctcgaggttgtcacatcagttaagtgaggtgatttattgcagtacctggtccgtaatgagcactcagacgttcacttcttttgtgggaaaagatgtccgttgaggttggattgaaattgaacaaggaaaagtcaaggaggaggacgtttaaggcaagtgagtgaacaagggcaagaagggagaggtcaaaggctacaggagactgacagggagaccgtttgcttagacatgaaaccaggagctgggaaataaggctgcggagaagccagatgtggagatgcatgaatgagacaggagacgtctggaatttattccacatcaggagggagacatttgagagagaaatatccaggaggcagttgcagtgacaaaactctgcattataaattgtaatatcccaaagagaggtcagaatgaaaatagacttgagagtggtccacatcatttgtcatgaaattggcaaaccagctgcatggatgtccacagtaggaaatatacaaaattgtggggctcctttccacagccaaagagcttggttagtatcacttgtttaacacttgttttgctaattagcttatacactacatgtttttcttctcagatatttcccaagtagtccagatcttcctaaaatgcacagatcggtgtgggctgaatggagctgtcaaggatgtctcttgcagatggcataatttggactgacccatgaaaatagggaaggatttcggcagaacggggaaagcagttgtggcgggccgagggaaggagggggatcagcttggctgagaacacagctttggaatccagaggcttcaagttcaaattcaggttccatgactcaccagtcatatccttgagccaaggtctaatgaaggagttcactgggccacaaacagacggagaaagtatttcaggcagaggaagcagtagtgtcaggccccatggaagagacagcagagcactgatggaggactggaaaaaaatagggggttggagaaaatacggagcaggagtgtttaatacaagaggcagggaggtaggcgggggccaggcctcccaggtcttataggtcaggggtccccaatcctggggccatgaaccagtacagttccctggcctgttaggaaatgggctgcacagcaggaggcaaggggcgggtgagccagcattatggcctgagctgtgcatcctctcagattagggacagctttagtgtctcataggagtccaaacccgatggtgaactgtgcccacgagggatctaggttgtgtgctcctgatgagaatctggtgcctgatgatctgaggtggaacagtttcatcctgaaaccacccactaccacccccagtggaaaaattgtcttccacaaaaccagtcctagggactgctgttctaggtgacttcaagggttttgcctttattctaaagcatctggattagattatatttgcatctggcaaaatcttcctggatgcagtgtggacagctgtggaagatgcagggggcagaaggattggtgaggaagttaggatatgtagggggtggccatggaggcagagaaatgagtggatttgagggttctggggtgcaaaatcaaggcattgtgataaattggttagggtgacaagaggacattggcaagggtgactcctagatttccatgattggttggacggtgttgccttttccttatcagtgtgctatcaaccccacaatacattgtcattatttttgtttaaattgtcagttagggctgggcacagtggctcacacctgtaatcccagcactttgggaggccgagccatgcaagatcacctgaggtcaggagttcaagaccagcctggccaacatggtgaaaccccgtctctactaaaaatacaaatattagccaggtgtgatggtgtgcacctgtaatcccagctactcgggaggctgaggcaggagaatctcttgaaccttggaggcagaggttgcagtgagccaagatctagccactgcactccagcctgggcaacaagagctaaactctgtctcaaaaaaaaaaaatacataaaaaaataaattgtcaattagcttttagagagatttaaataatttttgaaagcatttgtatatttgtccacattgttaccattttcagtgctctctgttccctgtgtaagtccgtatttccatacagcatttatgtaaatagtacctttaaaatttttttaaatttctgtctgctaacaatgagttagtagatacaaatatagtagccttttttttctatttgcatttgctttattgtacttttttcctttttttaagttttatttttggttgacacataattgtacatatttatgggatacagtttgatgttttagtacatgtatatattgtgtactgataaaatcaggataattagtatatctgtcacctaaaacacgtatcatttctttatggcaggaacattcaaaatcctcccttctagctattttgaactatacaatacgttattgttaactatagtcaccccactgtgcaatagaacaccagaatgcattcctcctgtctgactgtaactgaccaacctctcctcatacccccaccccattccctccccagcctctggtaaccactctctactttctactcctgtgagatcagcttgtttagattccacagatgaatgggatggtatttgtctttccacgcctggcttatttcatgtaacacagtgtcctctaggttcatcctgtgctcacagatgtcaggatttcattcttttttatggttgaatagtactccattgtttataggtaccacgtttctttatccattcatcttttggcgacacttaggtggattccatgtcttggctgttgtgaatagtgctgcactcaacatggcagtgcacatgtgtcatgaacactctgatttcatttcctttgggtatatacccggtagtgggattgctggatcatagggtaattctatttttaattttttgaggaacctctgtactgttttctataatggctctactaatttatatttcattcccaccaatagttcaataaaagagcgggggggggggctcccttttgtccacatcctcagcaacactcatcttttgttttgttttgttttgtttataatagccattctaactggagtgaggtgatatctcattgtggttttgatttgcatttctccagtgactagcgatggtggacattttttcatatacctgttggccatttgtatgtcttctttgagaaatgtgtattcagttcttttgcccattttttaatcagattatttggggtttttttcctgctgttgagttgtttgagttcctaatctgttttggatattaaccctttatcagatgtatagtttgcaaatattttctctcattctgtaggttgtctcttcactctgttgattatttcctttgcaggatagaagctttttagtttgatataatcccatttgtccatttttgcttttgttccatgtgcttttgaggctttatccataaaatatttgcccagaccaaagtcatgaagcatttcccctatgttttcttctagtagtttcgtagtttgggtcgtagattttcagtctctaatctattttccattgatttttgtatctgatgagagataggagtccagcttcatttttctgcatgtggatatctaggttttccagcaccatttatggaagagaccaccctttgcccggtgtgtattcttggaacctttgtcaaaaatcatttggctgtaatgtgtggatttatttctgggctttctaattctctttgtctgtgtgtctgtttttatgccagcttcatgctgttttggttattatagctttgtagtacattttgaagtcaggtagtgtgatatcttcagctttgttctttttgctcaaaattcttttggctatttggggtcctttgtggttctatacaaatgttaggattttttttttcttgtcctgcgaagaattggtattttgataggcattgcattgaatctgtagatcacagtggatagtgtggtcattttaacaatattcttccaatccatgaacacaagatatcttcccttttatttgtatcttcttcaattcttcctctttttttttatttttatttatttttttgacagtctcactttgtaaccaaagctggagtgcagtgccgcaatctcagcccactacaacctccgcctcccaggttcaagcaattctcgtgcctcagcctcctgagaagctgggattacaggcctgtgccaccatgcccagctaatttttgtatttttagtagagacggggtttctccatattggccaggctggtctcaaactcctgacctcaggtgatctgcctgcctcagcctcccaaagtgctaggattacaggcgcgtgctaccacacctggtctgcttcaattctttcatcagtgttttatagttttcactctagaggtctttcacctcctgagttaaattaattcctgagtattttgtttttttgtagctattgtaaatgggattcttttattatttctatttcggatagttgtctattagtgtatagaaatgctactgattttttatgttgagtttatatcttgtaactttactgaatttattagttttgacagtttcttgatggagtcattagggttttccatatataagattatgtcatctgcaaacagggacaatttaacttccttgtttccatatttggatgccttttatttctttgtcttgcctgactgctctgacaaggacttccagtactaccttgaacagagtagcaacagcaggcattcttgtcttgttcctggtcttttttttcccctttatttttatttttattttattttattagttttgtagaaactgggtcttgctatgccacccaggctggtctcgaactcctgggctcaagtgacccttccacctcagcctcccagagttctgggattacaggtgtgagccaatgcacctggccttgttccagatcttgaagggaaagcttccaacttttccccattcgattagctttgtctttgttttattaaccctgatttaattctatgaccctgctaaactcattctttttagatctaggaactttttctagattctttggtatttcctatgtagaaaatcatacagtgtgcacataaagacagttttgctttttccttttcaacatgtatgcctttcatttttttctcttgccttatttcaccatctgggacctccaatatagtgttcatagaattagtgagagtgagcatccttgcctggcccttgatcatactgggaaaacatttcgtattttaccattaagtctgttagtgataggtttacgtatatgctcttcatccgattgagggaattctttattattactgatgttttgcctttttttcttttagcagtagaagactcagaaagtggtgtttacatgcgattcatgaggtcacacaagtgttatgacatcgttccaaccagttcaaagcttgttgtctttgatactacattacaagtaagtgtactccattttcatgaattttttggtattttttggatggctactactttatacagtaatttaaaaccagcaatgccagcaaacgtttattgagtcctttgcactatcgggcactgtgctgaggttttatctgaattctcaacatcttggcaaccttataagaaatgtgctattactgtcttcttcctaaagacagggaagctcaaattatagagtttaagaacttaagtcagaaagctttggccaggtgcagtggctcacgtctgtaatcccagcactttgggaggccgaggctggcagattacctgaggttgggagttggagaccagcctggccaacgtgatgaaacaccatctgtactaaaaatacaaaattaaccgggtgtggtggtgcatgcctgtagtcccagctactcaggaccctgagacaggagagtcgcttgaacccaggaggcagaggttgcagtgagccgagcttgtgccactgcactccagcttggcaacagagtgagactccatctcaaaaaaaaaagaaaaagaaagcttagtccacaagttgttgtggaatttaaggacctaatccacagagctagtacaagatggggttttgaacacaggcctgtctaatgtgtgttagaacctaagctgttcattattaaactgtatggcctcgctcagtatatcctcatggtctttcttagttatttagtagaacatatgataaatttgaaataatattggtaaaaaagaagaaaatcacaaaaatgggcaatcttttgaaagaagaaccttaccgatctcttttcccagaaaatttgaatcttaacattttggtattaaaattatgcgtattgcaacttactttatatcaatgtaacttataatcacatacaaaaagtcctaaataatatactcaataccgtgatcaaactacattcagtgtaatcaaatgggtgtctacacacatatctgtgcgtatacatttagtgtattgtttctacataaatattttccaagtaggattgtcctcagtcgagttcctcagaagtaaatgctaaaccaagaattcatgggtttatgaaggatgcactcccaggaggaagcatgaagggatcagaggaagagcagggcaggggaagacacccagcaagggccctggaagggctgcctcagcctgagccttcgggagcaccagctgaaaggtgccctggagtgtatccaccccctcccatagccctgccttagatgatccttccaggctcttcctgctccaccaggccctttagacctccccagggacccccaggtgtggcctgcttctgttcccatgccccacacctgccgtgcgtcctcagagggctccccgggctcttggagccccttacctgtattctgtgcctgccacccaggacttacaggatgaccaaaaatgactttgcttttgtttaatttcattttccaattgtttcttgttaacgtatggaaatacaattgatttttgcaaattggctttatgttctttgctgagttcactttggaccaggtaaccttcagagtcacttttaaaaccctaagattcttgattatttgacacaaagaaggaagcatccaaatacaatcttatagtagggaaaacagtaggcagttgttttaagagatgcggtctcgagaactgtgactacatgtttcaataacaaaataatgagaagttctgaattcccaaaataaaggaactactggctcaacctatttcagcctcacgcccatcccccagaaggtttactttttaaaataccagattttctgaccaccggcatttctaccaacttaaaaataagcgacagtaggccgggcacagtggctcaaacctgtaattccagcgctttgggaggccaaggcgggcagatcacttgaggttaggagttcaagaccaccctggccaacatggtgaaaccccgtctctgttaagaatacaaaaattaaaattagccgagtgtggtagaagtcacctgtagtcccagctactcgggaggctgaggcgggagggtcgcttcaacccaggaggcggaggctgcagtgagccgagattgtgccactgcactccagcctggatgacagagcaagactccaacaaagcaagactctcaaaaaataataataacaagtaacagctgatttgacttttacccagctttccatgtattactcattttggctaaaccctagagaaagtcaagtgagtaatacatgaaaaatgcaatgccttatggatgtccaaggtgactgatccagtaaatatcacttccgtaattaagaggagctgtgagcatcatctccgggaagccgtttatcctgtgagcctctaagttgagaggagctgagatgcattaccatggaaatagggggagagagttgtttggcattggttaagtcaaggtaaaaagatgtatttgaaaaggggtgatttgagtattttctagacacaggctgcagtaatagccattgacacaccctcaagagctaagaaagcaaacaaaatagccgcgtacccaaaacaacctaagagaccagttaaataaatcctcgcataggcatataatagaatactgcataatggagaaaatgtttgtcaagagtatattcattgattcattgattaggaaaagaaaaagtaagctgcagaacagtactcaaaatgaccacgttactctgaggatacgacgtcatcagagccgtaactgctctagggaccaaggcgagccacttgcagggaagctgaaagagtgtgcgcagacaggagtagaacagagccaatgagaggagagcagaatgcgagggtgtgccaccagaatgagggggaagagcagtctcgggcttggcttttctgcttccatcttcggtctcttgagaggccgactggactccctgcagttgggttccatgagattcccctcggtttaatactggaatcaccctggggatccatgtagatatgtcctggccatctcagtcctgataaagtggaaatcaaatgtccaactgggaggtctgcctgctgggggatgtaatccccactgtcctcaagagccacactgtgcagtgccagcaggggccagcccagcaggagaagcacctgtaaaccaagcccagctttttctccatcagtcagtggctcataaggagctcccccgagtctgggtgtggatcgaggtaggggaggcaccggtgtcagagcagctgcatcatgtacccatgcagtgtccatgtacttcacaggcctgggcgagccccgtctcggcctggcgagagagggtcgctgtgcatgctcagcattcggcttggggggcctagtagttccctgttcgtgatggggagctcaggttgcatggtctccgcatctcgtggctagcttgtttggtctctataagggcctggtgcagtcggccaggaactgtttcccagcgggagagtcattatctgcaggagaaggcatggttgttttggggttaatcttccctcaaaaccctcaatgtctgctctgtaaatttccttttggtggaggcttcctacagcacccctaatatcaaccttgctgggtcctaaggccacacagaagagcagcctggacttgccacatgcctgatcgtgccctgggcctctctgaaaacagcttttagtgtcactcagtaccggtgtcagagtagcacgtacacatgtggtgcatgttgcctccaaaacacctgcctggtggttgcagtggcaggtggagtgtggagtgacaacttgaagctcccattggaggggtgtctccagtgtttcaggccgttctggggtgtgagacccccggttctgcggggtctgtccctcatgctctgcccggcacatatctcacagaggcacctagagctctgctacttcctgcctgtctagtccagcccacaccgctatcagcgcatgggccagtgtggcagtgtgcagtgtgaagatggccagcttctctgcagaccataataaggtagagagcgggggtgccgcagccttgagacacacgggtgaaagtatcctgttgccaggtaaagcagactccgtctaggggtccttgtagattggtatagagaaaaggagtatgtgtccaggcaggggctgtgggtcccccaagatactacattgggaacagctgctgcagtgacaagttcacttttcctattgaaggggcccctcacctgtacattcctcaggggctccaggagggagtgtcctctgggtatggaatgtgcaggtggcacatgacaaatccgtgccaatgcccctgtctcccgaagcctgtggattcctcctgtatagttcactgtgccacagaagcctggcatctcagcctcattaaacacggactcagcagtgccctgcacttcaggcagtcaaccaagtgagcggttagagccactgccggctgcgtgcacaaaatgttaatgaacaatttctcataagaccactcatagcaatcagtcccaccaaactagtgttaaatttctcgtctttgtcctaacgttactagcacctattcccatacatacttcttcggtttctgcagctgtgaaatggcaagatctcacagtttgttttgcatataagtggtttcctcccctgcagcatgcggaaacctgtccccagttacaggtcaaggggtggcaagggtgggagggtgagaggcccacgctaggcgtctgccctaggaaagcctgtcactgggctttcgagtaaagaaaggtgattctcagacactggggagccagctgttcccactgccatgggaggctcggaggaactcccgaatctggaatctcagcttcatctgagtccagtcagatgtccctctgtccggtgccagggtcccactccttccagatccatgcccagctttcccatcaaacctggtgatgccaccaattccgcctgtgcatccacaccccgcagagttatgctttgtgtttgattttggaaacagccctgtagctacaagaaatagactctctggggactgccatagaggcttgttgggttctctgtctgtgggtgcaggtcccagacctgggcttgaggttttctcagaggccccagcgcactcacagaatgctgtcatactgagtcctttggtcctggcttctgcctcagtggccagtgcagtggccatgtgggccctggcacacaaatgtcatcacaggcacagatgatggcttttttagtcacaatgccatggcctgccctggattacaggaatctgatttcccactgacaaagagctcaacactgtgttaaacccatggatgggaaaccaattccaagtcctctgttcctgggaaccagtcttggcagtttcttttttcttcttcttcttcttttttttaaagacagggtctcattctgtcacccaggctgaagtgcagtggtacgatcttggctcactgcaacctctgcctcccaggttcaagcaattcttgtgcctcacccacctgagtagctgggattacaggcacccactaccacacctggctaattttttgtatttttagtagagatggggtttcactttgttggccaggctggcctgaaactcctggcctcttgacctgcccgcctcagcctcccaaagtgctgggactacaggtgtgagccaccgtgcccggccgtggtgccagtttcttgatcagtcaaggttcagtcaggagacagaagccacaccagttatttgaacagaaaaagaacataagcaaatgttaactggatctaaattaactggtaactgaaaggacaaataaagacctctaaggcagtgttctcaaagtctgattcccagactagcagcttcagcatcagctggaacttttaaaaacgcagctcatcagacccaatctgagacccgaatccaaaacggggggatgaggctcagtgacccatgtttcaccatgatgctgtgtgagtctggtgtactccacagtgtcgtggaggagagggggtcctggcgcgtgccttctagctggtgcttatgtctctgggtgggagttggggcttgaggaagctcattttgcacaaaatgggaaaacaacaaactgtattcagccgctgctacaggaggtgcctcggtgcccaggtaaggcagtgcctgggtggagctcacgggagctgcaggcagacaggagccctgctagccgctgacgggaggagcaagcccttcttcctgctctggctttgagtccctccctagactcctgtattgtcagaacctgaaatagagccagttggcaacaccgaaacagggtctgcaaagtcccagcatcaccaagccaagttagagggatgggcatggagcagagagacagtaacttcatgactggcacagtagagaggggggacatccccttcccttccagataagcccaggaattcagagaaagataggtatcagttagtgtattagcctgttttcatgctgccaataaagacatacctgagactgggtaatttataaaggaaaagagatttaatggactcacagttccacgtgactggggaggcctcacaatcatggtggaaggcaaggagaagcaagtcatgtcttatatggatggcggcaagcagagagagcttgtgcaggggaactcctctttataaaaccatcagatcgctgggtgcggtgtctcacgcctgtaatcccagcactttgggaggccgaggcaggtggatcacttgaggcctggattttgagaccagcctggccaacatggcgaaaccgtcctcctaaaattacgaaaattagctgggcttggtgttgggtacctgtggtcccagctatttgggaggctgaagcaggagaatcgcttgaacacagaaggcagaggttacagtgagccaagattgcaccacttgcacaccagcctgggcgacagagcaagaatctgtcttaaaaaaaaaaaaaatcagatcttgtgagacttattcactatcatgagaacagcatgggaaagactcccccccatgattcagttacctcccactgggtccctcccatgacacgtgggaattatgggagcttcaattcaagatgagatttgggtggggacacagccaaaccacatcagttagtgattccaaaagatgacacctcgagaattatgagaggcccaaaaataaataaaacttcataatggaatcctcacaccctaggattggtggggggaagcattaggaatgatccaggcttttcctcacagtggcaatgtaacttcttttagcaatactctacaaatgatagcttttttttttaacaagtgttttataagagttttagatgtacagaaacatggcaaagctagtgcagagaatttacatataccccacacccagttgaattttgacatcttgcgttagtgtggtctatatttgtcccagttaatgaaccaatattgatacatggttatttgctaaagtccatgctttcttcagatttccttagtttttgcataatgccgttttctgttggaggatcccatctaggttaccccatcacgtctcgtcatcatgcctccttaggtgggacagcttctcagacaggtactccctgtgtttgacaccttgacggttttgaggagtgttggtcaggtattttccagaatgccctctactgagatttgcatgatgatttatcatgattagactgggcatgtggctttggaggagaaagaccagagagaggtaaagtgcccttttcatcataccgtctccagggtgcttactgcctgtgtgacttaccactctccattacctggctgaggtgtgccaggtttttccaccatgagatgattcttcttcctcctttccatgccatagtcccaagaaggaagtcaccacgtacagcccacacttagccatggggagtgacgcttcacctccgtgagggctgagcagctacgtgagttagttgggatttttctgcaagggagatttgtcccttctccatctgtttgtttattcagtcatctatttcagtatggatttatggatatttatttttgggttataatccagaacaacttcattttgttctttacattattccaggcaatgtgattttgaataatgccaacaaaaaaacaagcaagtatccaaataagtggctgtttgccaagcactattttttcttttgaggcagagtctcgctctgtcgcccaggctggagttcagtggcgcaatctcggctcacttgaagcgattctcccacctcagcctcccgagaagctaggattacaggcgggcaacaacacgcctagctaacttttgtatttttagtaaaggcttggtttcaccgtgttggccagtctggtctcgaactcctgacctcaagtgatccacccaccttgaagaatgagtagagaatacagaatgcagagcacatgatcaaaagtaaagtaaaaggaaagcttgaataggagggagctgcccaggacaatcctagtttagtgttaaaattaagaggcacaaagggaaggggcgcttgattattttaaaagcaggaaggaaagagaagccccggtcctattgttccaggctgatgctgctgatgtcaataaagagaaaacagaactgctcagctcaaactgtactttgttcattatcaaggaaaatgatcttcaaagtggaagaggtaaagtaatagtgattcgaggaaactaaagcccacaatagttgcggagagcacctgtcagcatgaaccacatctcatttctgatccagatgaatcacattctagcattaaagggaacttacaaaggagattcctaacctgttcgtgatattggaggagttgcggagaagaggtctgatttcggaggccagagataaaaggaaagagcagatagatttctcaaaaagcagaggctggggaatgtagtatcaatcccagctgagatttatgaatgaatggaatcggtcatgaattgaccaaaaaaaaaatttacaggagattcacctgcctttcttttgtggctgttgcgtagacggccgtgccatgacaggcacgtctggattccagctagagtaggctggcagagcctggcacgaggtcccagaggatgagatgcagagctgcagcttggcagccaagcagatcaattaatatttaaatctcagtcaacacctggagcaaggtttctaattgtgttggatgcctctcgtgggccatttccaaatccattcacatcaactcatagtccagcactcctcactctgtgcaggggcagtgggacggccctcagcccaggaccatcccatgtaccccagcttcctccgccaggggaggatagaagctagcagctacatgcagtcctaggaagatcccactggcatcagcatcagtgggctctgcggcggcagctcaggaacgcgtcctgcgctgactcacccgcccacccgtctccttcctcccttcctgtacttctgctccctggcatcacattcccaaatacactctgccttctggggagccccagctgagaaactgggggtacgccagagcattcttgtgccccacgctcttcagctttggaacaatgacttgaatattgatttcattgatggcatcatctaatttacagatgacttgaaaccaggtgggatagctgataataatcgaaacgcagaaagattcctcagtaggcaaaatttatacataggatcacttgatatggcatcaaggacagaagagatgagagcatgtgaatattctaaaaagatgaaaacgggctgagaacagggagggagaatggcaagccctgccacacatgggctcgtgctcgggaatgtgctggagcagagcagactagtggctgagagtttttcaaagcacatattaacaatttctgtcaagtggtaccaaaaaaactgacaataaagacatagtctcttgctcctgtgccttactcttgtcatattccacagaaacaacctgttgagccgttgaaccaaacacactgagtccataaaacctcccaagaaaagatgcgtgggaatgtattacttgaaattttatatatcacttacgttcaacctgtagactgctatgtctagaattctataacagaaatcatttttattaagaattgtgaaggtactaatatcattccatttcttctagctaccagtgctgatcgagagaaatttgatgcttttttaaaatccccagcctttatatatgattttatttttcccctctgaagcttttgtggctctcgctttctacctggtaccctaaaattccatcatcatgtgtcttgtggtcagttcatggtgccgggcaggtgacgtcccgctagaacctgacactcctagtatccagttctctggtccttgcgttgtttcttttttagaatttttatttatttatttattttagagatagggtttcactgtgttacccaggctggagtatggtagtgcagtcacagcccactgcagcccccagttcctgggctcaagcgatcctcctgccacagccttccaagtagctgagactacaggcgtgcaccaccacattcagttaattattttattttttgtagaggcagggttttgctatgttgcccagctgggtcttgaaccccgaggctcaagcgatcctcagcgctgcggcctcccgaagccactgtgcctagccttccttgcattctttcctcaatcattttcttcccagtgcttgcttttctccggaacttcagtgagcagctctgagacccccgagttgatctttaatattcttttcccattgttttttcaatttttcttttcattccactttttggaagattttttttttcctaacccttctagtgagatctgtgtaaaactgggacttgtgtgacttcagcgttcaaggccctgtcagatggctgcccattcattcataattaagagtgactgctaacagttggcatggacataccaagttcacaggtgggcttcttgcttggtgggcttcactgaagagcagtaagccagccatctttttcattggaggccccatgttcctatgtctgttttatttctggagcagtgcatttcctccagaaaacagtccttccatggcaatggtgggcaactgttcttctgaagtcgaaggagtactggggcttggaggggcatggaagatgagttcagggaggagggagtcatgcagctggcaagggaggcctgggcctggacggagaagagtctcgacgaccgtatttcagaagctggacccttcttgacgcagtagatatcagcgttaattttaaaagcttcacagtcaacttaattactgaaaatcagagtgaagctgtgtagaaagcagtgaggcatcagaggaaccagcttcccattctggggaacacagatgttctccttggtatagactgccagagtctcttagagcagctcgggcctgctcactattctaaaaacttacctatgaacattttatttcccatcttttcttatctaattatcacatttgctttgaaatgtgttgaaaatcctattaaaatgtaaactttaaaattaatcatagtttgagcaaattgcgtatcagttaaaaggaaagaaattttcaaaggtactcaagatccctgagcggtttcttcctgcaaattagaactagattgtgttagtcctctttgtatcctgtttattggttaattggaacaccctgtgccgtctataattatggagaattttccaagtatgattttaaattgctttataaacagctccatgcacgtgttcttaagaaagccaagttttagaaggcctcgttattgcaaagaaggtcggcaaaaccacagaagcgtcaggcccctcccgagctcacccaggacactgctctttaatgcattgtacgagtatcatgtccgtttggaatattatatgagatctctgaaggatggaattgagacttcctcagtgacctgcggacaggtcaacagtgtatgtggatgaaattaaaagaataaatctttcatcccagcactttgggaggctgaagcaggaggatcacttgaggcctagagtttgagaccagcccgggcaacatggcaaaaccccatctctacaaaaagatttaaaaattagctgagcatggtggcatatgcctgtgatcccagctactcaggaggctgaggcataaggatcacttgagcctacgaggttgaggctgcagtgagccgtgatcataccactatacttgagcctgggcaacagagtaagaccctgtctccaaagtgaaaaaaagaagaaatttctgttggcttctggtttggtcagtatagactggaaattttaagcatttgttcttcttggctgttagtgctgagcaccatactgaacatcttcaaatactagcctattcaatccacaccctacacctgtgaggaaatatccattagccccattttataacagcatgttgaggctcacagagggttaagtgactgagcagccaccacacagctggcacgggccaaggagcccgcgagaaagccttggtgcttgaggccatcagaaaaacgaagtgagctgctgtgcttatgatttcagtttgagaaatgaagcagtgtccctgttctgtagagatacacattttatgtggaaaacgagaagttgaagtccagtaggtgtagcaccttagctcgttgacaagaagtgggatggcctcttaattcactccacgtgcttccgtgagccttggttgttttatcttctgttgcagaagagataccactttgcacgttaaattcttaacgttctctttgccattgaactgctgcttcactggggcttttctctctataaaccttgccattgggctgggggaggtggcttacccctggaatcccagcactttgggaggcagaggcaggaggatcacttgagttcaggagttcaaaccagcatgggcaacataaccggaccctgtctctacaaaaaataacaaaataaaaagctagctgtggtggtgtgcacctgtggtcccagctactcaggaggctgaggtgggagaatcacttgaacccaggaggttgagactgcagtgagccatgttcctgccactgcactccagcctgggcaacagagcgagaccctgtcattcatacgtacatacatacatcgatccctctgttggaccgatactgtctgaaattaattaattcctccctccatccctccctgccattgaccacgcagcatcagtgtctttcatctcagaattaacttgattcagcacgcgtgatcagtttctaacgtctgtattattaccccgtatactttcccatacatgtatttgccaccttaagaattggtgttaggcagttatttcctgtttgtgttgttcacagtggcctcaccgtaaacagtatctgcagcattttgggggctgaacgcttttgtagcagattagtctgagaatttattatggggaagcaggatgtttttttctgagtctgaagtaataatcatcatatttgagtgttaaacttaaacccctgcttttgttggtatcattcttttaagcctgaggtgtgatgaggctcactgtagtgtaaaaatgtccattaaatctgttggatctatatgtgatcatttgtacaaggtgtaaacattaaatatcaaaatatcaaaatattcacaaactaagctaatagcaatatttattcttgggtttttttaaattattacactatttgaccagagatttttgtgtgtagatgtccactgtgctcagtcatttatgtcttgaagctggatacaatagtctctgccagaagcttctagaaatgtgtccactgaaggaagccctcttgtttggctctcacgtggtctcatctatggtttagatccattggactcattggcccttattagagaaaggcagtccttgataggatcctaggacttaggtcatagacaaggttcgtttactttctgtattgacaattgcaattaaaccatgcaataaatgcctagaatagcatttaattaccgtttagtccattttcatttcatgcagttactgctatagttaggtttgtctaccattttgctatgcgtttttcactttttctattgatttgttcttttattccttcttcactcgatttaacaaactatgtttaacccatttttctcctctgctagctttttagttatacattcttttttcatttttatgggtacatagtatgtgtatatacttatagggtgcatgaaatattttgatacaggcatacattgtataatcacatcaggataaatggggtgtccataacctcaagcatttatgatttctttacattacatacatcccaattattggttatttttaaatgtacaataaattattgttgactgtagtcaccctgctgtgccatcaaatactagaccgtattcattctatctaactacatttttttatccatgaactgcccctacttcctccccgcacccacccccactaccctcccttcccagcctctggtaaccatcattctactctctatttccatgagttcagttgttttcatttttagctcccacaaatggatgagaacatgtgaacttagttatacattcttttgttgatctttcagaggctgtcttacagattacatagcatctttgacttactactttccatcttttaataataattttaccaagtcccaaacaatgcaaaaaatgtatacaaaagttaaaccgtctcctaccctatgtgctattgttatatattttgcttctatataagttatgaatcccacaggatatcattactctggctttatgcagtattgatttatgttcacctacatctctgccctctcctgtgctctttgttccctcctacggttctgtgcaggtctagaatctttccttcagtgcagaggactccttaagtattttttattttttttgagatggagtctcactctgtcacccaggctggagtacagtggcatggtctcagctcattgcaacctccacctcctgggttcaagtgattctcctgcctcagcctcccaagtagctgggatcacaggtgcgcaccaccacacccgactaatttttgtatttttggtagagatggggttttttcatcacgttggccaggctggtcttgaactcctgacctcaagtgatccccccaccttggcctcccaaagtgctgggattacaggcatgagccagtgcacctggcctcccttaagtatttcttaatgctggttggttggtgacaattttctctgcttttttaatccaaaaaaccttactttgccaatcctttttgaaggatatcttcactggatatatgctctaacctagattggcaggttttttattttagcatcttaaagttttctttctcttgtcttctgactttcatagtttctgctggaaagtcagccgtcagcctgcttgttacccttttgaaagccaatgtgtcttttccccctctagctgattttccctttacctttggtttttagcatcttgtctatgacgtgcttaggtgtggttttctttgtgtttatcttacctgggatttgtttgattcttcttgataaatttcagcttcttgttgaaattgacctatgtgcagatgatgtgggaaatgccctcagaaaaattccagaatgaatgtgatgctcaatgcatagccttcttttctttcaagaattgtagctcccagaatccaccccgtgttgatgcactccagggccctcaaatagtgtttcctgtcttttgtacaacttggatagttgttttcaactgtttcattatgccaaactcagaactttctggcataggttttcaatagctatggctacttagggtttcatgaatgatcctcatgaatgtttttaacatttattttctctgctaaatctgtcattttgaagaaaacagtaagcaatttgtgcttttaaaagatgcccctggccaggtgcagtggctcatgcctgtaatcctaacactttgggaggccaagacaggaggatcacttaagcccaggagtttgagaccagtctgggcaacatagcaagatcctgcctctacaagaaaaaaaattatctggacatggtggcatgtgcctgtggtcccagctacttggaaggctgaggtgggagaatcacttgagcccggcaggggcagcggggaggggtgcagtgaggaaacaatgagccaaggtaccactatacttcagcctgggtgaaaaagtgagaccctgtctccaaaaaaaataaataaatacaaataaaacataaaaggtgcccccattcccattctattccaaccagtttagaaaagcaaacttaccagatattcagtgtgttttaaaatctatttacatgcgacttttccactatattcttctataatatattctaggaccacaatcagagatgcccagggtacaaatagcaaaccattcaaatgggcacacctttcctggatgccatttagttacaaaagcagtgtattttggtgcctttttgataaaggtgtgtttcagaaacagttcatgagtttctggatgctgctcagttactgttgctctcccacatcactgggttggctctactcatttcctcatcgtcattctcttgtagtcatttgactaatgtctagaatccctgctatattcaggactcagcgctggacgggttaaaataaatgcgtgaaataattgatgagctccctcaacgcaccagtagtccctatattcttgtgtaggtgaactaggtacatgcatgagcagttccacataaggcaaaatatatcacaataaaggaagaaataggtactaagttattagtcctaaagtcatctgctctaggttcctgcagttgttttcattagtaagttaacaaggattttgtttgttttgtttgttcatttgtttgtttgcttgtttgagacagagtctcactcttcactcaggctggagtacagtggcgtgttctcggctcactacagcctccacttcccaggttcaagcgattcttgtgcctcagcctcctgagtagctgggattacaggtgtgcgccaccatgcccagctaatttttgtatttttagtggagacgaggttttaccatgttagccaggctggtctcgaattcctggcctcaggtgatctgcccatctcggggggcctcccagagtgctaggattacaggcgtgggccactgtgcccagccaacaaggtttttttttgagtagtgagtgagaagagaataatttacttttagttaaaaaaaaaaaaacataaccataccataatgtaacactttttttaaagaaacattttactatcccagcttcttaatgtatcagtttaatctttttttgcttgtttctcattgtttccatttaaacacatatttttctaagtatcataatgtataattttacagttacatttttattgtcatagacctttcttgatatagttatgaaaacatcataattatgttaattattatttgattttttttctcattggtatgctagtatttgataagttttgtttgagaggtggatttttttttcagttttcaagattagaagtaatgtcacatggaacattgttgattcaggaatcccactcctaaaataattcaaagagaaaaagctgttgcacaagcaatatgaatactttgtgattcttgacactagctgtgttagaaaaaatattttctcagtgtttggtgccaccagtggttttataatagcccttgtattaggagctgcaactttaaaatatcggcttatttagcatctacaaatgacactttgttttaatttgcatttcttgggttattaataaggttggacattttccctgtacttatttgctgtctgaatttagaggatcattttcagcactgaacttttggttattaataaatcttcaagtatgataccttatggtatcccaaaagatatttgttatgagtgttaagtgagatatgatatgttagtgcctgacccatttgtgtctggaaggtataaaatgcaaaaatatattgtatctttcatacctttttttttcctcaaccttgggaactgagaaagtatgcttgttttctcattgaaaatactaaaaataaatttttatttcaggtaatttgatacaacttcagtgttttcagatgaattaataaccacatgtaggagatattagaccctgaagtttaattcttttgtatggttttaattacataaagtatgtatgtagacaagagtcttcagatacaataagaaaaaaaaaagaagttaattgcattatttcaatttcaaaaaataatttctaatccctgtatgcctttaggtgtaattcaaaaagatttttgctaatgttaataaattccattatttttagcttatcaaacttacgaaacttattatggaagataactgataagacttggtcaaatatgttaagggtatttttctggccaggtgcggtggctcacgcctgtaatcccaacactttgggaggccgaggtggatggatcacttgaggtcaggagttcgagacgagcttagccaacatggtgaaaccctgtttctaccaaaaatacaaaaattagccgggcatggtggcacatgcctgtcatcccagctactcgggaggctgaggtgagagaatcaattgagcccaggaagcagaggttgctgtgagccaagatggtgccactgcactccagcctgggcaacagagtgaaaccttgtctcaaaaaaaaaaggtatttttcttcctggactttgaaagtatgttttgtttctcctctttttcttcaggttaaaaaggccttctttgctttggtagccaacggtgtccgagcagcgccactgtgggagagtaaaaaacaaagttttgtaggtaagcagtgtgggcctgaggaaaatcgaaaatggaaaccttgaaagcagaaagcctaaagtattttaatagatgccggtttggaattcaacctagtaaacatgtttccaagttaaagaacattcttgctggcagggtgcagtggcccatgcccgtaatctcagcactttgggaggccaaggcagggagatcgcttgagcccagcagttcgaggccagcctgggcaacatagcaagacctcatctctacaaaaacatgcaaaaattagctactcaggaggctgaggtgggaggatcacttgagcccaggaggtcaaggccatgatcgctgcactgtactccagcctgggtgacagagcgagaccctgtcaaaaaaaaaaaaaaaattccttgcttttacatactgggtaagaaggtggacgtgctagtaaggtccaaacactgttgtcctttttttctttttttttttttttttgccgcctcattgagaactctacacactgttgtaacttttatggagcttttgttgttgttgttgttgaatttcttttaatttagcaactttttggctctctgaagagcttatgtgtctttaccagcccaatgaacaaaccccacgtaggacaccacagtcagatgtgagccagctgccccactttgggccacacatggcatatggcatccctgggccccgcactcatctcgctagtgcacacctttttgacagggcaaattagatgctgtaaacatgactgatgtctctgccagaccattgttatactgttaaaactgttgtgtaacttacagctatctaaatgccatcgttacttatcttatgaatcacagcagacaatgccattgtctctcttagtattcttcacgttattttgaaatgatcgttatgtctgcttctaggttttaatttcatcagggaagaagttcatgtctttttcatccgtatcatcctggtgtctagcacgtcaaaagcactcaataaatggcaactgttaaaaccattgtgtttagaatgcttcttgggaaacaatccaagtgcccagaattgtcacgtttctaaagcttacggaatactttatcttaaagtacttaaaattatttacctgtaactgcaattcttttttcaaatttgtatcaattaatgagttttctctcattgatttgccaaattctctggttagttccgtagtacttactgtcaggtttaatttcagctaaatttgtatatccagtttggtatacacaattaacacatcaatagttttaaataatatattaaactctgcttgatatcttcgaagtatattttataagctcttctagcatatattctaggctcacttgtcatttgaaatttttaaaaatgttttcatggttttatttgtaacatgtaattctttgttccaggaatgctaacaattacagatttcataaatatactacatagatactataaatcacctatggtaagtggcaccagttcctatgtcagtagttggagctgtacgtatctatgtatgtgtgtaggtatatgtgtgtattttaagatttttaatgttttcagttttttcttttttggtatggtgtgctgatggtgattttccaaatctatataacatgcagggaacttcagtacaaaactctctttactgtaagttatatgtatgaaactcaaagaaggaattctcaggaaaaataaaaggaaatagattctttattcagctttcggaattccttggcttagcagaattctacatatttattagctagacgttctgtaagttttgcttatctctgcgggcctgttgaggtggtagagcttaattcagttaccccagcaattgcagaacaagaattatatgtactttgtgattttaaagcagaaaaaaatgagtcattaaagtgaaataaattccgttttgacatgttcctgctaattaggaagagacagctcctggctgattttagtagcagaactctctggtccctagtacaatggttctggaaagagcgtagcttaaaaaccacttttgtccttcatctaactttgtgatatctgagattcaacctgcttggttttgtgtttttagtttctgtttgtttgttcatgagggtggggggaaggacaggattgcatactcttatttaactagtcctatttggggtacttaaaaggtgtaggttaattcaattaatactgctttatgcgtaatgctcagtattatccaataattcttacatcaaatacaaaaatgagtttcttcataaaacatgctcttgccgggcacagtggctcacgcctgtaatcccagcactttgggaagccgaagtaagtggatcacttgaggtcaggagttggagaccagcctggccaacatagtgaaaccctgtctctactaaaaatacaaaaattagctgggtgtggcagcgggcatctgtaatcccagctactcaggaggctgaggcacaagaatcgcttgaacccaggaggcggaggttgcagtgagccgagatcgcgccattgcactccagcctgggcgacagagggagactctgtctccgaaaaacaaacacaaccatactcttaggaagttttaccaaagattttgtaaatatcctgtatttatttcccatgaagtgtattatttcttcaatattaccaatgcaagtgaacacgggctttccttatagtggtcatatctctgcttttgaactagcaaaatcagcatgagtgtgatttttgaatagatagatttctgtgaaatgcagcaaatcccatataagaaatcttagcagtagaatatgaaatcaaaattgcaaaaaagcagttatgtctaaatatgcagcccaaagtttttcttaatatctgtagatacaggccaggcacagtggctcacgcctgtagtcccagcactttgggaagctgagaagggtggatcacttgagcccaggagtttgagaccagtggggcaacatggtgaaaccccatctctacaaaaaaaaaaaaaaaaaaaaaaaaaaaacccacaaaaattagccaggcatggtggtgtacatctgtagtccaagttactcagaggctgagttgagaggattacttaagcctgggaggttgaggctgcagtgagtcatgatcgcacttgtgcactccagcccggatgacagaatgagaccttgtctcaaaaaaaaaaaaaaacttgagatacatttttttctctatatctcacctcactttcttttttttgagacagagtctcactctgttgcccaggctggaatgcagtggtaccatctcggctcactgcaacctctgcttcctgggttcaagcaattctcctgcctcagcctcctgagtagctgggactacaggcacccaccaatatgcctggctaatttttgtatttttagtacagatgaggtctcaccatgttggccaggctggtctcaaactcctgacctcaggtgatctgcccaccttgatctcccaaagtgctgagattacaggcatgagcaaccgcacctggccgcctcattttctaattgcgaatagaaaatgctattatccaagctatgttttgtttcattttccaaatattttttctatgttgtatatgtatatttataaataagaatttttttatttgcaggtacagatttatgaattagaggaacataaaattgaaacatggaggggtaagcactattggatgtttaaaatcttttagtatcgggaaagctatgtttagtatgaaaagtatgttttcattttgcagatccttttctctctgctccataaaatgttatataaaacattctctttatttctgttaattttgatagtatgctactgtactaaagctgaacaatataagtattgtcccttctgtttatagacatgtataggacaccttcagcaggcaaggccttatcctagggccaggaatgtgaagatgaatgagctaaccaagccccacctcgctgcccacaatggggccaccgctcactactaagtctaagccctcagagatttgccttggtattaagaaatgcatcagaggcatgcctaacttgaaccaaagcaagcatctgttcttatttaaacctagtaattgtttctttacaaattgtggagaaacttaggacaaatgaacctcaaactagatggtttggagcaaatagcatggaagtaatttgaagaccatattctcttcattgtcacattgacattcaccctgtaaaatcatgatactcttttctgccatagaaccatttcttaaattcgcatttcatgattgtaaggtggtggtctcactgacacttgtcatggtgggttggtggagaggaccgggggtgggaatcacggcagacccagtctgtctgcaacagcggagcctttggagggtgctcaaggaaacactggtagaaatggagggaccaactgaaggaaaattttgaattcaaaattgaagagtttggttctgtgtttcccataatatgcttgataggagaagcaacctttgtagctggctgtgaaatcagaatacatcttggagttctcttacacccccaggggccctttcaaatccatacgatttagaagtttcactgagtgatgggtttggtttattacggctttgtcaaaccaagctaaacaaatttggcatgggatctgtacagtctgttgtgcagtgattgtgtaacaccagcttcttgtccagttctactgtacaagtactgatagaccaaggtttaagtatgtttacgttttgacattacatgatattttgtagtaataataatgccaaaatattcttaaacgccttctgtatagaaactttggtaaagcaaggccaggtgcggtggctcacacctgtaatcccagcactttgggaggccaaagcaggtggatcacttgagatcaggagttcaagaccagcctgaccaacatggtgaaaccctctctctactaaaaatacaaaattagagccaggcgcagtagctcacgcctataatcccagcactttgggaagccgaggcgggtggatcacctgaggtcaggagttcgagaccagcctagccaacatggtgaaaccctgtctctactaaaaatacaaaaaagtagccaggcgtggtggtgcgcacctgtactcccagctactcgggaggctgaggcaggagactcgcctgggcctgggaggcagaggttgcagtgagccaagatgatgctgctgtactccagcctgggcaacagagcaaaactccttctcaaaaaaaaaaaaaaaattaggctgggcacaggacctcatgcctgtaatcccagcactttgggaggctgaagtaggtggatcacttgaggtcaggagtgcgagaccagcctggccaacatcatgaaaccccatctctactaaaaatacaaaaaaaattagcagggtgtggtgacgtgcacctttagtcccagctatttgggaggctgaggtgggagaattgcttgtacctgggaggcagagattgcagtgaacccagatcatgccactgcactccagcctgagtgacagagtgagactgtctcagaaaaaaaaagaaaccttggaaaagcaaattaattgcagttgatatcttcagaaaaaaacagtttttatgtgctggaaagatgcccacaatgcagtaggttttgagcatcaatttggtaaaataatacttaaaaatatttaaagaacaaagtttgtcataactgattttatcttataacttatggaaattgattttttaaatttcataattgcttcatttcttgagagtaaggtgaacctggtagcattctagtgacctctgctggtattgctcttttatcagatttctttgtttttcctgattttataaacacttactgtcacattgttttttaatatttaatttttcttcaaatgcaacatcctgaaaacagtttggaagttgtttaaaatagccataactatgattaacacaggagttttaggcaaattaaatttctttttatttgagtttttaatccttctaactattaaccgtaaactgaagggtatttgaatttgtgttataactgcaaacagcaaatgtgttactaactgcatattttctttctataaatacagagctttatttacaagaaacatttaagcctttagtgaatatatctccagatgcaaggtaaacttgttttttttttctttgaaaacattcattcagatgtatgtgttttatcaccatgatagaaagaaagacacaaataaacatgttcttcattccaaacagggcctgcctccttaattccagctacactgtacgcattcagtaaatctaggaacactacaaaaatcacagccgttgctggtgctaaggatggataatggtctagtaatagggtcatactaaaccatcacgaagatctcggccaatctggggggcgtgttgaaattgcagattcctgggcttttacccctgacctgctaaatcaggatagggcccaggaatacacatttaaacaactcccttggcaattctgctccacactagcgtttaaacatcagtgtgtgttagatgtcggttcagatgtggtgagagcatgggctgccttctgtgtagtcgtctggcccgtccttttttatccaagccttctggtttggctgtgatacatttccatattggtgtaaaagcatctttcaaactcaaatccagtacagagaaagattaaaatatttattttcattttatttccaagtcctaacaaaaaggtataacaaccttcttactggcagtcccaggagagggaccaagtagaacagaaatgttggccctgcaatatctcctagccgggccggcccggggtagagccagtttgcccactcaccaatgcagagagcttgctgctacagcctttgctctcttgccaatacgatgtatctgtttgcttttctaaggatttaggtttcatcgtctttcaaataaaatcactaaatacactctttaaaaaaactcctcttcctggctgggcgcaagggctcatgcccgtaatcccagcactatgggaggccatggtgggtggatcgcttaagctcaggagttcgagagcagcctgggcaacgtggcaaaaccccatgtctacaaaaaagaaaggtggcgcatgcctgtagtcccagctactcaaataggctgaggtgggaggatcacctgagcccgggaggtcaaggctgcagtgagccatgacggcaggcaacagagcaagaccctgtctcaaaaaaacaaaccaaaaaaaatctcctcttctagagatttgtagcttgcacttgtatttgagatatgttaacatagattgtgaaaaatgaaaaatttgctgagatctctaatttaaaactcttccaaaacactgttattattgcaataataaaaacactggaagtgctttaaggcaggggtagtccaaagtgttctgatttttctcgaaagcctcctaacaactttaatgacttctcccacagcctcttcgatgctgtatactccttgatcaaaaataaaatccacagattgcccgttattgaccctatcagtgggaatgcactttatatacttacccacaaaagaatcctcaagttcctccagctttttgtaagtagtttttagcgtttctaaagacataattgcatttacttattaaataatgtacttcaagtaaattggctcctgttaccctcagtagaagaaattgttagttttgaggtctccctttctaaacttcagtttctcaacttactactctctgaattgtacattcttaaagttgattccaatttaaaagaatcaccttttagtgcaagtatcaaaacaattttaacaacaaaactcggcattctctctttaaattaaaacatttgtcaccagcatatgaggggaaataaggcaatctgcaagtctaattgaggactgttgtacaagataaactgaactaatatctagagcaaaaattgctttatgttgcttttactggtgtcatggttttagaaacatgttccaaaaaatgctttcctcaagattatcttataaactgcagcagtgatagaaaaacccgaagcaaataaaattttggcaagagaataccatgttggtccaaataaggcctgtattaacctgtaggttttctcagctacttgaaatgacctggctccgtagtcatccagaactttgagcctgtttggttggaaacattaaaagagactcaggaagaacagagagtttataagaggctttttatgtttgtcttttaattacatgcatggaatttgaggttgtaagtaatcagtcaaatagaaccagtagaaggtcttaatcgttctgaagaggtactttgaagagttgtttttccaagactgtaacagatattaaaaatgtacttcaaattagctttcccattttcctccccatggcttcacctaaggacctaacatagcgttccggtgcagtgtgaaggagctgaagctcctgccctggaggcagcttgagggaccccttttgctgacagaagcacagagggcttagtgatggagagaaataccttgtcaatcaacccagtcttgtattttaatcatttacatatataaataacatttatttaaccatgctgtgctaagaaagaaggtagggaagagtaatttacaaaaaaactcaagtctgaagtttaataaaggcgataatctaggaaaaagggattagggatgcatccgcattgtttatcagactggacatctgggaatgcagccgctttagtagttgaagtttaataggaacagagggagcatggggtgggaaggatgtattcagggcccccacgtgccaggcctgcagctcacttaatccttagagtcatcatttttaaataatattaatcatgagagctgattactgtatgtccggcactgttctaagcacttgacataatctcatcctcgctgctaccctatcaggtaggtatttttattaatcctattttatagggatgcagctaagaaaggttaagtagctttgccaaggttgcgtggctgggaagcggtagagccaggatccctttcaagcgttcctcactccccatgcttttctccacgcaggggccttgggagggaggcgtttgcataccttgcatacacaggacacctggctgggaaacgtgcccccagtcatgtggatactaagtggtagattgcaaacccgggagtctctctgactcccaagcccaaactatttctgctagtgtgctgttgcacaagagggagtaaaagcgtgagatcattcttttgcagagctgcttcagatttttatcttctataaaaaggagaggaagttgcctctgcccagtactgcctcatatttgggccaatatggtaattagaatcatgctaccagaatattcagctaactaaaggttttcagttaaaaatatagaacttaaagacatttcagagcctgatttttactgaattatgagatcattttctgagaaaaaaggagcattacccttcaagacgtttgaaaattagcctaagcctatagtgtgcaacagggaattcgctatgttgagatggactagatgacctaatagggctttctttttttttttctctaaatttctaggagtctcatgatttgaatattgatgaactctttgacttgaacattttgtttcttctaattgttcatcttttcctgataattataaggtacaccaggaggatggaatcaactataccctttataaaaggtggatttttgaaaccgtagaccttattttgttatactcaaacatgatcctagacttttctctcctgccatatccctcctcctttaaaacagcccatgaaaagttaatttttaaagattcttttaattctgttcagctggcttctttgttcctagtagacaaaaattggagctctccaaggagaattcaggatgtagaggcgggtggcgtgaggactagcttagcagtggctcagacagctgccgtcaaatgctttgggtttggaaatgtataggttcttaataaatattacttaatcctgacagcaggaccaggaatttaacatgaacaattaagaataaaggattcaattcttcgtggcttacaggtcttaatatcccaaatagacctgttcttccctggttctatacgcgttcttagtgagtgaagaggagatggaaaaagattacagtatcaatgctctgcaatagtttgtgaatagttaaatagaagcatagacctacaaactggttcaaacaaaagatacagtcctttgtaattttctcatgttaattcaggcatccaggtagactgttagaaaaaactaactttaatttgttggacatactttttcattcaaatctggacctttgaacatgacaagagtgtgttctgggtctagaacgtttgcgtttatcttccgtttagatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggtttgtgtgtttggcgctgacaggcagaaataattgtttatctcagggtgcaattattgtaagatgacctggcacaggagatacgtggggaaaatgaaaacttgggtatggtgaataaattcagcaccaaggggcacgcaggatcgtaaaaaaagtttaattggtttattttcatatgtccattaaaatatgatttcatatctaagttttcatttaaaatagacaaggttatttatcagtgtttaacttttagtaattatgtcattaaaactgattttaaatgaatttctttttgtcccttaagacatttttctaacatatatttttcatttttaggaaaagttgtagatatttattccaaatttgatgtaattgtaagtattttaattttgttcaatctgtcacctagaatgcattttaaacattcatgtaatgtgtttttatgtttttatcttgtttcttaatttaataatttctaaccttttggggtgtgaggatattatcagaattttatagaccttctatagtaattgtacttttaatctgcattggtttagcaaccaattatatattagtagcattttataatttttcatctttacaatacatgcatattttatgcactgccacagcatgtgtatatattttaaatgttcttgtttccacgtaggaggcctgatttattcgcctctagacgcgtgcgcagtgcacacgtggactcatggctcctttgtcgggcgcatcccattgcttagtgattgggagccactgttctaaagaagaaaaggggactgacactttatagccccaaatgtgcacgccattttttgccacaatactgaccccacattaaacattcttctgcagctgcctcaaaccctttgcttcacactattatgttaaacataacagtcaccgagaaatatgctgatcggcattttggttgagtgggacccgctaaaatgaatgagagccccatgaagccatttggatccatggggctcctcaagcctgttcttcctctggttgcttgatccccatgggtcccccaaagccttcccagcagaaaccttgttccccagggagcttgttgagaaggtccgttgctgcagcatttctagccctgtggcactcaccaccctttacagatgtcagcccaccttgccagagatttcatccatgcatggtagagagcattagagggtaaaaattggggggcagtctttggcaggatatactgtcaaagtttaacaatgttgcttcgtaaggaaggtagaccttgtaacatggttatctttaattgtgattgatatgttgacaaaataacagtagcaatggcatgtcgtaagccagaaagaacgtctgatgtatgcaggtactaaattcagataagcattaaagtttttagaaatcaggctctcttaagctcactaattttggtcattgaagtgaactgaaatgaaaggatataatttattctcttgcttcattacagaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtgagacggctttcccagtcctgctcccccgacgtccactgcaacaagtccccagtagtgaatgatgcctctggaagcctgaatctcaggaagggcccagcgaggcagcctccaggttcagtcgatgggattccctcctgtcccagaacctggcacactacttggcatataggcgatctctaaaagtttgttgaattgaattgaatggaaaagtcctggtatcataggtgaatccaataaactggtaagatacattcatagtttaaactatatatgtttgacagtgtggacgacataataagaccttgtctctactaaaaataaaaataaattagctgggcatggtggcttggacctgtagtcatagctaatagggaagctgaggaaggaggatcccttgaatccaagagcttgatatttcagtgagctgtggcggtgccactgcactccagtctcgacagcagagcaagaccctgtctctaaatagatcgatgtatctgtatctatggatacattttgttttgagaaaacaaaaatcccagaagctttaagttccatttgaatatttatgaattcaaaatttaaagtgcgtaatatatattttaacaaagtgaatgataagtcagtaaaacttttttctctcttcccaccagtatctctctttcctcaattagataaatagcaaataatctagtaactcccagtttcctgcacctcagcagtccaatttccttagactttactgcttataagattttcaaatgtactttgtgtaacaccctaaataaaagactccgcctaaaaagaaaattccttcacaagatgactcctcacagaaggaccaaaaaaataacagtttttagctttaatgtagctaggagaagggtgtacagtatcagtgatgattccatttgtttatatgacataaatagaacactaacttttaggtacctccaacaaaggacatacataagtttgactcagcagcagatgacaagaaaatacgtggggagtcatttcagtctgagagaactgcttaattctctggatgagatggtttcccttagccttcagagttcaaaagatatctgtttaatatccactattttttttttttttttttgagacggagtcttgctctgtcgccgaggctggagtgcagtggcgtgatctcggctcactgcaagctccgcctcccaggttcaagcgattctcctgcctcagcctcccgagtagctgggactacaggcgcccgcctaattttttgtatttttagtagagacggggtttcaccttgtcagccaggatggtctcgatctcctgacctcgtgatctgcccgcctcggcctcccaaagtgctgggattacaggcatgagccaccgcacccggctaatatccactattgaatgtaaccaataaaatgtcttcagtgtagaagacaaatgtgaactatcattttaatgtgtgattatagttagcaaataattgtgctgtgttatatcacaggattactgatgaacctgaaagcttttttagagaaacatttaaaagaaatttatgttgactgccacgggaaagatgaccaagccattattattattattattattaacctaaagcaacctatgacagaaacatcacccaaacagtattatttgagacaaaatacaaaaactggatttccccctcttcctatctccttcctatgtccctgttttctatcaggggtatcactgttcaatacagagagggtctcccagggcgcagccggcacagagctgccgtggcccaggttctgaagcctttttttttttttttttttttttttttttgagacaaagtctcactctgtcgcccaggctggagtgcagtggcgcaatctcagctcactacaacctccgcctcccaggttcaagcgattctcctgcttcagcctcctgagtagctgggattacaggaatgcaccaccacgcccagctaatttttgtggttttggtagagacggggtttcaccatgttggtcaggctggtctcgagcacttgatcttgtgatccgcccacctcagcctcccaaagtgctgggattacaggcgtgagccaccgcacccggctccaggttccaaagcctttttttttttttttttaagacacagtctcgctctgtcgcccaggctggagtgcagtggcacgatctcagctcactgcaacctccacctcccaggttcaagcaattctcctgtctcagcctcctgagtagctgggactacaggtgcccaccagcacttctggctaatttttgtatttttagtagagacagggtttcaccatattggtcaggctggtcttgaactcctgacctcaggtgatccgcccgcctcggcctcccaaagtgctgggattacaggcgtgagccatcgcgcccggccatcatgaagcttttaagagaatagcaacgccgctcccttcctgcgggtgaaaggcctgttacagaaacacctcaaaacgctctgccgtcactcatcagagatttcagagtagaaaactagagatggacgtagtctatcccacttcattatagctcatttatcctcttggatgcgattcttaatatatgaacttcacagagaaaagacactgcagaaaataaaacccttgtaagagctgcgaccttgtttcttcgtttctgtcatcatctggacttctctcccatgtattaataagacaagtacctgatagttattagaaactgatatacaacttttagaaattaaaacagttatgtttaacaatgtatgatagctacgttgtgtttcgtgtttgagttgtatcttttctatattaatattttgaaaattgaaaactcagcagggcatagctagctcatttttcttaaaagtaagcaagcaaatcagcttgaattagagacaaatcagtatcattagagacaggagatagatagctttcccctctttccttctcatgcctgtgtccctgtttttcaccagggctgtgactttttaatacggagtaggtcttccaggtaatcagacagtaacacattgaacattagagcctaaggtcatcgtatgggtctgtctgtggctactttccctcatttattcatttatgggatgtgtgtgtgtgtgttgcttttttctttttctgagacaggatctcactctgtcacccaagctagagtgcactggtgcgatcttggcccactgcaacctccacttcccaggctcaagcaatcctcccaccaagtaactgggaccacaggtgcacaccagcacacccagccactgtctaatgtttttgtagagatgatgtctcactgctattccccaggctggagggatgtgttgatcatataaaaacatgacaggacattatttctcatgtccattttaaaccttttttaaatgttaattttcacgtgtcctgcttttctctttgcaggtccatcggctggtggtggtaaatgaagcagatagtattgtgggtattatttccctgtcggacattctgcaagccctgatcctcacaccagcaggtaaaatgctggtttctgacctttgccatcggcgtctaggaagggtgggaggtagaacaggaagtgcagcatttaaaccatcatttctccacccacctacagatcaaggctttgagtatattactttgaaaccattttcgttttctcttcagttgggaagtttaagtgttctgcgtgagtgaggaaagtgtatagaacgtattcgaagttaagagcatcctatcaaggtccagtggccccctaaatgacttgggagccattgccatgttcatcataaccttttccactgaaaagacctcttcaattgtgctttgtgagagaactagtgaccagaaacatagagggaacgtcactggcttctatttgataccttcatctttccttaaagagaaaaaaaacttatattttgagtagataaaacagaatacctaaacacaaacttttattcattaatattgtacagaaatcacattcactttcagatagagtgtggttaaactcattttttgacagattcactttgagcaagccttcagagtctcagacagtgaggagcagagagaacgggagagggctttagacaagaggagctggccttcctctcatttcacacactcagtagtaagaggtgggcttgagagttcttaaaactgccagccctcccttccctcctcctcttcccatccctccacctccccagccccagtcaaatatgaacaacccagcctttgtcagggccacatggacccgatgtgggagcaaacagcatgccctttgaactctcagaatccaatattaaacggtgtgtgtgctacagtattgatttctctttagttcagaaatttcagttaagactagtttttacaattaagtctgtaacccaaaaatacctaccctaaaggaatcttcaccacctgcaagaaacatgtcttattcgctaaatgagaacaccaagagaaattccagtacagcagtgatttttccgaggtggtcctcaggccaggcatcatcaccaccacctggaatttactagaaaatgaaatgttcatgttggggccccgtcccatatccactgaatcagaaactctagaaatggggcctggtgcagtcacttgcaaacttcaagtgtttaaaagacctgaatctcacaatagtctctataatcatgaaacattaagaactaaacgaatgttaatgccataaaactgggaataatccaaatatctttgaaaagaagaatggataaattgtgtcacattcattcgatggaatacgatacaggattgaaaacgaacagtacagctgcattcaacagtggaggaatctcacaggcaacattgaacagagggagccaggctcatccagaccatcattaaattcatataaatttccaggcaggcataactgcacagcacatttgtgctaactagaaaaggcctcttctctgggcagatttatccccacaggtatatagcttggcaccttcagaaaaagatgccccgtttccagccctggaccacgggacacagtctgcccagcgggtcaggctgaatgtcagctcttgtctgtctctttgggcattacaaaaagagtaaacaagtcaagcgattcatcctctctgtttcttgatatctcaaaccataagaatgaacggttgtgctggatgagttcaaatttccatccagatttggtatttcaaaaattctaagtcattgcaatgcccctcccatcactgctggtgcagagaggaatctatttccagctggaatttggaatgtatgttaccatagaaattgtgccgtgaagatgggggtagctgggttggaattccttatgatacagtgtatacaacacgatttgttgaggaaaacattccgtgttactaataactggattacaagtgaacttttggagtggaactcagggagcgcctgcatctgatcaacaatcgcaagtgaggaggcccccaccgtgaggccaagtcccagctgtcccacccgagcgctgtctgaatgtaagcaagtcgcttcacctccttcagccccaatttcttcagtagagaaggagccggctgatacaggcccgtctccctcctatgttgctatgaaaagagctgaaagccgtgcacaaaagccatgtgtgtgcaatgaggcgcagtgcccgggacctgcactgttaggtggttgtccatggaatagtcagtaagaggcagtttgatgaagtgtctgctgttactcgattagaaggtactagtggtgattcttttcatcgggcaatggccaccgttccccagaggggtactggttcaacacaataacactttctctttctcaaaaaagtttttagcaacagttcattgtcaaacttagactgtccaaatgaacccatgtgtgcgtgcatccagtgtgtgggcagtctgatgccaggagctacggtgtttcagccacacgctctaatagattgccgatctctttcaggggtctagcgtctggtgaaaaattaggagagaagctcctgtgatgagaaaaatagtagctctccctgccaatccactgtggaatgtcctagccagatacttgttaggtgcaattatccttcagaatatttataaaggttttttttttgtttttttgttttttttttttttatttgagacggagtttcactcttgtcaaccaggctggagtgcaatggcatgatctctcggctcactgcaacctccacctcccggattcaagcgattctcctgcctcagtctcccaagtagctgggattacaggcgcccgccactacgcccagctaatttttgtatttttagtagagacagggtttcaccatgttggccaggctggtcttgaactcctgatctcaggtgatccgcccgcctcggcctcccaaagtgctgggattacagatgtgagccaccgcgcccggcctaaacctttttttaatacatatttgtaagagtgcacaactgaaatacttcacaccttcactaaaacatacctacatatttcttagtaaaattttttaagagtggaattctttttttttgttttccaagttaaatctgacatatttagaatgacaagatgttacgtggatccaagctgcccgaacgattgggtgggagatgggagcttgggccacctgctccttcccacatcgccctcctccgaagcctctggatcatcctcctaaggcactgccagacacaggtagaaacccctggggtagagaaccctgctgttaccatgagctttgaaactttcatcttccatccactgacaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgttttttttttgttttgggtttttttttttcagattgaaaaattaaaatagatcctactatct

SEQ ID NO: 38341 - DNA, 111298 bp, Homo sapiens
cacgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggtattggtagtgtttctcctctgttctctctcctgcaaggccctttcagtccttgtcactgcccttgagaactcccaggtcacatgaaggcaaagaaagtaaaactgaaactgcctttgagccacaggcttgctggggatgaggtgacaaagctaatcgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggtgactttgcgggggtctcttctctaggattatctgtacttcccctctgtcctcttttactacgggagatcgagctagctataacccaccttctttcatgagaaccacactaaattgcaaaaattatcccagtgctggaggagggcagcaggttgagattatgttggcaggaagaatgttggcattgattggcacgcaggggacgagagctgctttgtgctttaaaggtaactgagtatgagctaaaaagaaggaaaggagaggccgagagtaggaagaagaaagaaagctgacttggctggaggggtggagtgaagctgaggaagcaggaaggggaaggaggtgatgggtgggaagggcagggcagggtggagttaactgaaagaaggctaaactgtggcttgtacataattatgaggaagcacctttttttccccccttcattttgagacggagtcttgctgtgtcgcccaggctggagtgcagtggtgtgatctcagctcactgcaacctccatctcctgggttcaggctattctcctgcctcagcctcccaagtagcagggactacaggcacatgccaccaggtctggctaatttttgtagttttagcagagacagggttttgccatgttagccaggctgagctcaagccatccatccggcctggcctcccaaagtgctgggattataggcgtgagccaccacacctagccaggaagcatcttaaaagagtcagatgtcacttccagctgagggctagatccccggaggccaactggtggcccctgacatgttttatttgtaagagtgaggactcttggaaatttggaaaatttcacgcgttgtgaaagaatgggctcacgtttccgcagctcggctggcgctgtagctgctggtttgccaaagtccccacctctcctgcactgagctttgcattccttgacccaccccaaaacttctgtacctgcctggttcctgtgggcaatgcagattgctgctccttctggtttgataataatgattctcgtccaagtgcacaggtatatgctctttcaattaatttcaattaatatctccctttttcagtggagcatggcagatacacaaaaccaaccctctccttgacagatttctcagcctttccaggcgatctgccaagttgctagagggtatttgcattaaaaaaaaaagtttattttcttattttgggtttaaggattttccaacctgccttaaggcaatatttcatttatgccacactttacagctttcaaagcatttcttaaacagacttgaatttgttttatccttccagaagctccatgaagtctgtaatttggatctcctcatgctgtcttggaggaaacagaattgtagagaaactaaatgactgcccttggtccttcagtaatgttgaggttcacattcaggcacagctctctggaagaccaagctgtgtctttttgactgtgtgaaattgtaaaaagttatgctttgaaaagcatagtgactgaaagtatgatctcaatccagaatacttgtgttaccagaaaggggcctcaaaccagaccccgagagtgttcttggaccttgtgcaagaagcaactgggggcaagttcatagcaaagtggaagtgaaagcaagtttattaagaaagtaaaggaataggccgggcgtggtggctcatgcctgaaatcccagcactttgggaggccaaggcagacagatcacaaggttaggagatcaagaccatcctggccaacatagtgaaaccccatctctattaaaaatacaaaaattagctgggtgtggtggtatgcacctgtaatcccagctatttgggaggctgaggcaggagaattgcttgaacccaggaggcagaggttgcagtgagccgaaatcgccccactgcactccagcctggcgacagagtgagagtctgtctcaaaaaaaaaaaaagaacggctactccataggtagagcagtggcatgggctgctcgactgagtatacttaacggttatttattgattatgtgctaaacaagggatggattattcatgagtgttccaggaaacgggtgggcaattcctggaactgagggtttctctcctctttacacaaaataaggtaatttccagacattgtcatggcatttgtaaactgtcatggtgctggtgggagtgtcttttgcatgctaatgcattatggttagtgtataataagcagtgaggacgaccagaggtcactttcattgctatcttggttttggctggtttctttaccacaaagtgttttatcagcagggtctttgtgacctgtatcttgtgcctacctcctatctcatcctgtgactaggaatgcctaagttcctgggaatgcagcccagtaagtctcagccttattttacccagcccctgttcgagatggagtggctctggtttgaaagcctctgacacttgggcttgactgctggtttggccactcaatacctatgagtctttaggcaaagtactgaatcatcctgtgcttccttttctgtaaaatagggataacagccctcatctagggagtgttgtatggattaaatgacatagtacatgaaaagtgtttagaacaatgcctggcacagagtaagcttttgttcacatacacacacacacacatacacacacacacacacacacacacgccaaactgtaaaatatttgaagagacttattctgaggcaaacatgaggaccctggaggtcctgagaacatgtgcctgacatggttgggatacagcttggttttatgcagtttaggaagacatagacatcaatcaatacatgtgaagtacacattggtttgattgattcagtccagaattgaggtattcaggtcataggtagattcaaagatttcccaattggtaattagttaaatgagttaagctttgcctaaagttgaagttagcaggaagaaatgcttggattcaagataaaaggggttgtggaagccaagggccaaggttcttgttatgtagatgaagcttccaggtagcagacttcagagagaatggatggtaaattctccccgccccccccccccctttttttttttagacggagtctcactctgttgtccaggctagagtacagtgggatgatcttggctcactgcaccctccacctcctgggttcaagcgattcacctccttcagcctcccaagtagctgggattacaggcaccaccacccccaccacgcctggctaatttttgtatttttagatttttagtagagccagggtttcaccatgttggccacattggtcttgaactcctgacctccaagtgatccacctgcctcggcctcctgaagtgctggggttacaggtgaatctctcttatcaggccttaaaaggtgccagactcttcataactctcttcaaggtgggaggacttggaaggggaaagagctagttaatagatttacagatacaaaaagcagtttcaaaatatggtgaagaaacatatttgggggtaagatattttgatttccttctttatctgtcatttgatagagtcaggttggaatttggtatcttatggctacaaagagtctcttttatctgtcttaagatctctgttttaatgttaatgctggtcagttgtatctaaactcccaagtggtgggggataatgaggcatgttcagccattcacctcccatcatggcctggactagtatttcaggtttctttggaatgcccttggctgaaagggggtccattcaattggttgaagggcttagaattttacttttggtttatactttcaagaaatattcctatcagtggggccaggcacggtggctcatgcctgtaatcccagcactttgtgaggccaaggaaggaggattgcttgaacttgggagttcgaaaccagcctgggcaacatagtgagaccctaaaaagtctacctaaaaagttaaaaaaaatttttttaaattatactactactactaaaattattattatctgtgcctttgggagatactctgtattagttagggtacaggctaaattgtaaaaaagatcccaaaatacatttgctcaaaaagggtagaagatttttcctctttcacataatagctaagaggtaaatggtcagtccaggacaggcaaacaactctgctccacagggtcattcaggaacccagcttcctccatcttgttgctcccttttctgcatagtcaaaagtgactcaacatcaccttcaccttctgttcctgcctgtagtgcgaagaggggaggaattagagggcaaacagctcccttctaaatgatatacctcagagttgtacatatcctttcactcatattccctgacccactctgtttccctgaccaaatttcccaggcttttctaccttgatctgaccttgtctttctggacctttggtaccactgtgctcccatacctgaagactctttctcactgcagtgctactctttctaagttcccaccctactttgctagacattttttttccatttccttcaaagagacctcctgttccactcactccctaaatatcctctgggtctctgtgttccacccacagcccttcctgccttttgccctctccctcggtgtgatggcttaatgttgagtgtcaactggattggattgaaggatgtaaagtcttgttcctgtgagggtgttgccaaaaggagattaacatttgagtcagtgaactgggagaggcagacccgccctcagtctgggtgggcaccatataatcagctgccagctcatctaggacaaaagcaggcagaggaacatggaaggactagactggctgagtctttcagtcttcatctttctcccgtgctggatgcttcctgccctcaaacatctgactccaagttcttcagctttggactcttggacttacaccagtggtttgccaggggctctcagggctttggcctgagactgaaggctgcattgttggcttccctacttttgaggttttgggacttggattggcttccctgctcctcggcttgcagacagcctattgtgggacttaaccttgtgatggtgtgagtcaatactccttaataaactcctcgtcatgttagtcctgtcccatctagagaaccctgactaatacacttagtgtcctcagccacgcaaaagctgatgactcgcagctctccctcctccgggcaggtgtccttcctgacttctggtgctgaatgtccaccctgtcatggacctctgcctggggctgtctcacaggctcctcctacttagcattctaaaaccaaattcctcatcagtctcttcttgtatttattttcatgaatggcacagttagctagttgcccatcccaggaaaaagaaatctgataattattattattattgttttttgagatggagtttcactcttgtcacccaggctgcagtgcaatcacgctatctcagctcactgcaacctgcagcctctacctcctgggtccaagccattctcctgcctcagcctcctgagtagcagggattacaggcacccaccaccgcgcctggctaatttttgtatttttagtagagacagcatttcaccatgttggccaggctggtcttgaactctgtcctcaggtgagccacctgcctcagcctcccaaagtgctgggattacaggcatgagccaccccacctggccctgataattatttgtgattcctttctttcgttgcaccttttgcatacattcaatcaggtatcaggttctggcaagtctacctcttccagttcctcaaatcagcccttcctctcattctctcactttggggaaagcctggattgcttctcaaatacttacgacagagggtctctgagggatgttcttcttcacattcatcctccaccaagtgctgcctgttcaggggatcctcctacccttagtgctcctggggctcttagatgaagctcatactccttcaggttatgcacatgctccctcccaagcatctctttgtctatcttcccagcccctctccctctttaccccaggtgtgccaaccactcacactgtcacctacagagacttcttcagcctttctcctagtgctgatttccagctgtctgtcaaagctcatgcaatgtctcccaggccatacctgcctgacactgtcaacacagttttccttgcctcttcctcattagcagctccagtgcttaagcacatttcccgacacacagaaagtgctctgtaaatggcaaaagagtgaactgtatggctctttccatgtcctactccacctccaatcatgctacctgctctgtacctaagcttctgagaagaccctcctctcctgtggggatgtctgtaactctttcttcaagaaataatatttttggctgggcgcagtggctcacgcctgtaatctcagcacgttgggaggccgaggtgggtggatcacctgaaatcaggagttcgagaccagcctggccaacatggtgaaaccctatctctactaaaaatacaaaaattagccagatgtggtggcgatcgcgccactgcactccagcctgggtgacagagtgagactccatctcaaaaataataataataataataataataataataataataataataatttcaagaacaaactcaactaatgtcttcagtgaaggcttctcctacttccccagccagattttcattatttatctatcatcaagtatttttaaaatgcctatagtgtgccaggcactgttcagtatactggggatagagcagggggaaaaaaatgacaaaaacccctacccttaagaggttcacagtatagcatggggaattagaagtaagcatctgtctcttctctggtctttaagcacctcacaggcactggccatgtctgctcatctgtttattcccatcatctaacagagtgctcaacacatttgcttgatgaatacgttttgagcactgggagatgatcacagaagagctaagaagtgatagcagttgtatttagtggagaacagtattcacaccttgttgtctagattgccttgaaatcaggctctgtatgatatcttttttttttctcttagaaaaaactgttaacctatttagagtaattttattaaggagctttttatttttttatttttttttttgagacagggtcccaccctgttccccaggctggagtgcagtggttcaacaaccacagctcacttcagccttgacctcccgggctcccacctcagtctcctgagtagctgggaacacaggtacgtgccaccctgcccagctaattttttattttttgtagagatggggttccactgtgttgcacaggctggtctcaaacttctgggctcagtcaatcctcccgccttggcctcccaaagtgttaggattacaggcgtgagccattgtacctttaaaagaaaaaaagaaagattttttttattttaaattaaaaattatgacattgcatatcactgtgagtgtatttaatgttactgaattgtacactttaaaatgattaagatggtcaatgttatgtgtattttaactataataaaagaaaaaagttttttttttttttttttgagatagagtctcactctgtcgcccagactggagtgaagtggctcgatctcggcttactgcaacctccacctcccgggttcaagtgattctcctgcctcagcctcctgagtaggagtagctgggactgtaggcgcctgccaccatgtctggctaatttttgtatttttagtagagacaaagtttcactatattggccaggctggtctcaaactcctgaccttgtgatccacctgcctcagcctcccaaagtgctgggattacaggcgtgagccacggtgcttggctagttctttcttttcttaaggctgcatttcattcagcaaagaggcactcactatgtagccggcactactctgggtttgtgggccataaagacagataagacacagtccctgtctttcgaggacttaggcttagcaggagacaggcacctgagccacagagacaatcaagagttgctcgctgtgctcagggagaactctgttcggcccacaccaccttagttactagtgacggccaccagacttgaagtatcatgagtacctggatcatcacagaggagtcaatccatttttataggtctaacttgggtgtttccaaaaatgtcaagtaacgaacacacaacagaacatttataagagcaggattccaaggtatcagttagacagtaaacggaggggcccagccaagcatattcccatgctgcaaagccacttgatattagcgcacatcttgaagcaataaacgctgccctggcaggccctggcaaatggcacttgtgaatatttagaaacggagcagccctgtttgggaaaactgtcatactgacgcgctaggttgggagagatgaggtggagacagttaaaaaaaaaaagaatgaactgtatgcttccagaaacgttaaactctcactcatggagcctagtgcatcaagtttaggtccattgtaacagcactttaggttgtttctgattatttttttcaagacagggtctcactttgtccctcaggctagagtgcagtggcacagtcatggctcactgcaacctcaaccccctgggtgtagatgatcctctgacctcagcttcccaggtagctgagactacaggtgtgcaccgccacagccagctgattttttgtagagacagggtttcgccatgttgctaggctagtcttgaacttctgggctcaaacagttcgcctgccttggcctgccaaagtgctgggattacacgcatgagccactgcatccagcctgtttttttcaatgttttaacagcgcatcttttggctttaataatcagacttttttttttttttttttgagatggagtctcactctgtcacccaggctggagtgcagtggtgcaatcttggcttactgcaacctctgcctcccgggttcaagcgattttcctacctcaacttcctgagtagctgggactacagtcgcacgccatcatgcccggctaatttttgtatttttagtagtgacggggtttcaccatgttggctgggatggtctcgatctcctgacctcgtgatccacccacctcggcctcccaaagtgctgggattacaggcgtgagccaccacaccctgccaatagtcagacttttaaaagcagcagacccagctaactgggagtgaagcagctgctcctcactaatttgctgtcaaggagctgagcagatggaagcaccatcctccctcctcctgatgcctcctcttctctctggggtttccacatttattgtattactgcatttggtctatggggttgacagttcagcaggacttcaggctggaggtaggaaacaggtccactgtgggcatagctgcttgttaattcatggcagattaggctttctgtgaatggcatggcttttttcaaccacgagttctctgaggcctgaagaaagtgctggtggaaggccgtgttgcccgggccaaggaaagtgtcctgttacacaggggttggttgtaactcactctgattctgtggttaatcagaaacaaatcagcctgtttcatagaagcctttgttgtttgttctgatgagatttttacctgctgtacttgagacatcagtaaaaagtgaagtagaggttcctcttcagagactttccttcccatctaattaggaataaatagtaacttctcttagaagcaaaatttattcaaagacctgtgctaacattcttaaatatctgctatccataataaagaaatcaatgtactttaatgttcttagctcccacaatttagcctgaatatttgccctggcatgcttatactggtccaagcaagtattaggtcatagcctgttcctcttccttatttgaaggtgtttttacctttctcaacattgcacaagttacttcctccttcctttgttctcctctgcctttgcctcttttaaaaggttctaagttgccagccaattgggacaaatacaggatctgaggtcccattccagccaatggaaactggacacagcagtagggtggacgagtcaggttataaatgaccctgtctcctttgttctatatactcatggggcacaactactggcgagtgtaccctttctgcagaaagtgtaaaaatggccttgctgaggaaattaaatttatgttcaagtactatttctttacggcaccggggaacaagcatttcaaacacgtacttgctgcagactctgccctctggaatggctgcgatcctgtctcaaatggatttgagcagaaaaggggaagtgactggcagaaaagcccagagatagatctgtgtttaggtaaggttgtttgtccagagatagaactgtgtttagatagggttgcttgtagggccagggatgacagcgtcaagccctgcctctttttactcttggctctctgctttcttctctgttggcttccttctcgagccagctctctctgtggggtgacaaatgaccactggcagcctatgctcacattgtccctgtgtctagcagtttcagaggtaagaaatacttctttcccgacagctatacaaatacaaaggttaaggttgggcacagtggctcactcctgtaatcccaacactttgggagaccaaggcaggcggatcacctgaggtcaggagttcaagatcagcctggccaaaatggtgaaatcctgtctctactaaaaatacaaaaattagccgagcctgggctactcaggaggctgagtcaggagaattgcttgaaccgaggagatagaggctgcagtgagccgagatcttgccactgtactctagcctgggtgacagagcaggacacagtctctaaaaaacaaaacaaaacaaaacaaattcaaaggataactctggttggctagctggggtcatgtgaccatcctcaacccaagcattgtgctaaggaggatgggctattttgattgtcacctaggtctgagatagtgactgacagccccactgggtactgggggacacttttccaatttgctgggcacgtaatggtttcttagggctgccacaacaaatcccaacttacttggtggctaaaagcaacagaaatctcttatctcacagctctggggggtaggagttctacgtcaatgtattagggggactatattccctctgatgcctctagggaatgatccttccttgcctcttgcagcttctgtggccccaggaaatccttggagttccttggactgtagctgcgtcactccaatctctgcctccatcttcacaggatggccccttctgtgtttctcctgtcatgtctgtgccttcttataattacatgtgttggggtgtgctcagagcagggggcccgaagaatgcctcctctgtttacaacacacccaataggaatctggggtcattgtgacaagggacacagagcttgtgacctccctacaaacaaatgccctacacattgaaaaaacaaaaaacgtgtcagaccaggtgcggtggctcaggcctgttatctcagcactttgggaggccaaggtgggagaactgcttgagcccaggagtttgagacaagcctgggcaatatagcaagaccccatctccaccacacacaaaaaaatatgttactggttttagggtccactcaattaatccataataatctcatctcaagatctttcacttaattgcatctacaaagacccgttttccaaataaagtcatattcacaggtatggggtgagggttgggacttggatttatctctttgggggccacattccaccccctgtagggcagaaataaatagccactgcactccaccccttgactgcctggcatccatccatggccttttccacataaacaattccagaaatgcaacaccccagtgtggtacaggctgcccacatccaagcaaagctggccgatgtacattcttctcagtcaggccttgatgatactctttttttttttttttttttttgagatagaatttccctctgtcacccaggctgaagtgcagtggcacaagtatggctcactacagcctcaacctcccaatctcaagccatcctcccacctcagcctcccaagtagctagaaccacaggcatgtgccaccatgcctgggtattttttaaatattttgtagagacaggatcttgctgtgttgcccaggctggtcttgaactcctggcctcaagcagtcctgcctcacccttccaaagtgctgggattacaggcgtaagccaccatgccaggaccttagtccattttctgataactctgtgagctgccaactggagctagaaactcaagtcaagtcatgctgtagaatctggaccttgtcctcgctgcacctgccccctctacaccccgttctccctgagtcttccttcagactgcagccttctggcctctgccccaacacactgggcctgggccagagggatgaggccgggctgtctggcccttgccttcaggctgtttgcggtttggccaggcagggaacgccgggcagaagtggctggcagggagccaggggaaactgcttcttccggtttctgtcccctctcacactgtgtcgtccttctcccagcctttacctgtgctcctagcctggggcagggaatctgacttttgcaatcctgaaatatgattttctggttctcagctcagctgaattacttgccccaggcagaaagagaaactcatggctttcttttctccttccctgctttcagaaaggtcaactgggactaaagtgcatctttttctcaccgagcttactgaaggctgaagaaggggcagcacaccccaggcacctggctttttttttttttttttaacaagtcctaccaatttccagcctcattgagcatgtggtctgactcactgggctcaacaggagaggctttggctaccttgcaccacttgagaggtgttgctcaccccgagtcaggaagggagaccccaccttacacccacctcaacacagcaaattccagatattagggtctgtcatttgcaaaaccctgctcctggtacagaattctgagttacttaggacacttgattgcaattgatgttaagaaagatccaggccggtacggtggctcacacctataatcccagcactttgggaggctgaggcaggtggactgcttgagccgaggagttcaagaccagcctgggcaacatggagaaaccccatctctacaaaaaaaaaaaaaaaaaacccacaagaatattagccgggcatgggggtggtggcatgtgcctgtagtcttagctattggagaggctgaagtgggaggatcacttgagcgcaggcatggaggtcacaatgagccatgatcacaccactgcactcccacctgtgtgacagagcgagactctgtctcaaaccaaaaaaataaaataaaacaaaaaataaaagaaagatccagaaaggggattgtattagcctatataactgggaagcaggaaaggctggatccagatacctaaatgacaggataaggactttgtttctcaccccccctttgtcccctgttactctccagcccttctctctgcttgtctttctactggttttaatgggatttcaggctgattttcatggagctctaggctcacagtgcatttatgtctagcaatcctcttagattctgagttgttccaacagaagacacaggaagggctctgaatggactcgcttgggacctctgctcaccccctgtattaaataaccaccgaggccagatgagtggaaataccctggttagttggcctgagtcacatggcactattgatgggacaggtaaggccccatgattggcagcccttctgggttgggggaaagacagtttctgaaagaaaaaaaatgctagggagacaaaatcaaatgttaaggggctgggctctcagcacattcttggtttgcattctccagtgggtcagaagcctgacaatccgcctagcctctgctttgagcgtcaggggacccagttctattcctgcatccttagccatcatctacacactttttatcttttcttttaaatttttaaaaattgtgaaatctatatacatataagccatatgttcaacttaaagaatagtaaacaactgtgtccctaggatccaagttaagaaatagatcagagtcagtttcttagaagcttctatatgtgcttctccccagtcatgtgctctcctgtctctacctgagggaaattacagatttcatgcttttctttatagttttcctttacacacatacccttaagcctctaagtactatatggttcggttttgcaaagcccagaagcctattttaatgctgtatataagaatatgctagccgggtatggtgactcatacctgtaatcccagcactttcagaggctgtggcaggagggttgctgaagcctaggaattcaagaccagcctgggcaatatagggagaccccttcactacaaaattaaaaattaaaaaaaaaaaaagaatgtactatattgctgtgacttttattcaacatgatgttttttgttttttgttttttttttctgagacggagtttcactcttgttgcccaggctggagtgcaatggcgcaatctcggctcaccacaacctctgccttccgggttcaagcgattctcctgcctcagcctccctagtagctgggattacagacatgtgccaccacgcctggctaattttgtatttttagtagagatgggagtttctccatattggtcaggctagtcttgaactcccgacctcaggtgatccacccgccttggcctcccaaagtgctgggattacaggcatgagctaccgtgcccagcctcaacatgatgtttttgagcttcgtttgtgttgatgcaggtagctgtagtttatttttcaccactgcatagtgttacattgtatgattttcccacattgcatgtactgtttagagtgtataactaagaatggattgctaggtttaaaggtgcttccactctatgggataatgctaatttttttccctaaagtggtttataacaatcaacccttgcactacaagtcagtaatggtgtttcagttgacttcattcttgtcgattttaatttttgtcaaccccacaagtgtggcctgtgtctcattatagttataatttgcatgtatttaattactcttgaagtgaagaatcttttcttttctttttttttttttttagacagagtcttgctctgtcaggaggctggagtgcagtggcatgatctcagcaaccagcaacctgcaacctccgcctcctgggttcaagccattctcctgcctcagcctcccgagtagctgggactacaggcacaagccgccatgcccagctaatttttgtatttttagtagagacagggtttcaccatatgggccaggatggtctcgatctcttgaccttgtgatccgccctccttggcctcccaaattgctgggattacaggtgtgagccaccacacctggccaagaatcttttcttatttatttatttttatttgagacaaggtcttattctgtcacccaggctggagtgcagtcgtgcagtcacagctcacacagcctcaacctcctaggctcaagcgatcttaccacctcagcctcccaagtagttgggaccacagatgtgcaccaccacacccagctaacagtgcataatcttttcatagttataaaccaactgttttttctgtactgtaaatgcctgtttatatctttctccccatttttttaatgaaggggtggtctttttcttattgattaatgagagttctttatatattctggatggtaattattccatatcagttttatgtttttttctttttgtgacagggtctcgctttgttgctcaggctggagtgcaggggcaagaacatgacttactgcagcctcaacctccccggctcaagcaagcctcctgcctctcaccctcccaagtagctgggattacagccacgtactaccacgcccggctaagtttggtatttttagtagagacgaggttttaccatgttggccaggctggtctggaactcctggcctcaagtgatcttcctgtcttggccttccaaaatgctaggattatagacacggaatatcatgcctcagtgttatatgcttgtatatctacttgcagtttgggaatgcttttgcattttatttatggtgacttttggacagaagttcttaattttgatgtcaaatttatcttctctaggaaacctttcccaacttgagatattctcttttttttttgtctttttatgggcaattttattccatttacattcattgtcattactgatatagttggttataagcctaacgtcttttttttttcttatacttcaagttgtagggtacatgtgcacaacgtgcaggtttgttacatatgtatacatgtgccatgttggtgtgctgcacccattaactcgtcatttgcattaggtatatctcctatgctatccctcccctcttcccccaccccaccacaggccccggtgtgtgatgttccccttcctgtgtccaccaacttgagatattctttcctgttataaaagtttctaatttcatccttcatatttcgtacttcatatttaagtatttgatctacctggatttgatttttgttactgataattagcttccagttttacttttatttatttattttcagacggagtttcgctcttgttgcccaggctggagtgcaatggcacaatctcagctcactgcaacctctgcctgggttcaagtaattctcttgcatcagcctcccaagtagctgggattacaagagtgtgccaccacacccagctaattttgtatttttagtagagacagggtttctccatgttcgtcaggctgatcttaaactcctgacctcaggtgatctgcccaccttggcctcccaaagtgttgggatttcaggcgtgcgccactgtacctggccccaattttacttttgtacccacttgtctgcaattactctgtgtcagaaatcaagtttccagacatggctatgggttttattttgtcttgttttccctgagctctcaaatttcctgtgttgaacttcatttttttccaaaattcattgtagaccaatatttttgtaagtacaataaatattaattactatgggcagggtgtggtacctcactcctataattccagcacattggaaagtaaaggtgggaggatcacttgagcctaggagttcaagaccaggcagggcaacatagtgagatcccatctctaccaaaaaataaaacaattagcttagcatggtggtgcatgcctgtagtccaagatacttgggagacccataactttttctttttttttttttttcttgagacacagtcttgctctgtcacccaggctggagtgcagtggcacgatcttggctcaccgcaacctccacctcctgagttcaaacgattctcctgcctcagcctctcaagtagctgggattacaggcgcccgccactgcgcccggctaatttttgtgttttagtagaaatggggttttgccatgttgtccagggtggtctcgaactcctgacctcaggtaatctgccagcctcggcctcccaaagtgctgggattacaggcgtgagccactgcgcccagccagaactttttcatcttcccaaactgcaactcctcagtcatccctcccttcccccagcccctggcaactaccattttactttccatctttatgaatttgaccattccaggtccctcatatcagtggaatcatataatattagtccttttgtgtctagtttcttttacttataatgtctttcatgtctccaaggtacacccatgttatggcatatatcagaatttcattcttttttggctgggcgcggtagctcacgcctgtaatcccagcactttggaaggctgaggtgggcggatcactggaggtcaggagtttgagaccagcctggccaacatggtgaaacccctgtctctactaaaaatacaaaaattagccgggcgtggtagcaggcgtctgtaatctcagctacttggggggctgaggcaggagaattgcttgaacccgggaggtggaggttgcagtgagccgagatcttgccactgcactccagcctgggtgacaacagcaagactccgtctcaacaacaacaacaacaacaacaaagaatttcattctttttaaaggctgaataatattccattgtctgtatataccaaatttgtttatctattcatccatcagtggacattggcttccaccttttggctattgtggataatactgctatgaatattggtatacaaatatctgttcgaatctctgcttcccattcttttgggtatataccagaagtggaattactggattacatggtagttcaatgtttaatttttaaaaattatatatattttttctagagatggggtcttactatgtttcctaggatagtcttatactcctggcctcaagcaattctcccgtctcaatctcccaaagtgctgggattacaggcatgagccaccgcctgtagcccaatgttaattttctgaggaacagccatactgttttcacagagggctacaccattttaccatcacaccagcaatgtacaagggttccagttactccgtgtcctcaccgatacttcttttctaattttgcttttgtctttgataatagccatcctaatgtatgtcaagtggtatctcactgtggttttgatttgcagttctgtaatgaggttgagtatcttttcatgtgctcagtggccatttgtatagcttctttggagaaagggccattcgagtcctttgcccatttaattggactattcatttgttttttgagttgagttgtgggagccctttcactccatcttaattaccatagttttctgtgtcttaatatctggtagaggacaagcccccaaccccaacacacacctgtctgttgctcttgtttaaaagcgatttgttattttttggcccttgacccttccctgtaagttttggaatcagcgtgttcagttcctttttaaaaacctgttaggattttgattggaattgcctagaatatacaatttagggagaacagatatatttacaacattgcgtctttctgtcgtgaacatgctgtctctccatttattagttcttctttaatgtctttaagtaaagttttaccatattttccataaacgatttcacatattttgttagatttattcctgggtaattgatatttattcatgctattatagatggtatcattcaaaattacatttctttttttttttttctgggatagagtctccatctgtcacccaggctggagtgcagtggcaccctctcagctcactgcaaccttggcttcccaggttcaagcgattctcttgcctcagcctcccgagtagctgggactacaggcctgtgccatcacgttcggctaatttttgtatttttagtagagacagggtttcgccatgttgcccaggctgctctcaagctcctgacctcagatgatccacctgccttggccacccaaagtgctgggattacaggcatgagccaccgtgcccggcctcacaattacatttctaactgttactggtgtatagaagtgcagttgacttttacatattgattttatatacagaaaccttcctgaactcacttactaattttaataatttatttgtagataatgttgggttttccacgcaatcataatatctgcacgttttttcttccttcccaagcctttacacatttttttctttttctttttgtgacaggatctcactctgtagcccaggctggagtgcattggtgtgatctctgctcattgcaacctccccctcccaggctcaagcaatcctcccactagcctcccgaagtagctgggactacagccgcacaccaccatgcccagctaattttttaattttttgtagagacagggtttctctatattttctaggctggtcttgagaactcctgagatcaagcaatcctcctgcctcatcctcccaaagtgctgggattacaggcatgagtcactgtgccctgctgccttacacatttttatttgctttcttattcttgttctactacacaggctggtataatatgatggtattgggagttcttaggccttgctcctgatcttcacggggatgctttcaacattcaccattaagtatggtataggcaggccaggcacggtggctcacgcctataatcccagaactttgggaggccaaagcgggcggatcacctgaggtctggagtttgaggccagcctggccaatatggtgaaaccccgtctctactaaaaatacaaaaattagccaggcatggtggcgcatgcctataatcccagctactcgggaggctgaggcaggagaatcacttgaacctgggaggcagaggttgcagcgagccgagatcgagccactgcactctagcctgggcaacaagagtgaaactctgcctcattaaaaaaaaaaaaaaaaaaaaacaagtatggtataggcttttgctgtttttgtttttaaccttgctagatgttctttatcaacttctagttcaaattagttgagtttttattattgacagacattaaatgctactaattttttttctgcatttattgagatagtatctttttgcctttaacatggtaatatgatgaattacatgaatcacttttgtaatagtaaaccaatcttggattcttggggtaattccaacttggctaggatacattagcttttttttttttttttttttttttttgagatagagtctggctctgtcgcccaggctggagtgcagtgctgcaatctcggctcactgcaggctccgcctcccaggttcacgccattctcctgcctcagcctcccgagtagctgggactacaggggcccgccactatgcccggctaatttttgtatttttagtagagacggggtttcatcatgttagccaggttggtctcgatttcctgacctcgtgatccacctgcctcggcctcccaaagtgctgggattacaggcttgagccaccgagcccggccacattagcattttttatactacaggggtaaaagaaaaggtgtgatacctttccttcccatcaaagccaatactcctaaaacaaaagacaagttaacaagagaaaagcataacagattttcttaatgaaagttttatgtgacacgagagcctttagaaattcagacccaggccaggcgctatggctcacacctgtaaccccagcactttgggaggccaaggcaggcagatcacttgaggtcaggagttcaagaccagcctggccaacatggtgaaaaccccttgtctactaaaaatacaaaaattaaccaggcatggtggtaggagcctgtaatcccagccactcgggagtctgaggcaggagaattgcttgaatctgggaggaagcggttgcagtgagctgagacataccactgccctatagcctgggtgacagagcaagactctgtctcaaaaaaaaaggcacggtggctcgcgcctgtaatcccagcactttgggaggctgaggcaggtggattacctgaagtcaggagtttgagaccagcctggccaacatggagaaactccatctctaactaaaaatacaaaattagtcaggcgtggtggtacatgcctgtaatcccagctactggggaggctgaggcaggagaattgcttgaacccgggaggtggaggttgcggtgagccgatattgtgccattacactctagcctgggcaacaaaagcgaaactttgtctcaaaaaaaaaaaatgcagacccccaagcctcagggaaaactctatttttatgcttaggttcgctgaaaaatggccagctgtgtagaaatatggttggacagaagagagtgatctaatgctcatagagtgatgggaggcaaaggcccagcagaacgtgtctgttcaggtttttttttttttttcccgtagagacatggtctccctatgttgtccaggctggtctccaactcctggcctcaaggggtcctcccaccccaggttcccaaattgctaggattacaggcatgagctaccatgcccagccctgttcagattcttcttggtctctctgtgtctcgttcttttacctggagtgtagaatgtgacctcttttggaataagggtcttatggcctactatcagaaaaggtagagaatttcttttcttttttttttttgagacggagtctttctctgttgccaggctggaatgcagaggtgtgatctctgctcactgcaacctccaccttccaggttcaagcgattaccctgcctcagcctcctgagtggctgggactacaggcgtgcgccaccacgcctggctaatttttttttttttttttgtattttagtacagacggggtttcaccatgttggccaggatggtcttgatctcctgacctcatgatccgcccgccttagcctcccaaagtgctgggatcataggcgtgagacaccgtacttggcctgagaatttctctatggctagctcttacacagaaaggcaagggaaggttagagtaatatttctaggttttatggctggctttgagagagagggtttctagtttctatcacctgccttagggaagaggaattctagtttctatggcctgccttgggagagaggggagcaggagagatggagacaggaaaaggtcagtaacatcttgcttctgagccccccaatgtccttcagttcaaactactcagcatgacaaagcaccaaactttgggatatcattttctgagccccaaaaagacactgcgtgattcagtttgctaatactctgtttagagtttttatatctatactcattagttacattgacctgacactttcctctttggtcctgcctttgtcttctggtcctgagggtttttgttgatccagataaatgttctgggcactaaggtagtgtcccctgcctatctagaccatggggtatcagaccattctcacactgctataaagaaatacgcagctgggcgcggtggctcacacctgtaatcccagcactttgggaggtgaaggtgggtggatcacctgaggtcgggagttcgaaaccagcctgaccaacatggagaaaccccatctctactaaaactacaaaattagccgggtgtggtggctcatgcctgtaatcccagctactcaggaagctgaagcaggagaatcgcttgaacccaggaggcggaggttgcggtgggccaagattgcgccattgcactccagcctgggcaacaagagtgaaattttgtctagaaaaaagaaaaagaaaaaaagaaatattcgagactgggtaacttataaaggaaagaggtctaatccccagttccacatggctggggaggcctcaggaaacttaaattcattgcagaaggcaaaggagatttaagcacctccacaaggtggcaggagagagtgagcaagagggaggggggaaatgtcacaattttaagccatcaaatctcgtgagaattcactcactgtcatgagaacagggaaactacccccatggcccagtcatctcacacatggtcccttcctcatcatgaggatgatgatgattacaatttgagatgagatttggatggggacacagagccagaccatatcagatggggcatgaatctaagttatattggccttcgagaccatgagctcaatcaaaagtcagctcctgagcaggagctcaacaaacttttaggtaaagaaccagatattttaaatattttaggcttccacgacacatgcatctctgtttctattagtcattgttctccagagaaacagaaccaataggagatacagatatagacaaacagatttagtataaagaattggctcacaggattatggaggctgaaaagttccactatctgccatctgcaagctggagataaggactaaattccagtctgagtccaaaggcctgaggaccaggagcactgatggggcaaatcccagtacagggacaggaaaaggcccagctcagtcagccaggcagagagcaaatgctcccttcctcctcctccttgttctcttcgagtcctccgtagactgcatgatgaccactgccattggtaaggatgggatcctccttactcagtctactgattcaaatgctaatttcaccccaaaacaccctcacagatgtacccagaaataaccagaccgggcgtgttggctcatacctgtaatcccagcactttgggaagccaaggcaggtggatcacttgaggtcaggagtttgaaacctgcctggccaacatggtgaaaccccgtctctactaaaaatacaaaaatgagctggatgtggtggcttgtgcctataatcccagctacttgggaggctgaggcagtagaatagcttgaactcgggaggcagaggttgcagtgcgccgagatcgtgccactgcactccagcctgggcaacagagttgaggctttgtctcaaaaaaaatgaagtttaaccaaatgtctgtgcaccctgtgatacaatcaaggtgacacataaaattgaccatcacactgtaaaccaaaaagtacctgagacagttctcaatcaatttagaagtttattttgccaaggttaaggacaagcccaggagatgggtctgtgcctttctccaaagatgattttgaggacttcaggatttaaaaggggagaaagcaggatggagggggaagagggaggctgtggtcacatgactgaatccccatgttgcaagagaaagggagcaggtaggggaatagtaagtcagcactctctgtaagataaggtgaacatagagtaactacctgcagagatctttaaccttttatgtgtagctatctgcttaggaacaaaaggaaagacagattcttgcatgactcagctttcagcttcattttcttccttctggcagagtgaaccagggttcaagtttttgtttttccttcacaatactgttgtttctcctcttccctttcctcctcctccttcttctccttcttcacaactcctaaaaatgtaaaacctattcttagctcacaaaccttacaaaaaagtttgccagtttgatttaaactgtctcccaaaatctatgtctcaatgacatgttgttgtttcctacaatatagtgatgcttgagtgattatctaaagaaaataatttatgggtcgggtgcggtggctcaagcctgtaaccccagcactttgggaggctgaggctggcggatcacctgaagtcaggagttcaagagcagcctggccaacatggtgaaaccccatctctactaaaatacaaacattagccaggcatgatggcacatgcctgtaatcccagctactggagaggctgaggtgggagaatctcttgaacctgggaggcggaggttggagtgagcctagatcacgccattgcactccagcatggatgacagagtgagacccctttccaaaacaaacaaacaagaaaataatttatgaaagtcaagagcctgataaacagtcaccacccattcgtaatctgtgctgccacacctctagccagcagatctgccatcttttgaaatgagtatcaacctggacattcccaagtaaagtgcccacaacacctaggggttgtgattcaaacagcaatggttagactcaggctctctcttgctgccctctcctggctggtctattgttgaggatcagatgtgaatcctgtaggatttcatgagactcaggaaaccttcaggtctgattgctgacctgtagacttgtcaaaatttctaccagtggatagttcttaaggctggtcatgatggccgagtttgtctgttatttcttgtagggtgctccgactttcttgagtgtaagtgttatagaaaaagaatagttatcaggctgggcacagtggctcacacctataatcccagcactttgggaggctgaggcacgtggatcacttgaggccaggagttcaagaccagcctggccaacatggtgaatccctgtctctactaaaaatacaaaaattagctgggtgtggtagttccagctactcaggaggctaaggcaggagaatcggttgaacctgggaggcagaggttgcagtgagctgagattgcaccacttcactccagcctgggtgacaaagcgagacgccatctaaaaaaaaaaaaagaaaaggaaaaaaaggagttatcgtatattgaacatttactatgtgccaaacactgctaaacaaatattattccatttcatccttagaacgatcacatgagatccatatcccttgactgttcagcattaccttcacacaggtgatacaatggatactcagagaggttaatttttttttttttttttgaagcggagtctcactctgtcgccaggctggagtgcaatggcgcaattttggctcactgcaacctccgcctcctgggttcaagtgattatcctgcctcagcctcaccagtagctgggattacaggcatgcaccactgcacccagctaactttgtaattttagtagagatgggctttcaccacgttggtcaggctggtcttgaactcccgacctcaggtgattcgcccgcctcagcctcccaaagtacggggattacaggcgtgagtcactgcgcccggcctttttttttttttcagacagagtcttgctctgtcgcctaggctggagtgcagtggcgtgatctcggcccactgcaacctctgcctcccaggttcaagcgattctcctgcctcagcctcttcagtagctgggactagaggtacgtagcatcacgtctggctaatttttgtattcttagtagagacgaggtttcatcatgttgaccaggcaggtcttgaactcctgacctcaggtgatccatctgcctctgcctcccaaagtgctgggattacaggcgtgagccatcgtgcccggccagagaggttaattaacctgctcaaggatcacaggtggtagagctggagcttggcattcagtctatatttatctgactctagaacttgtggtctgaattgctacccaaggtttacaatcatttatgcagagtctaattcagtaggaatagtgtggtgccagaaatttgcatttttgacaagcactccagggtcctggagagctacactttgagaacacttcctgtcacaaatagaaactgcacggcttccattagaaagatgaaactctttagtaacagaagacttattctggggtggaccaaatgctgggctttccctccttctttgagtagaagaggaagttagaagagggtaataagatgcaaagatttcttatctcttcctgtccctcaggcctccctgcccccacctaagccccagaaaagtgcacctcaaatgaatttgcctgaagaggtataacattgccctttgctgacaaacccctgagcaaacatgtactggttatttggtaacactcaaaagtctaatcgtagctggccacggtggcttatgcctgtaatcccagcactttgggttgggaggctgaggtgggcagatcacctgaagtcaggagttcgagaccagtctgggcaacatggtgacaccccatctctactaaacacacacacacacacacaacacaccatctctactaaacacacacacacacacacacacacacacacacacacacacactagccggcgtggtggtgcatgcctgtagtcccaactactcaggaggctgatgcaggagaatcacttgaaatggaaaggcggaagttgcagtgagccgagatcgtgctactgcactccagcctgggtgacacagcgagactccctctcaaaaaaaaaaaaaaaaaaaaggatctaatggcagttttggcagttctttttttgttttgttttgtttttgtttttgttttttttgagacggagtcttgctctgtcgcccaggctggagtgcagtggcgcaatctcggctcactgcaagctctgcctcccgggttcatgccattctcctgcctcagcctcccaagtagctgggactacaggcgccctccaccacgcccggctaattttttgtatttttagtagagacggggtttcaatgtgttagccaggatggtcttcatctcctgacctcgtgatctgcccgcctctgcctcccaaagtgctgggattacaggcatgagccaccgcgcctggcagcagttctgaggaacagtttgctcaggctgtcagatctggaagtgttcgtggcttgctgagcagagacaagaggacaaagccttaggtgtaatctaaatacaacggatttgcaatgaaacaagtggcctggtctccaaccgtttctccacacgctctgcctttctgacagcaaatctatgtttggcaaggaatgggatggagacttcttcccacctggtggccaatgttttcttgaacctctatatcacccttcagctcctgggtggggttgatggtcatccacagagaatggggggacaatatacctgtgagggcccagccactggtcagtgttcagcagaggagaaatacagtagagaaagagcaagactatgccagacattgtgctgggtatttgactaacatgatttaatcttccaataacccagagaagtgtagggattccatcttcatttgccacatgaaaaaacggagacacaaatatgcaaagtaacttgcccaagatcatccacgtaataagtagagtcaattattaaacctaaaggccttgtcctttccatccagctctgtgccaccgcgaagggccaccgctctctgcattagttcctctgtgtaagatctcctcttccaatccaaacaggctccactcacaagccttggaaaaacgccaccagcccttgggtccaagaataacataaatgcaatgagccattttctgaaaatgagatgacatatgtcaagcattcagcccagagcctggtacttttcagactgctcagccggggtgggagggtccctgggacagggtgtttctggtttcaggagattctactggccgtttggtaacaaacatttatcaggtaactatataaatggtcaaaacaggaagagcagggctgggcacagtggctcccaggactttgggaggctgaggcaggtggatcaccttaggtcaggagtttgagaccggcctgaccaatatggtgaaaccttgtctctactaaagatacagaaattagctgggcatggtggagggtgcctgtagtcccagctactaaggaggctgagacaagagaattgcttgaacctgggaggcagaggttgcagtgagctgagatgacactactgcactccagccttagcaacagagcaagactgcgtatcacaaaaaaaggagtcatgggagtcatcctgattggaccagcttagatctcaggaatccatccctgcctgccagggggatggaatgagctgactggcttagcttaagtggcatgctctgtccttggaagcacatggaccctcaaatgaaaattgggagctctcgtgggaagtggggtttgtcagggagacagccacaaagatcacaacaggaaagttgcttttgtgaaataaaaaggcaggaaggcacaagcagtatatgattgtagcccacagatttgtttggctagagcagagcattctttgttcttgaaagtgagttgtgagaaatggagcatttgggagggagttgggggtgctggaaggggccttgtggggagcctgcggggcctcaggctttgtgtgagtctgggagttttagtgcagcatttaccggattactagcaaattcaggaaatgagcctgtttcctcctattatagagcctaatcctttattcattaaatggagtatttactcagccttaaaatgttcagcgtggggggttagaaaagaagggagcccacagctgctgagagcccactgtgtgctgacactaggctggaggcttctcctacgttttctcttttaatgctcccaacctccctctctgccccatttcacagatggagaaggaaaggcaagtgacttgtccagagccactctgtcaaaaggggacttgagtcctcagggctgttgactccaaagctgacaagcaggtaaccacattggggttttctccaggacatgagaattcctttgtcctgtgtatcacatcgagcacctgggctgatgacccttctgcatggtgtacccacctcacagcctgagcttatcctcagctacatccactatgcccagagacactgatgaatgcatctgggagtctggagggaggggtccacttgtgagttgaggccccatttgtacccgctccaccaggactgaggacaggaagtcacgcctaggagaaccaagacggggttgacaccaatggtacccacagagcatccttgtcccaactgtcaccaccatccccctcctcctcctcacacctgcatctccagcagttattgagcgcttgcaacatacccggtgctctctcagcactttacatacatcatctcctggaactatcccaaagcttttttgaagcaggtgccattatcctccccattttgtagatgggaaagctaagaaatgaccatggaggccgaggtcacagcaaggggcttgtccctgtaaggtctatacactcatccccatttccttttccctctttaattttcttttttatttttggagacaggctctcaccctgttgcccaggctggagtgcggtgacgtgatcatggctcacagcagccttgacctctgaggctgaagcaatcctcccgcatcagtctcccgagtagctgggaccacagctaccatgcctagctaatttttgtatatttttgtagagacagggtctcaccatgttgctcaggcttgtctcaaactcctgagctcaagccatccaccctcctcagcctcccaaagtgctggaattaaggcgtgtaccaccatgcctggcccatgccccattttaaaaatgagtaaatttaaccttcgagaggttgcccactaatctcacatggctggcaagtggctgagttgggatctgaactcaagttctgtctgactaccatggatgggctgagcactgctgtgaaggataattgttgagttaaagaaaacctttggagaagtgatttggccttgtggatctttccctgagcacaatttccagcatgttcctgagaaagcttaggatcctctttgttggaataagcgcaggtccttcctcggggcatctatgcccactaacgtcacagtcatcctccactcccactttttcccctttcccgaaaacatctcatatggggctccgagcaagccctgggaggagctgcttcctgggtgactgtgtcccccggaggaatgtacacctgcagcaagacgagtgggacatttttgaagcctcaggccacacacattgtccccaagacaaggctgatgcggctagtaagcctcttgtttttgaaggtcacaaacaacaaaaacatggaaactcagaatggaagggggcccatgagagcaatcttgaggcataacaacagctgcagaaggtgactgcagggaagcggactgtgctcctattctttatgttctgtttttagctgtgtttttcagagcaagtaggtaccatggtgataggtaccatagaaatagatggagcgcaccacccagcacggggctgccaagctgttcccctggaaatgcaccgagagctgccagggagagcccagggactctgcttcctggggcctgtcagctgcacggccagggaagaagtcccctgtagaatggtccccagaggcttctcactgtcttgctgtcattgtccaaggtccctgatggtgcatcctcctcctggagcacctgtggccttcctctctgagtcctcaggaaactcacttaagggggtttgcctttgcctagtgaagcaattatcttggccaacagtgacctcaaaagtagcactgccagcattcctgtctccatagttaggagtgcgtggtcctcatcctgcctggatgtggcactgtcactggttttatgcaatgtcataaagaatttgtggggcaggagctgagttctgaacatttggtaatcaggaatactcataaaatgaaatttcagaggatctaacccagaaagccgagcaaggtagggcataaccacgtctgatatggtggttttcagtttgtgaagccacaggcagtacagaatagggcccagcctcaactatttttggatgcagcttgaatggactgaaagaccctttgaaacaagtgctggaaccatcccgtagcacttacataaccatctctgcaaggctgttgatagatgaatgtaaatgaacctaggcagagcttagctcatttttatttagatttagaccaatttcatgtcttctgaaacgtaacccatatatacacacactaaatctaactcttttattttaggcctagcatgagaggatcaagttgaaagggcatctgttattatatctgtcccatcatatctgcttctgtgatggctttattatgtacatttctttctatacatttgtgctctcaggtggcattcttcttcagagcagggcaagtgtaattctggaccaatgtgtgattctgagaccagaccaaccaactgaaggtaattttattctcaattaaagaaacacagacggggcgcagtggcgcacgtgagcctgtagtcccagcactttgggaggctgaggcaggtggatcacttaaggtcaggagttcaagaccagcctggccaacatagtgaaaccccatttctactaaaaatacaaaaattagccaggtgcagtggcacgcacctgtaatcccagctacttgggagggtgaggcaggagaatcgcttgaactaagtaggtggaggttacagtgagccaagattgcaccgctgcactccagcctggatggcagagtaaatctctgtctcaaaaaagaaagatacacacatctctaacaaaggattttttttttttcttgagacaggatctctctccatcacccaggctggagtgcagtggctccatctcggctcactgcaacctccacccccaaggctcaagcgatattcctacctcagcctcccaagtagctgggaccacaggtgtgtaccaccatgcctggctatttttttgtatttttagtaaagacagggtctcaccattttgctcaggctggtctcgaactcctgagctcaagcgatccacccaccttggcctctcaaagtgctgggattataggcatgagccactgtgcctggctaggaatttattttaacaaccaaaaacttaaaactcaataacatcattaactcataaattattgtttagttacagattacgaaaatgatagaaccagaaggtgctaacaaaatgtctgtcctgcatgtgtggcatttgacatgaagaaactgaggcccttgctgggcgcagtggctcatgcctgtaaccccagcactttgggaggccaaggcaggaggatcacttgagctcaagagttcaagaccagccttggacaagatagtgaaaccttgtctctaccaaaaaaatacagaagttagccaggcatggtgcagtgtacctgtagtagcagctactgaggaagctgaggtaggaggatcgcttgatcccaggaggtcaaggctgcagtaagccgtgattgtgccactgcaccccagcctgggcgacagagtgagaccctgtctcaaaaaaagaaaagtaaaggctacgcgcggtggctcatacctgtaatttcagcactttgggaggccgaggcgggtggatcacctgaggtggggagtttgagatcagcctgaccaacatggagaaaccccgtctctactaaaaatacaaaattagccaggcgtggtggcgcatgcctgtaatcccagctactcgggaggctgaggcaggagaatcacttgaacccgtgcggcggaggttgctgtgagccgagatggtgccattgcaccccagcctgggcaacaagagcgaaactctatctcaaaaaaaaaaaaaagaaaagaaaagaaaagaaagaaactgaggcccaaagagtttgcatactttgctattagttcagcctgtcttctgtgtatgcaggtggtgtctctaggtcgttatcactctggcaaattctctcccagtgatggagatgtgtggagcccccagtctctccaaccagggagtggtgctcatggtgaccctgaagtaggcttgtgggtcaggccgttggttgagctgtgcagtgccagaagtagctaaacatccttaaaggaactgcctagtttatcattaggactaaccatggaaccgatgactcagcgtttactgttggcagtatcatacactcaacctgcatgtagatttcgtgcatcatattttgtggttacaggaatttggcctgatggacccgttgcagaaactctgtactaaataagcaaacacgtgtgctctagttttacaggccaagcaaactgtgaaacagaagggttggcctttcttgcccttagcagtcataccttggacttttgccacttggttgggttgctttatttggctaagtaactaaaagcagatttactttgaagaatgaggttctcaaatattctagaactctctaagaatggacattcacagtcatgctgggcagacagagttattcccaaattttcagagtcataaagcttatgtttgggctgggtgcggtggctcacacctgtaatcccagcactttgggtggccgaggcgggcgtatcacaaggtcaggagtttgagaccagcctggccaatatggtgaaaccctgcctctactaaaaatacaaaaattagccaggcatggtggtaggcaccggtagtcccagctactcaggaggctgtggcaggagaattgcttgaacccagtaggtggaagttgcagtgagtggagattgcgccgctgcactccagcctgggtgacagagtgagactccatctcaaaaaaaaaaaaaaaaaaaaaaaatccagtttggcctgtgtgaagcacccacacaaaaccttcctttcccaatattagcgccttcctgtggagctggaacaggggccccggggctagaatatttgatattcaagacacacactgagtctggtgtggtgcttttcagcaacacattgaaaaattgttgcttttcacaccaacaatttgaaactaaacatttaatgtgaatgtttctttttttttgagagaatgtctcactgtcccccaggctggagtgcagtggtgcaatcgtggctcacagcagtcttgacctcctgggctcaagcaatcctcctgcctcagcctcctgagtagctgggattacaggtgcacgccaccatgccagctaatttttttagtttttgttttttgtagagatgggggtctcgcactcctggactcaagggatcctaccgcctcagcgtcccaaagtgctgagattccaggcatgagccaccacacctggccttaatccgaatgttttttaacaatcacaacttgatttttaacattttaatttaaaatttttattatggttaaaaatatacaacatacagtttaccattttaatcatttttaagtgtacagttctgtggcattaagtacattcacattgttgtgcaaccatcaccactctccatttccagaactctcttcatcttcccaaactgaaactctctgcccattacacggtaactccccattccccaccccatctcctggacccagcctgtggtcaccaccattcagctttccatgtctgtccatctgtctgttgtgggtgtcttatagaaatggaatcatacaatatttgtcacttatgtctgacttatttcagtttgcataacgtgctcagggttcacccatgttgtagcatgcatcagaatttccttcctttttaaggctgaagaatattctactgtatgtatataccacattttgtttatccataatttttctatagtttcttatttctttgttgttgttgttttgtttttttgagacggagtctcgctctgtcgcccaggctggtgtgcagtggcgtgatctcggctcactgcaagctctgcctccggggttcacgccattctcctaactcagcctcccaagtagctgggactacaggcgcccaccaccacacccggctaatttttttttattatttagtagagacagggtttcaccatgctagccaggatggtctcgtctcgatctcctgacctcatgatccacctgccttggcctcccaaagtgctgggagtacaggcgtgagccaccatgcctggcctattttttttattttaaaataattgcaaagtgacaaaacatttcaagaatggtactaaagaaaatcttttttatatctcattattcatcttttttattttttcttttcttttcttttttttttttttgagatgcagtcttgctctgtcacccaggctggagtgcagtggtgcgatcttggctcactgcaacctccgcctcctgagttcaagagattctcctgtctcagcctcctgagtagctggaattacaggcgtgcgcctccacacctggctaatttttgtatttttagtagagacggggttttgccatgttggccagactggtcttgaactcctggcctcggcctcccaaagtgctgggattacaggcgtgagccaccccacccagcccttcttttttctttatagacagggtctcatgtcataagagaccctacccgccattccccaccacggagtcctaccttactcagctccaccttgtggctttaggactggattgtttagaaaggggaggagaagggaccaccatttgctttcattgaaaatatttgttttggccaggtgttgtggctcatgcctgtaatcccaacactttgggagtccaaggcaggaggatcgcttgagcccaggagttcagaaaatacagcctgggtagcatagtgagacccccatctttacaaaaaaataacagaaattagctgggcacagtggtgcatgcctgtggtggtcccaagctactcaggaggcttaggtgggaggatggcttgagcctgagaggttgtggctgcagtgagccatcattgcactacctgcactccagcctgatgacagagcaagaccctgtctcaagaaaaaaaataaagaaagaaaatacttgtttcattaacaattctttgcatgtggggagcccttgtatttaacctattaaataaacaaatcttaattatgactaccagcatttccccaatcttgtctctgctattataataccattttttaaataaaatgattatacagttaggatgccttcttccttgcagcaacacttattttgcaaatttgcagttgtatttaggctaccaccagcaactctcttggcaaacattgagcaactcctaccacaaaaattaatgagtagagagacaaggtctgcacacctactcattttgttcttccattatcaagttgtgggactctggggaagtgatccaggggacatctacagaaaccaaaaatggagttttgtaacactgtgagttgtttattcttgtaaataataggatcttcttgactggactggaagcttcaaggaagctgtgtcttctgtttttcgtgtgcatccttcgtggttctaaatatgatgctacatgaatataaggtgtttcctgtcgttgtgggctggtggagctgtgagggcttcagtgggataaactggaagaaggagcctgggttatgaagttcagtggatgcttcttgggttttctcttccttgacctccccggaccgtaaattcctccttgaaatacttgcttctgaatcacaaagtttctctcctgcctccctggccgccttttctcagctgcctttgtgtgagccacatgctctgcccatccctcctgacagtgagctttatttacttatttatttattatagacacagtctcgctctgtcgcccaggctggagtgcagtggcgaaatctcggctcactgcaacctctgcctccctggttcaagcgagtctcgtgcctcagcctccccagtaactgggattatagacatgcgccaccacacctggctaatttttgtatttttagtagagacagggtttcaccatgttggccaggctgatctcaaactcctgtcctcaagtgatccgcccacctcggcctctcaaagtgctgggattgcaggcgtgaggcaccgcacccggctgacagtgaacatttattgggcacctcccgtgtgccaggcactgttgatgctgcacatccagcagtgagtacaacagatggaaaggcttgtcttctctgaactgaaaggaaaagaggaaaaccccctcccttgggtgtgagcctgcttgcttgtttctgcgtcacgggaacaacctcagctgttccccatggtgtgatgagcactgcctgctcatgcaggccttgccgggcccatgaaggatgaaggcagcctctcccctgcaaggttctttcctatgtgaacccaaaagtatctaagacagagctcaatcaacttagaaagtttattttgccaaagttaaggatacagcgttaacatacagcctcaggcggtcctgaggacatgcacccaaggtggtcggggtacaggtttttattatttttgtttgtttgtttgttttttgagacagggtctcactctgtcacccaggctggagtgcagtggtgcgatctcgactcactgcagcctctgcctcccgggttcaagcagttctcctgcctcagcctcccaagtagctggaattacgggtgtgcaccactatgcccagctaatttttgtatatttagtaaagacaggattttgccatgttggccaggctggtcttgagctcctgacctcaggtgatctgcccaacttggcctcccaaagtgctgggattacaggcgtgaaccaccatgcctggccacagcttggttttatacattttagggagacctgagaaatcaatctatgtgtgagattgatcagcctttcactgaatacacaatttccatgtgagaggagggtagaggagtagtcacttatgccttagtctggctcagtgaatctacatttttacataaacaatagggcagaggaagcaatcagatatgcatttgtctcaggtgagcctcagagggatgactttgggttctgtctattctttgtcgggcacccatgaaaataagctgtcaatttacattgccagggtgaaattcaatagaactgttttagggtaaagatgttgaagcccacaaggaattcatcttttagcgatcttatttaggaacaaaatgagaggcaggcttgcgcagttcccagcttgacttttccctttggcttagtgattttggggtctcaagatttattttcctttcacacctgcgagagagactttctgatgctccttctctgccctgcgctcccatctcatctgccaactttgcgctttggctgccctgctgtccgtccccgacctgcagccctactagcttcctaaaaggcaagtttcacaaatcactcactgctcagtaccttctgtgatttcctgaggctccgggataaatccaaatttcttcacatgacaggtgggtccccatgagccagccgctgctttcctttccagacccagctcccgccacctcctgccttgtgtcaggctctgcagcacggacagctggtccccccagtacctccctgccttgctcctgctggcccctgggcctagagggccttctccctccccagcctgcttctagtctgacccctactctccttttagactcagccccttctcctccaccctgagtccacaggccccggagcgctaagcacatggtgttatagttaactatttacttttctatcttttcctggaagacagacacgatggtagatggtaattatgcgtttaatgtctgtctcctgggacggtaaacccctgtgagtgtgggctgtgactgtcttattcaccactgtgtttttggcacggggcccagagtaataaacatgggtaacacttccacagcgctaactgtgaaccggccagaagtgtcctgagagccttacatgagtttacaactttaacccttaccaccactcagtgaggtactgtgatattatgagatatgtatttggtcttcctctggtttcctggcatacaacttctaaaatccttggaatctccaaagagataaacgtgtttttataggctagagagttgactgatggccaggcgtggtggctttggccttgcacggcggctcactcctataatcctggcactttgagaggccaaggctgactgatcatttgagcccaggagtttaagaccagccccgtctctacaaaaagaaaaatttaaaaattagatgggcgtggtggtgctcacctgtagtcccagctactcaggggactgaggtgggaggattgcttgagcccaggaggtttgaggctgcagtgaattgtgattgtaccactgcactctagcctgggcaagagagcaagaccctgtttccaaaaaaaaaaaaaaaaggacagaaaagacaaaagagcagaaagcctctcttccatcagggccaccccaaggcacaactccagagggcgccattcacataaaatgtagtgcgacagccactcctgctcaggccccagtctcccactttcccctctgagggcaccactgataccaagctcttctccatccttccacagatgtctatgtggatgtgaacagaacatgggcatgtcggttaatagagaattctccaccttgccttgttaattttgcatcattgggagattatttcagataaggtgtgtagggtagcctcattctttttttttttttttgagatggagtctcgctctgttgcccagactggagtgcagtagcgtgatctcggctcactgcaacctccgcctcccaggttcaagtgattctcctgcctcagcctcccgggtagctgggattacaggcatgcaccaccacacctggctaatttttgtattttttgtagagatagggttttgtcatgttgcctaggctggtctcaaactgctggggtccagcgatcctcccaccttggcctcccgaagtgccgggattacagccatgagccactgtgcccggcctgtttctaaatcatttcttttacaaacagtgctgctgtgtactcagtcactgtttgagcacatctgtaggatacagtcctaggattggattgcttgggtaaacagagaaattactttctaaaggtggaatttcagaaatctgtgacaagcatacatgagatatttttacactgaagtttggggcttgtcagatctggctaggggttgactgtctgtggggctcctctctgatatatttgatgttagggaatgatgtttctgggtttgatagtttgttctctaaagagaaaagagagagctcagagcagaaaggtagctttttggattctagccagggctcactgattggatctcatctcacctcacttctagaggaagaccactccggaaaacaagatacctgggccatgcagcagtgggttccccagtgccctgatagaaagtctgagaagttcaggattcagtccctaaaagcatatgggctgaagaggctctggccctaaaatcaccttgttggggatagtgggaaggtccctgttatttttaaaatatactgaggatgtgattcctaacaccacaaaatgggtgggtgggtgaatggatgaatggctgggtgaatggatagatggatgaatgaatgggtgagtgggtggatggatggatggatggatggatggatgaatgggtggatggatggatggatgggtggatggatggatggatggatggatggatggatggatgaatgggtggatggatagatggatggatgggtggatagatggatggatgaatgaatgggtggatggatggatgggtggatggatggatggatggatggatgaatgaatgggtggatggatggatgggtgggtggatagatggatggatgaatgggtggatggatggatggatggatacatacatagattcatacatatagaaaggtaaatagtgatcaaacaaacatgaacttagacctgctttattattaggtaacttctttgagctcgttggacctcagtttctgtctgtaataggattaacaatgccttttttgtgtgtgggactatagtgacaaactaacagatgatgtacgtaaacgccctagcatggtcctggcacactgtgggtcaccatatatggtggtagttgctatcatttactgtgagtgggcattctctgattggtgtatattgaaggcattttttttttgactttgcaggagccaagttacaccctgtttaaccctgccttcaaagggacgactctgtaaggtaggggctctcagccttcttttcctcccagcatgcacggtgggtgacactggggtgcctggcacactcccagcatgcatttcacagggcaggatttctggcaacactcatttctctccaggccaggaaagcaacctagaaatcaacttacatttacattaaaacagtacataaataaaggaaagagaaggcaataaccctcagactttggtctcctggctaaaatgtatttgcaaaacagcacacagcttgcacctgctgccctctagggtaataatgagggtgggtggaggtacctgtggggtggcccattccagtgggtttgggcaaatgaggacggttatcagaggagtggctgctattccccacaaggttatggaaagcttctctctttggcctttgctgtgtgccaggcagaggtgctaggtcctctctgcagtgtgcagtgaccctggggaaccacagacattcaggaccctggctggtagctcagttgcttggctaaggtggtcaggcttgccaggcccaggcgttaggcaagcccaggcctgacctgccaaagcagctgctttaagcctcagaatcttcactgggcaatggaatcctacctcacctgactcctcccagcaccccctcccactagcctgcggggactaagtgttctctcccctgtgtccccacagcactttgttcccacagctattaaagtactcactgttggctctaagtacatctctcctccttccaaagcaatattctttttgttttgtttgctagagatttcatgtaatctcaaattctttgttaaaatggccctggggtttacattattttctatctaggagattagagttgaaaacataaattggtggtttggaattccactgagttcttctctttagatagaattgtggaaagtcaggcttgtccagaaccctcactatgggcactgtccttgaatcctgctctcattcattctgcagtcagctagtcatccaacaaacacttactgaactcccacctttgtgccactatgctaggcactgggtatatttggatgaaaaggaccttggctatgctttagagaccaacacaatgtggttatctagctctagattttgttgacatactaaaacctatctttttttttttttttttgagacaggtctcactctgttgcccaggctggagtgcagtggcgtgatcttgattcaccgcagccttgacctcctgggatcaagtggtccttccacctcaacctcccaagtagctaggactacaggcatgcaataccatgcctggctttttttttttttttttggtagacatgggtttttgccatgttgcctgggcatgtcttgaactcctggcctcaagcaatcctcctgcctcagcctctcaaagtgctgggattacaggcgtgagccaccacacctggctaaaacctctttttttaatagcataagtcaatttaggccaggtgtggtggctcacgcctgtaatcccagcactttgagaagccaaggtgggctgatcacttgaggccaagagtttgagaccagcctggtcaacaaggtgaaacctcgcctctactaaaaatacaaaaacaagccaggtgtcgtggcacatacctgtaatcccagatattcaggtggctgaggcatgagaatctcttgaagccaggaggcggaagttgcactgagctgagattgcgccactgtactccagcctgggagacagagtggcgagactctgcctcaagaaaaacaaacaaacaaaaaagaagtcaacttacaggattcctttctgagcacaatttcctagagatttgagaccacctctattttttaaaaatcatattttttagcttttaattgtgatttaaaaaacacattctacttttaaaaatctacaatatctatttactcaccaaagattgtataaggcactgtgcctagagtggggttaggggaaggacaaagaagaaaacacaaagtccctataccttctagaaacctaaatctaaataagggaagtcacatgtcgacagaaactcggcctcttatttcacttgcgattgcggtggtattcattcgtctgttcattcaactgtgtgtattttgggcacgtgctatgtgcataggctgtgatgggtgctctggagcctgtggaagaagtctcacatgtgtccctgccctcgaggccctagggagagaagggagttcagagtcaagtagaataataggccacggtgcctcctggccaaggagcccagcaccagccttttggagaagactctgcagctcccgaggaatggaaagctgttagggaagggaagggggacgttccaggccaagggaggggcacagggaagtttgcgttaggaatttctcatcagaaaaggagatgtgacgggggagaatggattccaaacaatgcccaccacaaggcaggcccaggaacagggccaggaaagggtaggatgtgatgtggtatgtgaagctatgtgaggctgaatctgctgccttcagggggccacactttctaatttgttccctttccttccctcacccagattctctgctacttattcaagttgacacgatgcccttcacactccacctgaggtcccgccttccctctgccataaggagtttgattctacaaaagaaaccaaacatcagaaatacatccagcatggctggaggtaagtggtgccagatagttaaaaaaaaaaaaaaaaaaaaaaaagaaagttcctgggaattaccagctgtgtagggcccacaaactcctaagacttctagattctgcataggaaacagaaagtaagagcagaatgatattagctctggtcactatttaactgctcagaagaaactggaaccttggattagactcaaggtatggaaacccatcagatgggtctaatgacacccagttctgcttggtcacctcagccccatatggagaaccaccagtgggctcaggtgatgaaaagggttgtcccttctgggaaaagtgcccccaggttacactgcagtttaaccagattttgattcagaccaattcttcctacccttgactggtcttattctctggtggcacccatttccctactgtctcctgggagtgatactgaaggctctaaaaggtcctgcaagagaaaacagataccaaatttgtcattgacctaagtccaagcaaaatttcacattaaaaaagactcgtctggttatggtataagtgcccaaggaaaaaccatcagcaccatctaaagtactagagcaagaccattttcctttagtttattaatatgtctggcctctgttgctctatatgggctaacagagttaactgttgtataacaaggcactcttttttgttgttgttgagacgtagtctcgctctgtcgcccaggctggagtgcagtgatgcgatctgggctcactgcaagctccgcctcccagatttgggttcatgccattctcctgcctcagcttcccagtagctgggactacaggcgcccgccaccatgcccagctaattttttgtatttttagtagagacggggtttcaccgtgttagccaggatggtctccatctcctgacctcgtgatccgctcaccttggcctcccaaagtgctggagttacaggtgtgagccaccgcaccaggcccaacaaagcactcttaaacttagtggcttaaaaccattaatctcacaattctgcaatcaaggttggtcttagcagggcgcttcttctgttccatgtggtgtctgttggggatagaccatccaagatggcttcttcctgacatgtctggcatccagtgggacatctgagactggctgaacatttcttctccatgaagcctcttcaatagtggtcgccaaacttctttacatgggacgccatgagacagattccaagagaataagtcctaatgcccaaacgcataccaagcttctgcttgcatcacacttactaatgtcccattggcgaaagcaaatcacagggccaaggccagagtcaatagggaaggggctacaatggggtgtgaatactggggagcatagtttatataaattggtgcaaaagtaattgcgatttttgccatttttttttttttttttttaaataaaagtaatggcaaaaactgcaattacttttgcactacctaatatatacagagagagccaccaaggtattagtctacagcaacctgttatatacgagcagcgaacaccagcttaaccccaggttgacgactgcttgctaggaccctgggaggcaacagagcagagcagccagggtcttggagcctggagggagacagcctgagtatgagtcccagcttcgctctttactagcaaactgtgacctttctaagcctcacctacacaatgaaagtagcagcagaaccttcccagtgggactgtcgggaggggcacctgagctgttccccgctgccgtgaaatgctcctcaaggagagaagctcattttaccaaacagctgggaaactccagcttggagctgtcttctgggggctttcaatcaaattagaaatgttaaagggtgttttttcctctctcttgtcattaagttaaaaaaaatgattttgaggtaaaaggactcagagaaatcactcagtttatctacaaagaaaagtgttactgccttccatggagcccaaggcagctgggggatgcacaaatcacattagaccataaagtatcctccaaaaaggtgaggcctccagagtccaccatcctctccagaaagagaccatgaaggcttctattctgtgtcctgttactaatggggacaacttggggacttttctgttcatctccagctgtggagatgaacaaaaccaaaacaaaacctgcaaagttcatttaattaaaaaggaaacaaagggccgggcacggtggcgcacgcctgtaatcccagcactttgagatgccaaggcaagtggatcacctgaggtcaggcattcaagaccagcccggccaacatggagaaatcccatctatactaaaaatataaaaattagctgagcatggtggtgtgcacctgtagtcccagttacttgggatgctgaggcaggagaagcacttgaacccagaaggcggaggttgcagtgagccgagatcgcaccattgcactccagcctgggcgacaagagcgaaactctgtctcaagaaaaaaaaaaaaaaaggaaacaaagaagctttgtgcacataccatcctgatttattgtattaaagatacaatttgtgctgggcatgacggctcacacctgtaatcccagcactttgggaggccgaggccagcggactgcctgaggtcaggagttcaagatcagtctgcccaacatggtgaaaccctgtctctactaaagatacaaaagaattagccaggtgtgggggcatgcgcctctaatcccagctactcgggaggctgaggcaggggaattgcttgaaccctggaggtggagcttgcagtgagccaagattgcgccactgcactccagcctgggcgacagagtgagactccgtctcaaaaaaaagaaaaaaaaaaatccagtttgttctcacaaggggctttggcagtaagaagcgggtgagtagggagtgggaggcctctaagccagccaaatcccctcccacctcgctccagataacttttggagccgtgctgggcttgcttgagactggcatcaggttccttgggctttcggcagctgggggtgtctcacgtgtcctcatttggaaagtctgcttgtagcattggcaggcactgtagcgactgtgataatgagctccgggccctgcgatttgagcaggagctggtcctggacattcccagcggatggttgcatctgtttcactccccagtccccatggaggacggcgctcccctcctagggaaacccagtgcctgcagcccagcagaggccactccgtgatgaaatgaggcaagctcgcgggcaccccttccaggtttaaatgctggctgtgccgtgcagcagctgtgtgaccctgggaaagtcatttcatctctctgagcctcgttcccctcatctataaaatataattacttgtgcaaatgacttggcatggggagcccggcacataaaaagcactcagtaaatattagcccacaagattattgtaggagagaaagggacatgggttgatagagcaaatctgacagggcaattgtcctcaagggtattctccaatagagcataataattattattttttgagacagattcttgctctgtcacccaggctggagtgcagtggcgcgatctcggctcactgcagcctccatctcccaggttcaagcgattctcctgtctcagcctcccaagtagctgggattacaggcacgtgccaccatgcctggctaatttttgtatttttagtagagatggggtttcaccatgttggccaggctggtctcgaactcctgacctcaagtgatctgccaacctcggcctcccaaagtgctgggattacaggtgtgagccaccacgcccggcccaatagaacataattatgtttttctttggtatggtcttaattttagaatattgagaaaagcacagagaagcaaatgacaagtatgcacagctctgtcacctggagacaaccgtgattaacttgtaatgtccttactggttctagtagatgttctttggtgtctgcacattcaagggttagatatttattgtagtctttgctatctgggcttatttgtagtcctctgttttgggaaggctttccagttatttgaaaggatttgggtgttgtgatctaagctgtttctgctttagggggcacctcaagcccagtaacgccgtcattcttgcagacttagtacaggtatgggtttgatggtcttggagaagatctaggagcattctctggtttaccaggcagagacccttgttctcttcccttactttctcccaaagagtctctctctctctctgtctctgtttggaaccacctaaagctgggggtggaatgacacaatcacccctgtagccaccaccactgtgactgtgctgggccagacctgaagccagcacagcactgggtcttgcccaagtcctgctgtaaccactccctggcaactgcctatgtttgctcaaggccatggggctctgcaattagctggtagcaaaaccagccaggcctgtgtccttccctgcagggtggtgagttcccccaggccctgggtgagtccagaagagccgtctgggagtcagggactacagccaaaaaccttagatgcctacctggtgttctgttgtattgtggctgagctggcactcaaattacaagacacagtcctttccactcttccctcccctttccttctagttctttcactcactgactttataaaaaggagaatatgtccaacacattgtttcattacctagtatagttcctttaatgacacataacaaacatcttttaacataaccgttacgtgtttcttctgtaaccgtaattttaaacatctacacaggatttcattgaacagtaactttagtccctgcttcctgaacaccgaggtgctcaataacttacatacattacctccctgaggtctcttggaggtaggtatggttgctgccatcttatagatggggaagctgaggctgagacatgcaaagccacagcctgggttcacacagctggtcagagacaggatcaggattcaagcccaggtgtgtttaccaccaaagccaaaggacttccattgcggaggaaggctggctgccccagaggaggctacagcatgtaataggaggtcttctcctgtagctctgtgaacactgtgagccagctcaggcaagaatctgccccccaaaaagatacccaaatggccaataggacatatgaaaaggcagtcagccacactagcagtctagacaatgcaaattagaaccacaaggtgatggataccactacccacccacaagaatggctaaaaggaaaaagacaggtaatatgaagtattggagatgctcacataccactggtgcaagtgtcaattggcacaaccactttggaaaactgcttggcagtatctattaaagttgcacatgtgtataacttaccaccccagaaatgcacatttatgtactccaaaatgcatgtttgtggcattaaaatgttcatggcagcaccatttgtcataaccccaaattggaaactactcagatgtccattagcaataggattgggtaaatcctcattgcatgaatatactaggcagcagtgagaatgaactattgttgaatgcaacaatatgaatgaatctcaaaatatattgagtgagagaagctagacttaaaagacacatagtgtatgattttattatatggagtctaagaacaggcaaaagtcgtatgtggtgctagaagtcaggatggttggctcttgttccttgatctggatgctggttacatgggtgcattcatttcatggcaattcatcaagctgtaggttcgtatgtttttgattgaagcattacctacacttttttgagtggggctctgcaattagcaggtagcaaaaccagccaggcctgtgtccttccctgcagggtggtgtacacttttttgagtgtaggtaatgcttcaatcaaaatttacattaggccagttgcggtggctcacgcctgtaagcccagcactttgggaggccaagacaggcagatcacttgagcccaggtgtttgagaccaacctggccaccatagtgaaaccccatccctactaaaaatacaaaaattagctgggcacagtgatgcacacctatagtcccagctacttgggaggctgaggcatgagaatcacttgaacccaggaggcacaggttgcagtgagccaagatcaagccagtgcactccagcctgggtgacaaagcgagactctgtctcaaaaaaaaaaaaattacattagaagttgggtatggtagtgtgcacctgtagttccagctacttggcaggctgaagccggagggtcacttgagtccaggaattcaaggccagcctggaatagcaagaccttgccactttaaaaaaatcacagaggggctgggcgcaatggctcatgcctgtaacccagcactttgggaggccgaggcgggtggatcacctgaggtcaggagttcaagaccagcctgtccaacatggaacagttggcccaacatgggccaataaatatcccatgtatatttttagtctctactaaaaatacaaacaattagctaggcgtggtggcagacgcctgtgatcccagctactcggggggctgaggcaggagaattgcttgaacccaggaggcggaggttgcagtgagccaagattgtgccattgcactccagcatgggctacaagagcgaaactccgcctcaaaaaaaaaaaaaagaaagaaaatcagtaagtgtctgccaagaaaccgctgactatacatttttcccttctcccaccatacccagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggtaaaaagcttgggttactgtgggttgaagcttgggagtgtccaggtgctgtagccaggtgtctctgtcatccgggacctctctgtccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaacacccagagacagagatattgtgtctgttctcccaggcttttaaactagaacctatctagtaaatggccctactgatgctgggtcggtgtacctctcccacgagtctacctttcctatggcaccagcacagactggcatcttccctggcctagccctagtctcatcctttcttccccaaccctgtcatcatctgctttcccagcagagtgactttctaatgctaaacccgatcatgtggctctcctcttaaaactccttcagactgggtgctgtggttcatgcctgtaatcccagtacttcgggaggctgaggcaggaggatggcttgagcccaggagtttgagaccagcctgggcaacatagggaagacctggtctctacaaattttttttttaaaaattaactgggcatagcggtgcacacctgtggtcccagctactcgggaggctgaggaggattgcttgagaccaggaggttgaggctgcggtgagccgagatcatgtcactgcactccagcctgggcaacagggcaagaccctgtctaaaatatatatatataaaataaaataaaattcttcagcatcttcttatggcttggacctcagcctgatctcaagcccatggtgacctggccccagctcagtttctcccctgacccctgacactccagtcatccccagccagttcccgagacagaaaaccccccaggaacattctgtcatgatcattttaggacgggaaggtcctttggagaccccatctgggcccatgattgtacctttacatttttccccggtgcctcctgtgctgccaacttggaaactcctggagcccatcccccagtgggctttccacgtgctgcttcctctgcctgggtatgccttcttccttgcccaactggcaaactcctattcatgcctcaagacccagcaccaaactcctctgtggaagagaattgatttcttccttctctgtgtcactctacctagacggttgacattccttgctgtgtattgccagtatgtgttttcagtgaagtctcacctatcaattagggttacgagctctttaaatgctgggatgggatgggcgcggtggctcacgcctgtaatcccagcactttgggaggccaaggagagcagatcacctgagatcaggaattcgagaccagcctggccaacgcggtgaaacgctgtctctactaaaaatacagaaattagccgggcatggtggttcgggcctatgatctcagctatttgggaggctgaggtgggagaatcacttgaacctgggaggcagaggttgcagtgagccgaggttgcaccactgcactccaggctgggcaacagagcaagactctgtctcaaaaaaaaaataaataaataaaaaacattaaaaaaagaaaaaaagactgggacagtgtcctctccattactctagccccatcgcccagcatgtgcccggcatgaaggcatggctcagtaaaagagtttggagtgggtaaagaataagcttgtaaccaaagaagtctttcaaccctacagaagagtttcctttaagggaagagaaaggcctcacccactactggcactgagaggttccccaagacacatattctctgtcccctttgggctactggtcctacctctatagcagagaggccaccatttacttttcttcttcttctttttttttttttttctttgaggcagtctcactctgttgcccaggctggagtagtgcagtggcacgatctcggctcactacaacctccacctcccaggttcaagcgattctcctgcttcagcctcctgagtagctgagattacagctgtgtaccaccatgcctggctagtttttgtatttttagtatagacggggtttcaccttgttgcccaggcttgtcttgaactccggagttcaagtgatctgcccgcctcggcctcccaaagtgctgggattacagtcatgagccaccgtgcctggccaccatttacttttctcggtggtttggcttgttttggcttgcgggtataggagacacactgggtgggaggtgggggtacgttctatacgtgctgatttaatcgtttccgatctggggacatttgaaggatgccagcaaggccccctgctgaaaactatgctccctaccctggtgccagggctgaaaatttcagcactagacatcctcttctctctccgcagtccttctataatgtattatcaggggccacagtgagagtctggggccctcccagctttccccttatgtccccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgcatacaaggtagggacacagcccacagcccacaagggcagaatggcctgaagatgcagatcaacttacatattcctggggtggggagaacatgggcacgggaggtggaaaacctaagctccagccccagctcagccatttctagctgtgcaacccaggagaaatgatcaatctctctgagccagcctcggtcccactcacctctgggaccactgtgagcacccagtgtggcccttcttcatggttcagtgctgtaaaccaaacctgcttgggatttctctggctcctttaacttcaggcacctcagcgagatttttaaaaatcctccctggctccggtgagcctcagccagggggaatgagcctggctctctcaatacccagggatttgtggcagagcctcggccaggcagtagctcctgggtcaggtctctgtccagaaagctgggtcatgttcttggccggaggtggcctctggcagtcacaaacacagcacagccggcgtctctgggacgtgcctgctgtgcctctcccagcccctacttgtcaaggtgagtgcactcgattccctggttccacagacccttcctggacatctgttggtaaagtctgagagttcactctgctccatcagtggtcagccagcataaacagccaggctccaggtttctttatttatggaggacttggatcagagattttgtcttggactctgggacatttattaaaatgtcttggtttgggctcctgccagagaggccccagctgcctctgatcagcaacaaagctgcccatagtctgtgctgccttcatgggtgaagtgtgcccgagcggttctcttgaagctagggaagggtggggatgggaccccagccactggcaggcacccatggcagtctctggctctggaacacagcaccctttgtaggaggtgggagctgagagggccccatggctcgtcacatgcagattctcattttagatgaggaaaccgaggtctaaagagagaaaaggacttgcccaagtcccaaagccagatgggaacctggaacccctggctcccatctgtacaatgtcaataacagagatgtgacaattaaatgatgctttgcagtcacagggtctgctgatatggcaactgtttgttgcctacaaaggtgcaagtaagtgtccacagtaagtgctcaacagggcttcactgaccccgatgcttatcaaatagctttcagtctaatatcgacacctctgcccctgggctccagggagagatggccagacagccatctgggattccattggccacccccagacgggatgtgtctcagccttggggagggctgcctggctctgccagtggctccagcatgtcccctctcctgggtgctattatgcagacactgctggcagccacaccgaggttccatcctgctgccgccagggtggtgatagcaagctctttaggtggtggccaagactgtcacagtggattatagtcctggccatgtcctaaatctttcataagctctattgcaggcaccagaaaccattcaggaggtggggtgggggagcgaaacaccaataaaagtcacacagatcaaaccgggcaacatctgttaaggcaggaggcaccaggccgtgctccatggggtctggggacaggcttgttgcttgtgtggattcaggaggcagagtgaacaccagctcctcctgtgatgttctcccttgcctccctctgcccgtgattcaccagaggctgtttacctttggtccatggcccttgcagtccctagagaaattcagaggctccatgatattggatgggaaaaaaagtacgtttttcttttcccttcttccctccctcccttctttattttattttatttttatttttatttttgacagttcttgctcagttgcccaggctggagtggtgcagtggcacagtcacagctcactgcagcctcaacctcctgggttcaagagatcctcccatctcagcctcccgagtagctgggaccataggcatgtgccagcacacccagctaatttatggttttggttttttttggtagagacagggtttcgctgtattgcccaggctggtcttgaacttctgggctcaagcgatccaaccttcttggcctcccaaagtgctggtattacaggcatgaaccactgtgcccagcctcaattttattttcataacctcaactcacatttagcatttccttcaattatgaatgtaggcagcaaatggctgtcatatcagcagaccctgtgacttcatggctggcaacagaaatcacagatatcttcatatcacgttagagttcttcctgatgtctcaaaaatatcctatatgctgatcactacttcaaagttacaatgatagtagaactggcatcttgtttcttaggctgctactgaggaagcatgcatattgtctcacatttttccttttttttttttctttgagatggagtcttgctctgtcacccaggccggagtgcaatggtgtgatttcggctcactgcaatctccgcctcctgggttcaagccgttctcctgcctcagcctcccgagtagctgggactagaggcgcgtgccaccatgcccggcgaacttttgtatttttaatagagatggggtttcaccatgctggccaggctggtctcgaactcctgacctcgtgatccgcccacctcggcctcccaagtgctgggattacaggtgtgagccatcgtgtctggccacatttttctattatttgataactgtgcttgcaggataattggtttcctttggaatcctgtgcattttcttgtatgcagttaaaggcattactttgaccaggggtccacagctgtactagtctaccaaaggggtccgtggcacacaaaaagttaagattccctattttaaaccagtaattaacagcaaactccctctctctatgtcacataaaaatagaagctaatttctataacagctactcctccttcatttagctgccttgaactcttggtgctcagagcttggatctgtgctaattccattttttaacattttcacttgatttttttttttttttggtcagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccaggtcagtgtctctcgctcctgcccatgatcttcctgttcacatgggcaacccaggtcagtgtctctcgctcctgcccatgatccccctgttcacatcggcgacccaggtcagtgtctctcgctcctgcccatgatcctgacagcctctcttggagttgggcctaagaagcagacaggagtttgccacgttcctaagctcccatggcttgtctttgtttttaccaggggtctccaggggcaaaggccctgaacaaggctcaaaggctctggcagctgtatcagggctgggcttacagatgcccctcaggtttaaaggtgccacccttggcagaatagccagtctcactgtgatgtaagtttatatatatcacatccttttgggtttttaccgaggcttaataatacatacataggaaaaaatatatatatatataatgaatatatatattgggttttgtccacaattcctggctcataactcctaaaattcttggaacctccaaaatgctgtattttgtctgataggttcagggtggggctggtcaccagaaagactaaggtaggattagagggttgggactttcagctccacccctccccgcaacctccagggaggaaagaggggctaaaggtcaagctgattacccacggctgatggtttaatcaatcatgctcatgtaatgaagcctccgtaaaaccccaagaggataggcttcagtgagcttctacatagctgaacacatgtaggttcctagagggtggtgcctaaggagggcatggaagctccgcaccccttcccccacaccttgccctgggcatctctatctgtatcctttgcaatatcctttatttaatttaattaaattaattaatttatttatttttgagacacagtttccctctgtcgcccaggctggagtgcagcgttgcaatctcagctcactgcaacctccatctcctgggttcaagcgattctcctgcctcagcctcccaagtagctgggattacaggtgcccaacaccatgcccagctaatttttgtatttttagtagagatggggttttgccatgttggccaggctggtcttgaacgcctggcctcaagtggtctgcccgtcttggcctcccaaagtgctgggattacaggtatgagccaccgcacccggtctgcaatattttttatgataaactggtatacataagtaaatgtttcctcaaggtctgtgagctgctccaggaaattaatcaaactcaaagagtttgggtataatcaaacccaaagagggttaatcaaactggaagccagttggtcagaagttctggaggcccagacttgcaactggtgtctgtaggggggtggccttggggactgagccctcaacccgtgggttctgatgctatctccaggtggaatggaattggagggcacccagctggtgcctcctgcttgatggtggggagaaacccctacaaatttggtcacaggagtcttctgtgtggatgactgttactgcggtgtgagagcagaggaaacacaccatttaggtagagtttttttctctacacgctcacccactggggatctttgataaatgtaaagctcctatgaacttccaatgaatctggggttggaggaagccaagggttgcagcagggctctttgtccggagatttgagctcgaagcaacgtctaatctgggctgctattctttggtatatttgggtaggagatggctttgttccatatgttaatttgagctgaaatccattgatccccagcgtattcactcaatctgagagtgagtgaacagatccaagatgaagagccaatatcaagaagctgtgcaggcctcttagaaggcctgatgagagtttgagactgggccttggttgagggtccaagtttggtatacctaaacttgctcaactgcataaccgacaacattagacagaacctagccttttgtgaaaatgcagtcagtacttgctagcttcatcacatgaggatgattcagggccacccaccaggatggtgtctgctgaggagttttatcattagcggggatggattgggcccagcacatccatctttgctgtcttcgggattaggttgctgctggtagtcaagcagctgaggttaggtgcatgagatgtgacccagcctggaccaaggtcaaccccccaaggctggctttggtagcaatctgcacaatgagagtactaggctcaatgcacccaaggatccttccagaaatcacgccacacagtttgagattctgttttctgaaaccaccatgccacatggactgtaaattatggagtagcctgagttgtcaaagccttaatccctattctccttcacctcttcctcaaataccatttacaataatcctgcaatttgagtttctgttttagagaaagaaccataaactactcaaccagttctaattggatgctccctgctgaggaaattacattttccttttccatctgcagaactgttgggaatcaaagagctttccaaacctgcctacggggatgccatggtgtgtcccccaggggaggttccagtgttctggccttctccgctgaccagtctcggagctgtcagcagctgtggtacgttgggggataatgggacaatcgatctgccctaggatggagcccagtggggtctagttcttgaaagcatattctcgtagtacaatgatttaaaaataaagccatgaaacaaaacacaaaacagaggcctacagctacagtgaatctctctctggtttccttcttttatttatttatttttttttgagacagggtctcactctgttgccaggctagagtgctgtggtgcaatctcggttcactgcaacctccagctccctggttcaagcgatttttcagtctcagcctcctgagtagctgggattacaggcatgtgccaccatgcccagctaatttttgtatttttagtagagacggggtttcaccatgttggccaggatggtctcaatctcctgacctcgtggtctgcccacctttgcctcccacagtgctgggattacaggcgtgagtcatcgcgcctggcctggtttccttcttttaatcccagggctggatctccttaccagagcactttgtcttacaactcaatttttttgtcgttggttttttggttttgttgagacacagtctcactctgtcgcccaggctggagtgcagtggcacgatctcggctcactgcaagctccgcctcctgggctccagcgagggaggtgtgcctcagcctcccaagtagctggaattacaggtgcatgccaccacacctggctaatttttgtatttttagtagagacgaggttttgccatgttggccacgctggtcttgaactcctggcctcaagtgatcctcccacctcagcctcccaaagtgcttggattgcaggcatgagccaccgtgtccagcctcaaatatgttttgattaaatatatttccttccttccttcccttcttctttcttctttctctctctctcccttccttcttgtcttgtctttctttctttctctttctttctttctttcacagagtctcactctattgccaaggcttgagttcagtggcatcatcatagctcactgcagcctcaaacctctggggtcaagtgatcctcccatctcagcttcccaggtagctgggactacaggcatacgccgccataccaaaccaatttttagaaattttttgtagagatggggtcttgttacaatgtccaggctggtctcaaagttctgggctcaagtgattctcctgccccagcctcctgagtcatagggataacagcatgagccattgcttcagccgttttgattaaatatatatttttatctgctgaagcatcccagcccattctagcaggaggactaacctttagcttggctttttgagacattttggagattgatggggccttgaaaacaaaggtgaagccaagaaatataactaaacaagtcatttcctgtggtatttgcaaggtgattataaacaaggccagcagcagtacattttttccaaggcctaggtgatattacaatgaagagacacacgagggcgccctcgctagctctcagtaagataggaaggtgacagaaacatgaaaaataacagctattgcagaccatggtcatggacactggaaaattctggccaggccagccacacttgcgctgtaagcacatactgtagtgttactttaatttattttgaaagcattcgtgagagttcagctatcagaatggcctcatgcgagggaaagatcatccctaatgtggtgatgaggcgtggctgccaagatccacaggattccatttgttcatttatttaagtgcatgtgttgagaacctgctatgtgccaggcatgcacccaggcctcaggagtacagtgctccatgggacaggatggagtcctctgggcgctcatggtcttgtctgagtgtgtgtgtgggcatgtgtgtagacacacccacccacgtgcagtaaacgtcccccagcccagtggcctcaccgctttcccaccatcggtcgtggcaggtgccctgcagaggagatctcactgctgtgggcaccccagcatggcatgttccagtcctttagttctgacagcgatagcacaattgatcgtagatgagaacaaatgacatcagagagggacaatcttgaatcattctcaaattccctttttttttttttgagacaaggtctcgctctgtcacccaggctgagtgcagtggcacgatcacagctcactgtagccttgacctcctaggctcaagcaatcctcccacctgagcctctggagtagctggactacaggtatgcaccatcatgtccagctaatttttaaatttttgtggagatggggtctcactatgttgcccaagctggtcttgaactcctgggctcaagcgatcctcccacctcagcctcccaaagtgctgggattatagtcgtgagccaccatgcctaccttgaacttcaatatttaaacttctattagcaatagattatgtgcaacagacctcacaactgatgggggcaaaaccccgtgtcatgctctgagctgactgttctgacatctacctggttttggagtgaccagttttaggtgccatccaaaacacagacaagcgataattaaattcatcatcagattcaagactttttccccttacacatcaaatctaaaagttatgtatctattagatttttattttgaagtgctggctgactctttctattaaatatgaaactttaagccaagtgtggtggcttacgcctgtaatcccagcactttgggaggctgaggtggtcggatcacttgaggtcaggagttcaagaccatcttggccaacatggtaaaaccctgtctctactaaaaatacaaaaattagccaggcgtgatggcacacacctataatcccagctacttgggaggctgagaattgcttgaaccccagaggcggaggttgcagcgagctgagatctcaccactgcactccagcctgggtgatagagcgagactctgtctcaaaaaaaaaagaaactttattgtttctgtgaaatccaagatttatttactcaattcacatctgcatttgttgaacacctattatgcgcaaggccctctgtgggatcctgagatgaatgagcaatggtcgctcttctccaggagcatacaactgagtagagatgaatactcaaagatagtaatgacactgaggaaggcagaagaggtaaatagtatggtattaagcacttaatgagctaggcataaggaactaagaatgagtaagatactacgtggttcaggccaggctctgtggctcatgcctgtaatcccagcactgtggtaggctgaggcaggaggattgcttgagcccaggagtttgaggccgcagtgagctgtgttgcaccactgtactccagcctgggcaacagagcaaggccttatctctttaaaaatatatatagatgaggctgggtgcggtggctcacgcctgtaatcccagcactctgggaggctgagacaggaggatcacctgaggtcaggagttcgagccagcctagccaacatggcaaaaccctgtctctactaaaaatacaaaaattagccgggtgtagtggtgcacgcctataatcccagctactcaggaggctgagacaggagaatttcttgaacccgggaggcagaggttgcagtgagccgagatcgcaccactgcactccaacctgggcgacagagcaaggttccgtctccaaaaaaaaaaaaatatatgcttgttcaattaagcaaaccatcgagggcttactctgaaacaagcactttgctgaacactttcttaaaaatttattttttttttttacatttttaaaccacgagtatgctaaacactttttttttttttttttttttttgagataaggtcttgctctgttgcctaggctggagtgcagtgacgtgttctcagctcactgcagcctctgcctcccaggttcaagcaattctcccacctcagcctcccaagtagctgggattacaggcgcaccaccaagctgggctaatttttgtatttttaatagagacagggtttcactatgttgcccaggctggtcttgaactcctgacctcaggtgatccaccctccttggcctcccaaagtattgggattacagccgtgagccactgcgccctgcctgctaaacacttttatgtacgttttccagtttcgttctgacaatagccatatgaggcattatcattacagtcaaagaaacaggtttaaagaataaagtcgggctgggcgtggtggctcacacctgtaatcccagcactttgggaggtcaagaggggaagatcacctgaggtcaggagtttgagaccagcctggataacatggtaaaacactgtctctactaaaaatactaaaattagccaggcgtggtggcgggtgcctgtaatcccagctactcaggaggctgaggcgggagagtcgcttgaacccaggaggcagaggttgcagtgagccaagatcataccactgcactccagcctgggtgacacaacaagactccatctcaaaaaaaaaaaaaaaaagaataaagtcaataaagtcacatctcaaattccagtatattcacaatgctaaaaccagttcttaataactatgctagagtgtttcacattgcctgaaatctaacaaaggagagtctttaaagaataaaattaacataaatcaaagcaaaatgtaagtgccataaggaaaaatagaaacgatgccataaggaaaaatagaaatgatgctcacagagggttccaaacctaacatttgctggaaagcaaagcaagatggcttcatgagttttaagaatccagtaaacacttcctgatatccatgggttaaattgatggaatcgcctagagctctagctatagctgtggctgtatctcacttcttttcaacccatattcaactcatctttactttcctagagattagaggcaactgtttaaatggaacttgatgtagctataaaccagcttattctgaccttggtgccagcaggtggtatagggagtgcttaggctgagttgatggccaggtgccatcttgcctatcaacagtgggctagatgagggtaggctggacttgatgaagtggctgggctcagaccctcctgctgtgtgttttagagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccaggtaagaaacaacacatttgctcggcatagacccaggtaagaaacaacacatttgcacctggagaaaatcaccttttcagtgaaaaaggtgggatgcaaaatgtatccacaggatgattttttaaatgttgatactgcatataaatctcaaaaagactagaattaaatacaccaaaatactgacattgatggtctctaggtagtggtattgtgagtgatttttgcttactttctttttctttctttctttctctttctttcttttgttttctttcttttctttcttttttttcttttttttttgagacagagtcttactctattgcccaggctggaacaatggcgtgatcttggctcaagtgattctcctgtctcagcctcctgagtagctgggattacaggcacgctccaccacacctggctaatttttgtatttttagcagagacaggatttcaccatgttggccaggctggtcttaaactgctgacctcatgatccgcccaccttggcctcccaaagtgctgggtttacaagcgtgagccaccatgcccagccttgctttcttctttatggctttttatttatttatttatttatttatttatttttgagatggagtctcactctgttgcccaggctggagtgtggtggtgcaatctcaattcactgcaacctccatctcccgggttcaagtgattctcctgcctcagcctcctgagtagctaggactataggcatgtgccaccccacccagctaatttttgtatttttagtagagtcgaggtttcaccatgttggccaggctggtctcgaactcctgacatcaggtaatccacccatctcggcctcccgaagtgctgggattgcaggtgtaagccaccatgtccagtagtttttggctttttcttgttgttctaaactttaacactaaacgtgaggaagttcgttgagtttatttgctgggcatgttgccagccagaagcagatggggttaggtagtaagaaaaaaagagagaatggtttctaggtaggcaactgccaccattaaaaaaaagttatttatgtagtttattattattatttagagatgggggcgtggtgtctcactatgttgcccaggttggtcttgaactcctgggctcaagtgattttcccgcctcggcctcccaaagtgctgggactgcaggcataagccacctagcctgtcctctatggatttagtgatgtccctaatctccccctttagtgccattgccctggggttgggcatggaatagattagttgtatactggatagcagggatagtgatggggtaggattacttctccggggatcccagtggggcaggaccctacagccacagcctcacaacagtttgcagtcaacttgtatattgtataacgcatctcaggggaaggatagcccttctgtggctttggagccactggccttctgtacatgggagagggctggtgggatcccctaggggacctgctgattccaattagttattttattttattttattttattttttattttattttattttatatttttatttatttttatttttttattttagtttagtttatttattttattttattttattttttgagacaagatctcactctgttgcccaggctggagtgcagtgatgcgatcttggctcactgtaacctccacctcctaggctcaagcaatcctcccacctcagcctcctgagtagctgagactacaggccggcaccaccatacctggctaatttgttgttgtatttttagtagagacggggttttgccatgttacccaggctggtctcaaactcctgagctcaagtggtctgcccacctcagcctcccaaagtgctgggattacaggcatgagccaccatgcctggccctgctgattccaattagaaagaggtttgctaaaagctggttgaggggcttttaacttcctgctatgtcttcatttaagggctgaatttctaatcccaggtggccagcagggactgcagtttcacctgccattgtgtgtggtaaatccctttgttggcaaacactcatgagagaattacggtgtagcccatacctcagtttcttcatcagcgtaacaggagtgatgacaattatgcctgcctctctgggttgtgatgcatgataaggataatggtgtcacctaccaagttatactgtgccaggcaacaggctgcaagcatttatgcgtttcatcttattaaattctcccagtgactctacgtggaggcagctatgattaacttcatttaacaggtgaggaaactgaggcagataaggtacaaagactttccaaaatccacatacctagtaggtggtcagggcagaacttgaacccatgtctgctgacttcaagcctatgatttatacctgtcagctaaattagaatctcaatggaaacggtaagtcacagtcttgcctgggcagttgaaagagtgctctagcgactcctggttcacaccccagtccctcttctggaccttctcatgggccgtgctcctaaacctggggtacaaaccgcccttggcacctggaatgactggagaggagaaggcatatgtggcctccccaccggcccacctgactctcattccccagagtcaggtgggccagtgggaagatctaggtagctacctgcatcaatggtggccgacctccgtggagagctgaggggtgaggccagcctgcaaagcagcagtcagcaatctgggccagactcccagggcccagacaggactgattccagcaccagtttaaagcctacagcagctgggtagaaccccaaaacagacaggctgggaccttcccctgctggccagcactgtcacgaatctgacagtgcagaccagccctagaaatacctaattcttgggaggccgaggtgggaggatcacttgaggtcaggagttgaagaccagcctggccaatgtagagagatcctatctctagaaaaaacaataataataaaaattagctaggtgtggtggtgtcaaacgcctgtggtcccagctactggggaggctgaggtgtgcagatcgcttgagttcaggaatttgaagctgcagtgagccatgattgcagcactgcactccagcctgggcaatagagcaataccctgtgaaagaaagaaagaaagaaagaaagttggggggggggagggagggagggagggagtctgattctggaaggaaggaaggaaggaagggagggagggagggagggagggaaggagggagggagggagggaaggaaggaaatgtctgattctctcccctgggcctaggagcaaaagttgtcttccaatgacaggggcatctgtagtaactaaatttcttgctgaaccactggacatagctctttgcctgtttgtcttctgttaggttgttcattcattagttcattctgtagagaatgtggtttcctttacatataatcctatagtaaattaaggatataaacccaccacagatacacctcataggttatgctcatgactgtgtatacataaagtatcttacatagttgatcccctgggtggattttttttttcttttgagacacagtctcactctgttgcccaggctggagtgcagtggtgtgatcttggctcattgcaaccgccacctcctgggttcaagcagttcttgtgcctcagcttctcaacgtagctgggattacaggcatgtgccaccatgtctggctaatttttgtaattttagtagagctggggtttcaccatgttggccaggcttgtctcgaactcctggcctcatgcaatctgcccacctcggcctcccaaagtgctgggattacaggtgtgagccaccgtgcccagccggatttttttttttttttttttttttttttttgagacaggttcttgttctgtcctccaggctggagtacagtgatgcaatcataggtcactgcagcctcactctccagggctcaaggtaccctcccacctcagcctcccgagtacctggcactacaggtgcgcaccaccatgctgggctaatttttaatttttttttgtagagatggggtctccctgtgttgaacccctgggttcaaacaatcctccctcctcagtctcccaaagtgttgagattacaggcatgagccaccgctcctggtgctctgggtgggtatattttttaaaatttctgccataccttctccttcacaaacattcttacccaagctgatggctctccatttagcacagagtcatgagggaagatgaattattaactctaccattagctcagattaaaaaaaaaaaaagtaattgggaagtaaatttattgcagatgtggtgcacccattgcttaataaaacaagctaagaggtcagccacaaacaccacccatcaatgctgtgcagactgcaagacaaagcttgaaggatgaggctgggggaggcagatttacagctgttggatgtgttgatgtcatctgttaaggaccatctttaatcctcaagaacaacagatgcttttgatccccactatattaaataagcagatagaagattcataacagcatcttgagcgttactcactggacataataatagacccacttagtcatttttgagaggatgttggcttgcatttgaggtgcctggggaatatgaagggatatagggtttatagtaatgatttttgcactgatgataaaatcatcataaatgtatttaccaatttacagttgaccaagttctcactctcctcttctccctttggagctcaccatgccctaggaagtaggttacatcccaatttttttatttaaaaatgttgttattcttctcctcgccccccctttttttgagacagagtcttgctctgtcacccaggctggagtgcagtggtgcgatctcagctcactgcagcctccgcctcccaagttcaagtgattctcctgcctcagcctcctgagtaactgggattacaggtgcacaccaccatgcccggctaatttttgtatttttattagagacggggtttcaccatgttggccaggctggtctcaagctcctgaccatggatcaggtgatggatcaggtgatccatctgcctcagcctcccaaagtgctgggattacagatgtgagtcactgtgcctgacctaaaatttcattttacaaatgttccactattttattaatatgctgttatttaataccataaacaatgctgtaatgaacatccttatgactaagtttgtgaacatgcccatgatgactttgttaggaacagtgggcacgagaagtgactcgctggctccagtggaatgcacaaatctaagacagaaatcaccctccagacagcactgctccagtgtccactcctcccagcacactatgtgatgggccatgtccctgtgaccctcctacatctggactacctcccattctccatgtgggaaaactgaggctcagagaggtcaaaggatgaggccaggtcacacagctacgatatgccagcatctggactggaatgcaagtttcctggttctaaatcaggaactgttcctccataacagaaatccaaaccccatgtcttcttcttctttttttttttgagacagagtcttgctctgtcacccaggttggagtgcagtggtgcgatctcggctcactgcaacctccacctcccgagttgaagcgattctcctgcctcagcctcctgagtagctgggattacaggcacccaccaccatgcctggctaatttttgtatttttagtagagacggggtttcactttgttgaccaggctggtcttgaactcctgacctcgtgatccacccacctcaggctcccaaagtgctgggattacaggcgtgagccaccccgcccagccaaccccgtgtctttcatattctccaggcacctcaactataagccagcgtcctctcacgtcccttcagtccactgctgatttcagccaccgccagagtagaagttctgtgtcccacacactgccttcgcgtgcactgttttgctctgagatgacctgaatgtagacaaaggcacaatgggacctcatgagggcggctgcctggcttggtggccactggtgggcacctgtagcacacaccgcagcttccccactcgtatcctctgggctgcctgggttcacctgcatagaattatgggcggctcccagcacgacagcctcttaccataggctcaggtctctgctccatctgaggatgccctctgtccctccagagtctccctcatcacagcaggcacagcttggtagtgcagaggactcaacgccctaataggcaggtgagtaaatgcccagtctcctgtcctccgaggaccccacagtttcttagagaatctcaagctgtgctgagccccagttgcctttgaagttaacttgctcactcacaatcctttactgtttttttttccgctttccccatcttctcacttgcatttcctgggatcacctcccactgaaatacttgtgcccaggtccttgtgtcagggtcttctttgagggaatccccagctaatggtgctgtctgtaccatttcccttccctcttatgttttccctgtattagttagggtttgctagagtgctgtaacctagaagccccgggatgctttgctcaaatacagcagaagtgtgttcctctctcacacagcaggccagggtgggtcttccagggtgagtgtcctgggtcagcagaaggggatctgctccactcagtcactcagggaccctgcaggtctgccgttacatcctgtgacccccaggaggttctggctgtcaatactccagctgccaggaaaagggaacgagcttggaggtgtgtgttggaggtgcatgccaggcccagaggtggcatgcgtcacttccatcacgatccaatacagagaacccaatctcgcggccacaccagactgaagggaggctcctcagccatttacccctctgtccttcactgctggggtcagggggcgggggtagaatacactgtggcaagcaatttgcagtctctgccacagccctcaaaaaaacaaagcaaatgaactaaaaacccaaactactcttactgtaaagtttctactttaaaaataatcacttttggctgggtgtggtggctcacgcctgtaatcccagcactttgggaggccaaggtgggaagattgcttgagcccgggagtttgagaccagcctgggcaacatagcaaggtcctatctttttaaaaaatgccaaaaaaaattagcgggctgtggtggcgcgtgcctgtagcccagttgttcaggagggtgaggcgggaggatcacgtgagcccaggagtttgaggctgcagtgagctgtgatcacgccactgccttccagcctggatgacagagcaaaaccctatcataagtaaataaatacatacatacatacatacaaataattttaaaaatatagttacttttacattctatttttgtcatttcagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtaagcagtgagatgggcttggtccatttccccaaacgggctttgtggacggaggctggagggaatcagcatctgcagtacagagcattctccttccagctcagaacaactccgttgtaagctgcatagcttgatttcatagacgaagagactgaggctctgagagatccaggggattttcccaggtggaaatggtgagctggaatttgaacttgggtccaccaggctccaaagcatgggatccttcctgcacacctgctgctgtccctttgcagtgtggggaatgacctgccgagtattcttagcaatccggggcagccctggaccaccagagctggggagagtagtggagtatgaagtggctgaaaggctcagacagcagtcccacctggtcgtgatgggcagggctgcacctggagcacccaggtgggcgttattgctgtaggtgttggagacgcgaggctgtaattccactatccgtgtagccagatcagcgtcgggctcaatgtgaacaaccgctgctcacctcacctccatcctgcaggaagtgttatcaggcatgagctggaagcctggtgaatctcacctgcctcccgctaccgatcgctctgtgtccctcaaaatgcattcttcagaggtatgttttttccttttagcattcaaaaagggctttaaactcagtaaggcataccctaaagcacccattatgtcagaagtttccaaaagcctgtgtctgtacgtgtagaatccacttcatgcaacaaatgtgtgttgagctcgagtatgtgccaggcactctgttaggttctttttttttttttttttttttttttttgagacggagtctcgctctgtcgcccaggctggagtgcagtggcgcgatctcggctcactgcaagctccgcctcccgggttcacgccattcccctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctctgttaggttcttgagatccacccgtgagcaaaactgacaacagtcctgcccccacggagagtatcttccagtggagtgtgacagacaagaaacaacttgtaagatgaatgcacagtgtgttcgagtgatgatgccatggggaaaatggaccaggatgaggagactggagagtgaggggctgggcggtggcagcagtggggggcagctgtcactttacacagaatggccaggaagacctcctggaggaggtggcctttgagtccagaattcaggttgatgatgagggcgtgaggcttgggctggctgagggaagggcatcctggactgtggcagtggctggggcagaggtcattaggtggagtgggggcccagtgggtttaagagaggatggcatgctggctgactggcctggagtgaatgaggaaaagagaagtgggacgagggacagagaggtaacagggaccagatgggacagggcctcgcaggaccctgtgggcagctgggcttttgttctgggtgagatggggagcctgggatttctctgagtcagggacagccatgttctgtgtgggttgtaagcaatcactggggtgcagagacaagggtggaaacgggagactggtgagttatggaaggtgggagaggaggacggtttggagtgggggtgcctcatggcacatcccttcagccgcacttctgatttcagctgccactgcggtggatgttctgagtcacactgacccgatgggaccccgccacaagctagggccctgcagggcctctccaaagccatgtggaatcactggctgatggcttcagggcaccctcaacccctgggggacaggacctgaggtgtaagtgacacatgctacaacttggatgaccctcgaggacatcttgagaagtagattaagccagtcatattgtatgactccacgcatatgacgtgcctagagtaggcaaactcacagggcagaaagtagaatggtggttgccagtggctgggaggagaggggaatggggagagttgtttataggtacaggggttcagtttgggatgatgagaaagttctggagatgaatgggggtgatggttgcacaacaatgtgaaatattttatgctactgaacgatacacttgaaaatggctaaaacaggccgggcacagtgactgtcttttggacagttccctgtcttttggagacacataggtcctggtggaactgacgccccactccctagagcagcaaccttgaaggtgcacgttccctccttcccagcctcattctccctgttccctcccacatgcttcgtggcaccatctcccaagagaccatctgcacccaagtctcaagttctggtttcaaagaaacccaaagagacaaaaagtacagatacagagggcagggggtattgtgagaagtagccagatgttgtatctattttgcaggtacagtcaacatgatttccagatggattgggtgtgggtgtgaggagaaggatcagggcttgctctaaggtttttgtcctggtaactgaaaggatggagttgctgtgaactgagatggggaagactggcaggtttaggggtaaatcaagagtccaggtttgacatttgcgccctgatggaaggattgtaaaatggtgcagatgctatgaaaaacagatggcagtggctcaaacaattaaaaacagcaaataccatatggtctagcaattccacttccaggcatataccccagaaaaaggaaagcagggactcaagaggtatttgttccctaatgctcatagcactttatttgcgacagtcatgaggtggaaccaaaccaagtgcccatcaatggatgaacagatagataaaatgtggtatataattattactcagccttaaaaaggcaggaagttccgacacatgctacaacatggatgaccctcgaggacatcttgagaagtggattaagccaatcgtattgtatgactccacgcatatgacatgcctagagtaggcaaactcatagggcagaaagtagagtggtggttgccagtggctgggaggagaggggaatggggagttgtttataggtacaggggttcagtttggggtgatgagaaagttctggagatgaatgggggtgatggttgcacaacaatgtgaaatactttatgctactgaactatacacttgaaaatggctaaaacaggccgggcacagtgactcacgcctgtaatcccagcgctttgggagaccgagacaggcagatcgcttgaggtcaggagttcaagaccagcctgtccaaaaccccgtttccaccaggacctgtgtgtctcataacaaaaccccatttctactaaaaatacaaaaattagccaggcgtggtggctggtgcacacctgtaatcccagctacctggaaggctgagacacaagaatcgcttgaaccctgacagtggaggttgcagttagccaagatcgcaccaatgcactccagcctgggtgacagagtaaaactgtgtctcaaaataaataaataaaaaggctaaaatggtgaattttgtgttgcacgtattttaccataatttttaaaagaatgcaggtttgaccctgttaggtatgaggtgcgtctattagacacacagtggagaagtcaaggaggcagttagtgatatataaagagttcaggagagcagcgtgggcaaggagaaattgggaggctgttggcgtgttggtgggctctcaagtcaaactactgggtgagagcactgtggaaataaatggaggcagagcaaaggacccaggattgcgtcctgggtctccctgtgttaagaggatgaggagaagggcagaacagccagcgagggagacgagaaggagcagcgctgaggccagaggaaaggcaaggggccgtgtttccgtagggcagagaaaggcctcgggaggaagggctgccgacggcgtagagcaccattcacaggccaacctcatttccatctgacaacggtgttgctgggtattttcagctgcccccttcccagaagtcactctgccctctctgctcacctgacagcctggcttggagacgcctgccagactccactcagagctgggtcttgtctcttgtcctcatgggagctcagagggtagaatttgctatattggattttacagaacttacattacatttgcatgaagaaagtaaaagcaatttggccttttaatgaaaattatttcagctccgtttttaataaccaaagcctaggaaaagttttaaagaggctgagtgcagtggctcacccctgtaatcccagcactttggaaggccaaggcaggcagatcacctgagctcaggaatttgagaccagcctggccaacatggtgaaaccccgtctctaccaaaaaatacaaaaattagctgcgtgtggtggcacgcgcctgtagtcctagctactagggaggctgaggcaggagaaccgcttgaacctgggaagtggaggttgcagtgagctgaaattgtaccactgcactccagcctgggcgacagagtgatattccatcttagaaaaaaaaaaaaaaaaaaggagttttaaagctgactaggcattgtcatttctttcctgtcttgagcatagacagaccatagctctttcttcatagctcagaagtgggaacctcatcttgcccagaccctcctttttggggattctcctgtgtcctttctcgtgtgttccccactttgggatacattatgttccctgccttcctggactccctggtattttttactagtatcctatatccttgatccaattttgaggcagtaagaaagaaacatcctttacttagcactgaccgtgtgcacgacggccagccaggtagttagcacacagcatgtcattgccctgtcgcggtagtcctgggaggtgggtgttaccccattttgtagaggaggtaaccaatggctgacatagcttgcccaaggtcacatagcaagggaatgatgtgacgttcccaccgagggctgtttggctctaagttcagccccctttccagattggcaggctgcccctcacagcacagggaagggctgggtcattcccctttgttgtgactgtcccccaaccccaaattgccagcttatggcttcacatgtagaatgtgttctgtgagcatcacgatgactaacagctacttgccttccccacttagatgtgggctgaggttagggaggggggatggggaaggagccacagtgagggatcctttttttttttttttgagacagggttttgccttgttgccaggctggagtgcagtggcgcgatcttggctcactgcaacctccgactcccgggttcaagtgattctcctgcctcagcctcctgagtagctgggattacaggcgcccgccaccacgcccagctaatttttctatttttagtagagacagggtttcaccacattggccaggatgatctcaatctcctgacctcgtgatctgcccgcctcagactcccagagtgctgagattacaggtgtgagctacgtgcccggccagtgagggattctttaagatttctgacaatgattcttgttcctcatgccaacttgccccattgacccactggggtggcagtggcagctcccaaagagctcaggggcagcagcatggcggagtagctgagggtgggagccgctgtctggaagctgcatttgcagtacaagcatgcagttttaacatgggtacggtgcctccttgggctggctctacgtgaggggtgtgaggggctgatgatggagattgaggagctggctgaagctcctccaaggctaccttggcagccatcctgggctacagagcagtctgggagctcctgcaggaccagctagaccataacagtgggtccaagacaccctgctcctggctccctgccgtcttaagctctgtgtgaagactttatctttggccagtgactatgctgggattctatcccaacctgctgtgagatagatcggttaatgaaaaccaagttcattttatcttattttgggatttttgtgtatttcccacatattctacaacaatacgtgttctttttgtcattagaaaaggtcctatttttaagaatcaaattcactttgattcacttttggaaatcactccaatataagtaagtatcccaaggcacagactctgggaatttccttcagttgttcttgaccttccctgaaggtatgcagggaggtagggagtgggtgagaatttggggtgagaattggagccatgaaactgacatatatacatggccttgcccaagttgtttggcatctctgagcctcagttttcctcatctttaaaatcgcgataatgatggttttttgggttttgttttttttttttttttttgagatgcattctcactctgttgcccaggctggagtgcagtggcgtgatctcggctcactgcaacctctgcctcccaggttcaagcaattctcctgcctcagcctcccgagtagctggaactataggcgcttgccatcacgccgggctaattttttgtatttttagtggagacagggtttcaccatgttagccgggatggtctcaatctcctgacctcgtgatccgcccaccttggcctcccaaagtgctggaattacaggcatgaggcacccgtgcccagcccatgatggtttttatcacatggaattgttgtaaaaattaaatcacagtggctggcgcactgtcaccgagggcacataaatgtatgctcagccctcgtgatggcagtgggccagaacaggccgctgttcccatggtattatgggcatcttacatgcagcatatttgttaggctgtgttagcccgattctgccctccacccccgtcaaccctagagtttacccaggaccaaaagtaaacttaaatatcctctgtgtcatggcctcggcttacctaacatgttctacagatagatgttgttcaacaacagtaatgatacccttcaaagaagcttttgaaaagccaacgtgaatttccaaaagccaacactagagctgatgtgtgccctgcttgcctttattttcaaggtgttctgaagacgcagatcccgatattaacttaccaaggtggatcagtggaagctgctcaggcattcctgtgcaaaaatggggacccgcagacacctaggtacgtatgtcgcatcccagtttaagtggcggatggtggaaacgcccatatgctcttcacttagccaacaaagtgtctgcacacccaagcccttcagagggagcgaagccatgagccaaggaagatgggttctcatggaccagactaacaaatgaggctggggggtttcaaggtatcctgggggcctcacagaacatctctggaagtaacaggtccctgggcagcagagagagacagcatatcttcctgatagaggggagacatagcactaaaaaaaaaaaaaaaaaaaaaaaagtttctcagtctcaaactgtgggtcatgacatgttagagaatagtgaaatcatttcagttagggtatccagcacctttggaaaatgaaatagaaatacagcatcattgtatatcttgtatagtaatggcaagtactccctcataagactgtgtacatgcaagtgtgtgtatttcttactgtgtgttatggtcaaactttttttcttttagggggtggggatggagtctttatctgttgcctaggctggggtgcagtggcgcgatctctgctcactacaacctccgcctcccaggtgccagtgattctcctgcctcagcctcccaagtagctgggattacaggcacgcaccatcacacccagctaatttttctatttttagtagagatggggtttcaccatgttggccaggctggtctgaaactcctgacctcaagtgatccacccaccttggcctcccaaagtgccaggattacaggcatgagccaccgcgcctggccgctaatttttttatttttagtagggacggggtttcgccatgttggccaggctggtcttgaactcctaacctcaggtgatccacctgtctcagcctcccaaagtgctgggattacaggtgtgagccactgtacctggcctctctgaactgttttttaagcttacacttcagtggcgtaaaactacactcacattgctgtacagccatcatcaccatccatctgcagacctcttttcatcttgcaaaactgaaagtctgtgctccattcaaagataattctccatctcctcctcaacccagcctctggcaaccacaattctactttctgtctttatgagtttgactattcgaggcaccttgtgtaagtggaatcatccaatatttgtccttttgtgactgcttatttcacttagcataatgtcctcaatgttcattcatgtcacagcatgtgccagaatgtcctgcctttttaaggctgaataacattcccttgtgtgtatagaccacattatgtttttgcattcatctgtcagtgggcactgggtttgcttcctgctcttggctatgctgaatactgctgctatgagcatgggtggacaaataactccttgagtctttcacttctcctggacatacacatagaagtgaaattgctggatcatatggtatgttctatttttaattttttgaggaatggccatactattttatatagcagagttgagatttttgaaaaacactgtcttggaaggattgagagagatgtaaaagtacaatatgcatattcttttttttgagacagaatcttgctctgtcgcccagtctatagtgcagtggcacaatcttggctcactgcagcctctgcctcccgggttcaagtgattctcgtgcctcagcctcccaagaagctgggattacaggcacccgccaccatacctggctaattttttatatttttagtagagactgggtttcaccatgttgaccaggctggtctcgaactcctggcctcaggtgatccacctgcctcagcctcctgaagtgctgagattgcagacatgagccactgtgcccagccttttttttttttcccccttgagacggggtctcactctgtcacccaggctggagtgcaatggtgtgatcttggctcactgcaacctctgcctcctgggcccaggcgattctcccacctcagcctcccaagcatagctgggactacaggcactcgccaccacacctggctaatttctgtatttttagtggagacaaggtttcaccatgttgcccaggctggtctcaaactcctgggctcaagtgatctgcctgcctcggcctcccaaatggctaggattaccggtatgagccactgcgcccagcctgcatgttcttaaattggattgtcaaaacagtagtcctgctagtaatcatagcaacaataatcactgtaaccaacactgactgagcactgagtaggttcagggcttcatgacaagcgcctcctgtgcattttctcatgtttccctttgaacactgtgtgaggtacacagtgtggtcatgtcaccctacagatgcagaaaatgaaggttagggaggttaagcaatttgcccaaggcccgtggcaggaggacctggaatcagaacccagatgatctgctgccacagcccacattctgaccactataccatctgtgccccttatttctctgtttctatctaaagaagtttatctttgtgttagactcactccttttgtattttgagcccttttccttctgttttgtgtctgtaaactgaacaagatcctggaaggggccagcagcaggccaatagcagccaatactctcagcctcttggcctggctatccctgctggacaaaggggatctgagtgggcaccagcaatgttcccatccccatagcaaccctgaccattggcctcctgcttttatagcctctgaccctactaaagaaattgctgaggattccaatgctggattttttttttttttcaagacagagtcttactctgtcgcccaggctggagtgcagtggtgcgatctcagctcactgcaacctctgcctcccgggttcaagtgattcttctgcatcagcctcccgagtagctgggactacaagcacccaccaccacgcccagctaattttttagtagagatgaggtttcaccatgttggccgggctgttctcgaactcctgacctcaagtgatccacctgcttcggcctcccaaactgctgggattataggcatgaaccaccatgcccagccccaatgctatatcttaaactgacttaatagactagtctccagcacaggtcctggcccagagtagatgtgccaccaagttctgcaggaatgaaggaatcaaagaaaaaaagaagcgtctttcgcgcaaacacaagaaggcatgacccagcaaagcagccacctctccataggaccctctgacctctgacctttgcttcccggcagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtaagtatggagtactggggatgcaccaagaacgtggccccatgaagtgtcttttgttgttgttgttgttatggagtcttgctctgtcacccaggctggagtgcagtggcacgatcttggctcactgcaacctctgcctcctgggttcgagcaattcttctgcctcagcctcccaagtagctggaattacaggcatgcaccaccacgcctggctaatttttgtatgtttggtagagacgaggtttcaccatgttggccaggctggtctggaactcctgacgtcaagtgatctacccacctcagcctcccaaagtgctaggattacaggcgtgagccactgtgctcagcctaagtgtgtttttattgactattgaacacacgaccagaaagagttatgtggggaccatcattttccactgcaaagacggtctttgttcattacggttggtatagacactaatgacaccaccatttagaaatccaacatcctcacaagcaagggagggaaagcatattctatttgcctgactctaaagtaataaaactaatattaaagtaatatcaatagtaaaattgaggcatggcatattattttggtcatataggacagaatgtaccatatattattttgtgaagcatgttaatttaaaaattatctaatatatgattaatatttcaattttttttttgagacagagtctcactctgttgcccaggctggagtgcagtggtacaatctcagctcactgcagcctccacctcctgggctcaagcaatcctcccatctcagcctcccaagtagctgggactacagggtgtgctaccatgcttgggtaatgtcacgtgcgtctgtgtgaagagagtccacaaacaggctttgtgtgagcaacaggctgtttatttcacctgggtgcaggcaggctgagtccgaaaaaggagtcagcgaagggtcgtgggattatcattagttcttataggtttgggataggtggtggagttaggagcaattttttgcgggcagggggtggatctcacaaagtacattctcaagggtgggggaggatattacaaagtaccttcttcagggtgggggaggatattacaaagtaccttctcaagggtggggagggtgtatcttacaaagtacattcacaagggcaggggaatatcacaaagtacattatggcaagggcggggagggtgtattgtcacaaagtcaattgatcagttagggtagggcaggaacaaatcacgatggtggagtgtcatcagttaaggcaggaactggcattttcacttcttttgtggatcttcagttgcttcagcccatctagatgtatacgtgcaggtcacaggggatatgatggcttagcttgggctcagaggcctgacaggtaactttttttttttttgagatggagtctcactctgttacctgtctcaaatgcagtggcgcaatctcggctcactgcaacctccgcctcccaggtttaagcaattcccctgcctcagcttcccgagtagctaggactataggcgcatgccaccacgcccagctaatttttgtatttttagtagacatggggtttcactatgttggccaggatggtctcgatttcttgacctcgtgatccgcctgcctctgccttccaaagtgctgggattacaggtgtaagccaccatgcccggctgcttggctaacttttaaacatttttttggtagagatgaggtctcactatattgctcagcctggtctcgaactcctgagctcaagctatcttcccacctcagcctcccaaactgtttcaattacaggcatgagccactgagcctggccttcagtcgttaataatataataatatggtctgggcgtggtggctcacacctgtaattccagcactttgggaggctgaggcaggtggatcacctgagctcaggagttccagaccagcctggccaacatggcacaaccccgtctctattaaatatataaaaaaattaaccaggcatggtggtgggctcctgtgattccagctcctcaggaggctgaggcaggagaattgcttgaacccaggaggtggaagttacagtgagccaagatcgcgccactgcactccagcctgggcgacaagagcaagactctgtctcaaaaataataataataataataataataatgtgataatttgtgtttgcacaaaactttgtacttttccaagaggcttcacattcattgtagtgtttaagcttctgtgaaaaccctgtgaggcaggtaaggtgagtcccaggaggttttcccagatggcgcagctaattagtgttgctggtagcattaggagtagactgcagactcctggggccccagccctttatcagggaatcatgcctttatgaattgcggaaaggcttagtgtaagccccaaggagaacctttcttccctctgggtgggtctcaggccctggggtaatgaagacttgtttgtcattgcatgtttccaagtgtttcccagactcattagtctcctttggcttttgaggttttgatgagacagtgagagccttctgcgctgattagaacgtttctgcaaatcgccctggcttttcccagaagaggctgtgggtgtggtgcacacagtgcggttggcttccagcttcctgttggcttccagcttcctgttggcttccagcttcctgtccctccggctgggcaggcagaggacctcagcctgtgggggaggggttctcagagtggagaaaaaagagatctctgtggctacaggggcaaacagggtctgagggagctgctagagcaatcccgtcctcccacacccgcaatgggacccccatctgtgctgtgacgaccctgagatcccagaggaggcaggtggagctggccgttcatggcttcgaaccgccccctttgtagacccttgggcccttctcacggcctcaggagcccagtctcctcctgtggcccccgccgccccagaccctcctgcccagcaaggctacctcctgaattttcctttttctcttcttcttcctcaaaacccctgttcctcaggttccatgggcaactgccatgtcatgggcatagtgctcaattgagaatcaagtcacctgggtttaagtctccaccttccactgactgcccaggtactgcccccatcagggactgccagctctatacagtgaggatcatgatacccatgacaggatggatgtgaagcccaaaagagatggaattcataagatgctaaaaagagacagctatagaccagataccagtgttacatgttgggtgttattctcctcattcagtgggctgtcatagatctagagaagtgttctgagaaaaaccatcaggatataaatctaaggtgtttggtccttcacaattgtgtcattcttttggccaaattcactccctgatgtttgagatggatcagctctagatcccacaaagaacactagcctctgacagaattcttccgcatcttccaagcctttatagaagcagacacaaaaacaatgatgtacctgttccataggcttggagagtccagccctctggccttgagagactcagacaggtgcattgcatgaaaggttattgagacagctgtaaccctcttctagaggtggattcagctgaacatctagtttacagactcctctataaatacctggacacaggagctgtgtcccccagatctacagcaccacctcaaagggtacatgcttcagggcttgataggtttttttgtgtgttttttttttttttttttagatggagtcttgctctgttgcccagtctggagtgcagtgatgtgatctcagctccctataacctctgcctcccagtttcaagtgattctcctggctcagcctccacagtagctgggactacaggcatgtgccaccatgtctgggtaatttttgtatttttagtagaggcaaggttttgccatattggccagactggtctcgaactcctgatctcaagtgatctccctgccttggcctcccaaagtgctgggattacaggcatgagccactgcacccagactagatttttaaatcttatccatacaagggtagaggtatctgctagttatttttagccaatccacctatcttgaacaccattcatttcaccaatgaattaaatcatttttaatatgtatttattctagcattcatttattacactaattaacaaattctctgatgcagactatcagatgggcctcaagactatgtagcctctttcaaatgcttactaaccacacttggagtgtgtattcctgattaggatatttcagatgttaaccaggtacccctgtggtatagattaaaatgaactaaaacacatacatttcacattctttcagcagaagcctttaaagtaagttctagaactgactttgcaccagatcccccggggggctcagtgagcgggagccactggaagggaggtcctgagtgtcaccatacccacatctcccatgggcctggcaccaagagcatagaacgtgctccatctttgctggagaatgtgacccaaaaggagacatgcccacactgtagtgtgttccaaacgtggactcatttttaactaaagaagtttctagaaggcctaaggggaagtaccacaactcctggttgtctgaaaatatatccagagccaacctttttgccctcccaaaggcaacaagcacatgtagggctgccttgcttcaggcctcccccattttgccctggtcccgtgcactgactcagctccccttcccttcaggagtcggtgatggaggcaacgagcttgggatgggtaaagtcaaggaggctgtgaggaggcacatacggcacggggatgtcatcgcctgcgacgtggaggctgactttgccgtcattgctggtgagcactcggatggccgcccagtccggccggctacccagggtgagcgacctggcttggagcctgaccaggccagaagctcttcttctctgcagtcagtccatagggcaccagggcagggaggggaggtggtgctcagcctatgacctttcattcagtcattcaacaaacatttacagtgtgccaggcagtgttctgagcactggggttatagctgcaatgaccctgctccacagagctcccattctaggactgggagatagagaatgagccctgacaaataaacacatcagatgattctaaagagtaataagagctttgggggcgatagtacaggtcgctgagagagggtgatgggagggccccttcagatcagtggtcaggaaggcttttctgaagagagtgatctgtgcttttatctgcatgaacagtaagaaaactatctggtaagtgtttggaggatgcgagaagctttctacctttcctttcacctacttctgccttgggctgccctgtgcctccctactgttgctcctctcccgcaggacccacctttcctgtgtccaggtccgtctaggtgtggcctcctcctttgacctcaccacacatttcaagaaaattgggagatccctgaaaaaggctctctcccacttcatgatcatagcctggaaaggaatggaacctcgtgggaaccagtgctagggtgggaaaacctgattcgtaattgagaaatggctggaggctcagtatgggcaagtatgagagtttaaaactccaggcgacccagtggtctgggggccctcgtgctcttgtgagttttgcctctgggcgttcaaccaagttctcacaatggatattagaaaaaaatcccctcgtgcttgcatcattggagggaaaaatgagtcattttcaagtaggccagggcattctcttcttcttcttcttcttcttcttcttcttcttcttcttctccgtctccttctcctcctcctcctcctcctccctttcttcttcttctttttttttttttttttttttttgagcgtgctttgttgcccaggctggagtgcagtagtgccatcttggtcgctgcaacctccgcctcccgggttaaagcgattctcctgcctcagcctcccgagtagctgggattacaggtacatgccaccacacctggataatttttgtatttttagtagagatagggtttcaccatattggccaggctggtctcgaactcctgccttcaagtgatttgcccaccttggcctcccaaagtgctgggattacaggccttaaatctccctggggaaagcgaaatacccaaccccacctttcttcagccttccacgtgggagagggacatacccaattccagctccctctagcaatctgtgccacgtaagggggagaggacaaaactgagaagcagtagtgaagttcacagtccagggcacaggcttactaaaaggcagagacctaatcataggactgcagagcccttcccctccccgacacatcttaccaccatcactaaaggtccatttgctacagtttcttttttttttcttttctgagacagagtctcactctatcacccaggctggagtgcagtggcacgatctcagctcactgcaacttctgcctcccgggttcaaactattcttatgcctcagcctcctgagtagctggaattacaggtgcgcactaccatgcctggataatttttgtgtttttggtagagacggggtttcgccatgttgaccagagtggtctcgaactcctgacctcaggtgatccacccacctcagcctcccaaagtgctgggattacaggcatgagccactgcgcctggcccagctgcagttccttttaccaagtaaattatgtccacctttcaacaacaaaaaaaatttacaagaaacaccgataagcaaaaacacaatttgaagagaagttacaaacagagtcagacatgtcagaaatgacgggattatcagacctggaattcttttaaaagtatgattaatataataaagtcttcactgcaaaaaataggcaacatgcaagaagagatggataatgcaagcagagacatgaaaattttaagaaagaataaataagaagtggtagatcagcctgggcaacatggcaagataccatctctgtaaacaatttaaaaattagccaggtgtcgtggtgcatacctatagtcctggctacgtgggggggctgaggtgggaggagaacttgagcccaggaagatgaggctgcagtgagctgtgattgagccattgtactccagcctggatgacagagcaagacactgtctcaggaaaaaaaaaaaaaaaagaggaagtagatagagatcaataactctgtaacagaaatgcagaatgcctttgatgggcttattagtagaccggacatggctatggaaagaatctctgagcttcaagatatctcaacaaaagctgccaaaactgaaaaaaaagcaaagagaaaaagtgctgggggaaaaaaaaacccacaacagatcagaatatctaagaactgtgggacaactacaaaaggtataacctagactaatgggaatactagaaggagaagaaagagagcgataaatagtagcatttgaagcaatagcaaatgagaatttcccccatattaatgtcagacaccaaaccatagatccgggaagctgagagaacactaaagaggataaatgccaaaaagctacatctagacatatcatattcaaacttcagaaaaccaaagataaaggaagaattctgaaagaagccagaggcaggtggggaaaaccctttacctatacaggaacaaaggtaaaaattacattcatttgacttctctacagaaaacatataagcatgaagagactggactatttttatttttttcttttttctttttttttgagatggagtttcactcttgttgccgaggctggagtgcaatggcgcaatctcggctcgccacagcctcctcctcccaagttcaagcgattctcctgcctcagcctcccgagtagctgggattacaggcatgcgctaccacgccctgctaattttgtatttttttagtagagacggagtttctccatgttggtcaggctggtctcaaactctcgacctcaggtgattcgtctgccttggcctcccaaagtgctgggattacaggagagagccaccacgcccggccacctttaatctttacattactgaactatttaaagtattgagaggtagcaaccaatgcagaattctgtgccctgcaaaatttgcttcaaaaataaaggagaaataaagactatgaagcaaataaaaattgagagaatttgttgccacaactgccttgcaagaaatgttagaagaaattcttcagagagaaggaaaattatatctgtcagagacttgaatctacataaagaaaggaagagtatcagtgaataaaataagtgagggtaaaataaaaacttttgtatttatttttgaccttacatatcagtttgctcaaaataataataacagcacaaaataataataacagtgcattccattatgtatgccatatgtatatatatgcttatgtatgtttgtgtagaagtgacccaaatgacaggccaggcacggtggctcacgcctgtaatcgtagcactttgggaggccgaggcgggcagatcacttgagcctaggaatttgataccagcctgggcaacatggggaaaccccatctctacaaaaaatagaagaattagctgagtatggtggtggacgcctatagtcctagctacttgggaggctgaggtaggcagatcacctgagcctgggaggttgaggctgcggtgagccatgattgtgccactatactacagcctgggtgacagagtcagaccctgtctcaaaaaaaatagaataagtgacacaaatgacagcaatggtacatggaatgagagggaagaattagcaatgttttgttataagttgcttgtgctacccatgaagtggtatactgttatttcaaagcagactttgttgtaaatgtatgttgcaaactctagggcatccactaaaaaattaattttaaaagtagaatttacatgctaagaaaggagagaaaatagaatcatataaaatactcagttaaaaccacaaaaggcagaaaaagtgtagaagacaaaaatggggccaggcgcagtggctcacacctgtaatcccagcactttgggaggccgaggtgggtggatcacctgaggtcaggagttcgagaccagccttgccaacatggtgaactcccatctctactaaaatacaaaagttagcaggagaatcacttgaacctaggaggcagaggttgcagtaagccgagataatgccactgcactccaacctggggaacagagtgagattcggtctcaaaacaacaacaacgacgacaaaacaaaagaacaaaacaaaaaaatggaataaagaacaaaggcaataaagaaaacagcagcaaatatggtagctattaatccaactatatcaataatcaccataaatgtcaatgccacagtgaacttaaaaaatcaagattgaggccgcgtgcggtggctcacgcctgtaatcccagcactttgggaggccgaggctgggtggatcacgaggtcaggagatcgagaccatcctggctaacacagtgaaaccccgtctctactaaaaatcaaaaaattagctgggcgtggtggcgggcacctgtagtcccagctactcagcaggctgaggcaggagaatcgctttaacccgggaggcggagcttgtagtgagccaagatcacgccactgcactccagcctgggtgaaagagcgagactccatctcaaaaaacaaaaaagaaaataaaacagaaagcaaaaaacaaaccaagattgagctatatattgtctgcaagaaattcactttaactgtaaagacactatatgtgtctttatatttaaacagattagcaataaagagatagagaaagatatgccatgttaacactaataaaaagaaagcagaagtagctacattaatttcagacatagcagacttcagaacagggaaagttatcaggataaagagggggattacataatgataaaggggccagtattcaaataagacataatacgccaggcacaatggtgcacacctgtaatcccagcacattgagaggctgaggcaggtggattgctttagcctagacattcaagaccagcctggacaacatggtgaaaccccatctctacaaaaaccccatctctacaggcaaatgcctgtagtcccagctgttcaggaggctgaggtgggaggatcacttgaggaggcagaggttgcagtgagccaagattgccccaaaaaaagttgatgggggggagcataactgataaaactgcaaggaaaaatagacaaattcactattacagttggagacttcaacacccctgtatcagaaatgggcagatcagcctgggcaacataacaagaccatatctctacaaaaacagcaaaaaattagctgagcatggtggtgtgcacttgtagacctagcctctcaggaggctgaggcaggaggattgcttgagtttaggagttggaggctgcagtctgctgggttgtaccactgcactccagccttggcaacagagtgagactctgtctctcaaaaataaaaataaaataattttttaataaaaaataaaaatcaagtaatgtaatccattacgtcaataggctaaggaagaaaaatcacatgttcatgtcaatagatacagaaaaagcatttgacaaaagcaacacccattcatgataaaaactttcagcaaactagaaatagaggggaacttcctgaactcgataaagaacatctacaaaaaacctacagctaacatcgtaattaatggtgagaaactagtttttccactaagattaggaaaaaggcaatgatgttccctcttaccactattttcaacattgtattggaagtgctgcctaatgccgtaagacaagaaaaagaaatataatgtaaacagattgggaaggaataaataaaattgtctttgcttgcagatggcatgattgtctgtgtagaaaattcaaaagaatcaacaaaatctcccagagctaataagtgattatagtatggttgcaagatacaaagttaaatactttaattgtatatgtcagcaatgaacaagtggaatttaaaattaaaaacacattaccatttacattaattccctaaaatgaaatacttaggaataaatctaaaaatatgaaggaaaatacaaaacattgatgaaaggtatcaaaaaagaactatatcaatggagagatattccatgttcatggataagaagactcgatattgtcaagatgtcagttctcccaacttgatcaataaatttgatatagtcccagtcaaaatcccagtaagttattttgtggatatcaacaacctgattctaaagtttatatgaagaggcaaaagatacagaataacaaactgaatattgaaaaagaacgagatcagaggactgacactacctgactttaagacttactataaagctacagtaatcaaggcagtgtggtattggtgaaagaacagataaatagatcaatggaacagaatagacagcccagaagtagacccacacaaatagggccacacaatgtttgacaaaggagcaaaggcaatgcaatggagcaaaggtagtcttttcaacaaatggtgctggaactggaactactggacatccacatgagaaaaaatcaatctagacatatagacgttacatcctttacaataataaactcaaaatggattatgaacttaaacataaaacacaaaactataaaactcctgtaaggtaacataggagaatatttggatgagcatgagtatgattatgacttctttttattttaatttgattgattgattgattgagactgtgtcttgctttgtcacccaggctggagtgcagtggcatgaactcagctcactgcaacctccacctcctgggttcaagtgattctcctgcctcagcctccccagtagctgggattacaggcacacgccaacatgcctggctaatttttgtatttttttaatagagacggggtttcaccatgttggccacactggtctcgaactcctgacctcgagtgatccacctgcctcggcctctgaaagtgctgggattacaggcatgagccaccacatctggctgattatgactttttagataacaacaccaaaggcattatccgtgaaagaaacagttgataagctggacttcactaaagtttcaaacttctgccctgcaaacgacaatgttaagagaaggagaaggctgggtgcagtggctcatacctataaccctaacactttgggagaccaaggcaggaggaccatttgacactaggaatttgagaccagcctgggcaatgtagcgagaacttgtctctacaaaaaaattttaaaatattagctgggcttagtggcatctctgtgtctgtttcccagttttcaaatggagataataatagtacttacacctcacaagcttgttgtaaggactccaggagctactctatgtaaggcatttacaacagtgccacatgttgtaaatattcaatcaaagaagatactctgttcattgaatataagatgtcattgatggccaggcatagtggctcatgcctgtaatcccagcactttgggaagccaaggcaggaggatcacttgagtccaagagttccaggttacagtgagctatgattgcgccactgcactccagcctgggtgacagagtgagaccctgtctttattaaaaaatgaagaaaaggctgggcgcagtggctcacacctgtaatcccagcactttgggaagctgaggcaggcagatcacgaggttaggagatcgagaccatcctggctaacatggtgaaaccccatctctactaaaaatacaaaaattagctcggcatggtggcaggtgcctatagtcccagctactcaggaggctgaggcaggagaatggcgtgaacccaagaggcggagcctgcagtgagccgagatcatgccactgcactccagcccgggtgacagagtaagactccgtctctaaaaaaaaaaaaaaatcccaccactttgggaagccaaggcaggaggatcatttcagtccaagagttccaggttacagtgagctatgattgtgccactgcactccagcctaggtgacagagtgagaccctgtctttattaaaaaatgaaaaaagccaggcacggtgactcacacctataatcccagcactttgggaggccaagacgggttggtcgtttgaagccaggagttcagggccagcctggccaacgcagtaaaactccatctctactaaaaatacaaaactaagccaggcgtgttggcatgcacctgtagtcccagctactcgggaggctgagggaggagaattgcttgaacccaggaagcagaggttgcagtgggctgagatcataacactgcactccagcatgggcaacagagcaagacttgctctcaaaaaaaaaaataataattattgatgacaagaattaacaataatttacatactactaagaaaggaaaatacaaccaattgtaactgtaagatactattaattataagatacatctcaatttcagagatgtaagtgtaacaaaagtacatcttaaaatcagtagaatacagtattatttttatcgtatggtctttacctgccacgttttgatatatggcttgtattttcatgccacatgcctttgtattcactgaagattgtttgtttgtttgtttgtttgtttgttacggagtcttggtctgttgcccagactggagtgccatggcatgatcttggctcactgcaacctccacctcccgggttcaagtggttttcctgcctcagcctcctgagtagctaggattacaggcaccctccaccacgccctgctgatttttgtatttttagtagagatggggtttcaccatgttggccaggctggtctcgaactcctaacctcaggtgatctgcccatttcaacctcccaaattgctaggattacaggcttgagccaccgtgcccggccaagggagtttttgtttgttattttttttgtttgtttttcttttttttttttaactggaattgctcccattcctccacccctcttctggcaaaattttactcaacctacaaggcccatattaaatgaccccttttctatgaatctttcctaaaccagtcagaatgagtgccccctctccatgctcccataattctgcgtgaacatctcagtcatagtggcccgtggctggccgtgtgcacagtccctcctctcctgagcagaattgacctctctttcgtggtgctctagcacttattgcttaccaggcccttcatcaattcttcttcaactgcatggagaactcaagcaggtttcagggaagagccaaggagatggtcccaaaactgggaaataagccctttgggcatgtgatggaaaaggaagggaagtctgaggctgatttgggagtgatctttgagcacatgaagaggtcatgcgatccagcgcgacggggctgtttcctgccctctgagggtgggcttccacgtggcacaggggattcagctcagccagaggggagagtttcttcatgttgagtgttttggaatgggtttctacggttattgcctaaacctttttttctgatggtcattagcagtggattaagtagtttagagcaagggttttcaaactttggcttggatcagactcacatagaggatttatcaaaactcagccaggtgcacctataatcccagctacttgggagactgaggcagggggatcacttgagcccaggagtttaagcctccaccccaatgagctatggtcgtgctagcctgggggacagagggagaccccatcactaaaaaaaattaaaaataaaaataggccaggtgcagtggctcatgcctgtaatcccagaactttgggaggccgagatgggtggatcacaagatcaggagttcaagaccaacctggccaatatggtgaaaccccgtcccttctaaaaatataaaaattagctgggcatggtggcacacacctgtagtcccagctgctcaggaggctgaggcaggagaatcgcttgaacccaggaggcagaggttgcagtgagccgagatcgcaccactacactccagcctgggcaacagagcaagactttgtctcaaaaaataataataataaataaataaatacaaataaagaaaattcagcttgttcctttcctctcctctcctgctgagctttttattcagtagttcttggctggggccaaagaatttgtgtttctagcaagctcccagatgatactggtgctacgggaccgtggaccagtcctgcagatagttctgcttcctagaggcaggctgacagacacatgacttttccaactccatgatggaatcttgttttgctgttctaggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagccttgaagcagaggtctcctggattgggtgccctttaagctactcgcagttctgaatcgtgtggcaggcctgatccaagtgaccattttccttctagtttgactttgggtgagttgcttagcttctctgagcctcattttcttcatctgtaaaatgggggtggtcagcattgttgttggaggaaccgaatgcctcacccatggtgggtacttcatactgttagtggtgggcaggtgtcctgtcagccccctccaaggaattcaccacccagcgaggccactaaaacctccagagtaagtcaatcagccatactaaggaaagtgctaagggggacagacaaggtgagaagagaatcctgtgggctggaggctgcaaggaataagccaagtagaaggagaggaatcccagcgggaggaatggggggagcaggggcttgggagatgaggacaggcttagtgatggtttgtgggagacagctcttgaggtggagagcaggaggtagggggtgagacaaaagtagaagagggcttcagaccgcaggcccacaaggaggaggtccatgagcccctgaagctgtttgcacaattgttcctgtacatgtatttttctgcgcaagactctgtggtttcatcagattcttcaagtagtctggggccattaagaatccctggtccagctgggtacggtgactcatgcctataatctcagcactttgggaggccaaggcaggaggatcacctgagcccagaagtttgagaccagcctggacaacatggtgaaacctcatctctagaaaaaaaattttaaaattagctgggcctggtggcatgcacctgtggtcccagctacctgggaggctgaagtgggaggatcgcttgagcccaggaatccaaggctgcagtgagctatgttcacttcactgcactccagccttggagacagagtgggagaccctgtctcaaaaaaaaaaaaaaagaatccctgggaagggacagatcatgttagctggacccaaggacactgtgactttctccctgaggactctccctgagaggcagcagcaggtaacttttgtctgagctcctccgactgcagaccccatgctccgaagtgttgtttgcagttctaggtacactctgtagcccagtgcagaggaagggcatcaacgtgtgcccgtctaacttatgtgaactcacacatgcatatggggaaaatgcaaaagagaggtggccagcgcgcagcacccaagcctgagcagcgaggtggcagcgggactggcccttccttccttgggcctcaatttccatggccctcttagagcaagctccgcccccaacaccaattccaggctctaacccgcctcctctggggctcctcaaggagatgggacctgcccctcttggaggagaagctggtggaccagacttgcgggacattcacaatgcctcagtgcttaacgggacacctacttggggaatattcccaggtaatttggactttgggaaaacggggccaaagctctgactttacatctaaatcctgggtcagatgtgacttcacctgtgagcagacagcagcctgagggattagaggtgggtgccgaaggttgtgggagagggcgtggaaggtctggggagatgggaaagcaaatccaagaggccggagggtcctgagcactgagcctgcagaagagcccgagattgggtgggtggtcgctacaagtcccctgccagtgggcaggcccgatagcctcccaacgtctgcaaccagacgtccgcattgctgccccttttctgtcttttttttttttttttttgagacagagttttgctcttgtcacccaggctggagtatagtggcacgatctcggctcaccgcaacctccaccccccaagttcaagcaactctcctgccttagcctctcgagtagctgggattacaggtgcctgccaccatgcccagctaattttttttgtatttttagtagagacaggatttctccaagttggcgaggctggtcttgaactcctgacctcaggtgatccacctgcctcagcctcccaaagtgctgggattccaggcgtgagccaccacgcccggcctcttttctgtctttctttcctgttttcttacaccctgtctcttccctttttccttctgtctgtctctccctctctgtttctctgtgtctttctccttcctgcccctggcctctgtttctctccagcacctgcctggattggtggtgtcattcccattttacagacgagagacctggggctctgagaagccgatggcttgcctgagaccacccagctgagaggcagagctgggatccgagtctaggtctctgtgactccattctctgtgcttttcccaattccgctcagaagtgtcccaggtagtgccagggaagagagatgggggagggggagctcaggcagctgtggtgacattttcagagggaaatggtctgccctagaggggcccagagggccttttgtgctttctttatacttcctggatctgaactggaaaaaaacatgcaagggctgcttcacacatgattcctgattcacgcagacacaaaagaacgaacccagccaaacaaatcacacagcccaacacacagatggaagcttttccttctgcatttctacctagtccttcataaatcaattaataatgtaccacccttataaagaacataaaatggggattttttttttttttcttgagatggagtctcactctgttaccaggctggagtgcagtggagaaatctcagctcactgcaacctccgcctcccaggtttgagtgattctcctgcctcagcctgccaagtagctgggattacaggcgcgcaccaccacacccggctaatttttgtatttttaatggtgacggggtttcaccatgttggccaggctggtcttgaactcctgacttcaagtgatccgcctgcctcagcctcccaaagtgctgagattacaggcgtgagccaccacacctggcctaaaatggggattttttaaaagcaaaagtacaaacacatgtttgttgagccccgcccctgggccaggcccaggcttgctctaggggacaatgaggagtcaccctgggtgggggactcagggtccactggggagacgacacatgacaggcaatttcaggagccaagatggaatgtgcacagtaagcttcagtgagaggccgggcatggtggctctcacctgtattcccagaactttgggaggctgaggcgggcagatcacttgaggccaggagttcgagaccagcctggccaatatggtgaaaccccatctctactgaaaatacaaaaattagccaggcgtggtggcgggcgcctgtagtcccagctgttcgagaggctgagacatgagaatcacttaaactcgggaggcggaggttgcagtgagccatgatgacaccactgcactccagcctgggtgacagagtgaggctctgtctcaaaaaaaaaagaaaaaaaaattttgaaaaaagcttctgtgggagcacagaaaacagtgcttagctcagcaagttcagtgaaggctgcctggaggaggtggcactggcactgagctgtcttgaggagtgagtaggatataagtagccaggtaaggaagggtggaaaaggccttctaggccgcagaacccacataagcaaaggtacagggacatgaagccgtacagtgtgcagaggaaatagctagaatcgtcacactagagttctgcaggtcactacgtgggggtccttgagtcatccagagatgctgggcagagctgtggcctgagctagtggaaaagcttgattggttggggcagagaaatgtcccacagctctgctcagtgagttgcatctggggacaggggttcttaaggatctcactgtgagtgtggtagaagcaggcactatgctgaggaggccagataaggtggacatcactacctgggcacaccctgcccactctggcccttggcccaggggcaccttaaagtgagggagaggcccttgggttgtacttgagggcaagcattcctaagacgtcatcaagggccaagagccacttgatgacactttacaggggtacctgcaaggtctgataaggaggacttggagctcaggaggtggagaacttggtcttcctcagcttgggggccaaggtgctgcaatttggcagggtgacagagctctgggcagggggtgggtccctaggagggactgaaggcctccaaggatgaggcctcgggaagccccctcatggcatcttcccctcagcccgatggaggcctcagacagcagccagccaggccggctgtgcctggatgctggtctgggttagggccactctcttccctgtatttctgtagtttgtggacttctctgtttcctaggaccaagtcctttgtaaaaacatcgggcctgccttgggtgagtgaagtgggtggttaggaaggtcgcaggccctggccggctgcctggttcaagccctggctccgcccacttcagcctggagcaagtctccgacctcagcattcctcggtctcctcgagtggggccgtaacagatctactttttgggtgattggaagatggaatgagtccctttgtgtaaagcacctggcatagtatctggcatggattaatagcaagtgttcaataaatgccaaccgtcattatcatcatcatcatcatccttcttatcatgacaaggtcctttctttactttcagtcaggctggggcaggtgtcagggtgtccctgagccaggcttgatggtggcagcaggtggcctatgccaaggagagctcccacagccagagcagaaggaggtgaaggccaagacagagctggggcctccagatgccatgtggcgtcatgtgggactgtctgtctttccccgtgtggctgggaggcagatggagccgtttctcccgctgccacactccccagcccggtccaggcagccagctctcccctgcctattgcaagatgagaccatgattataccagccccatcttgctctacgggaagcctcagcaccatgttcccgcctgcctcgtcattgcctgtgccagagcccagggccaagggagtgccttgtctcacatcccagcccatttcatgccagccctttacaagagatcacaaagaagaggcactccctgggagtgggcaagccaatgccaggaagctgatgcctgggcaggaaagaggctaaggaaacgtggggctcatggtataaacaaacaccaggaaaggtttcctggacttcccccacctcaacccagtacttggggaagaggaacacagcagctgggcctgttttgcatcactgccttgaagtggaggctggagggagctgcctgagggctctggccaggctcccagcccctctctgctccatctctgctccagggcaggtactgagcacccatggtgacatggatgtggaatatgccatcagcccagggcatagcagccatgtggtttggggaaacagaagaggaccctgttattcacatgcccagtggtaggtagggagtgaggggccaaagagtgagagctcttggaggaacaaatgatgacttatttgtccctacttcagagcctggcccagggaaggcactcaggaaatgttggatggagagatgatggatgcatggatggatggatagatggatgggtggatggagggatggatggataatagatggatggatgcatggatggatgggtgatggatgtatgggtggatggagggatgcgtggataatggatggatgcatggatggatggatagtggatggatagatggttgggtaggtgggtggatggagggatggagggatggatggataatagatggatgcatagatggatgcatgcatggatggatggatagatgggtgagcagatggaaggatgaatgctttgatggatgggtgatgcagagaggcaggaacagcctcgggcctcattctgggctcccattctctttcagcactttcattcaccctactattctttataacttatttttgttaaagtataattaacatacaataaagtgtgtacaccttaagtgtacagttggatgaatttttacataagtatacacccttgcaaccaccaccaagattaagacacaaaacagttccaacttcccagaaggcaccccactttgagcggcatcatcacctcccataaatacctgcccaccgtgctcccagtgtgacttaatagcaagcacccatacactcagcctctacacactcagcatccacacactcagccaccctggggcctctgtccccatccaagccctgtctactctccctcacttgggtcctccattcctcctctcctgccctgttgtctcagcctggactggtgcagtggccttcaggcgccctgccctccagctgctccctggtaattctctgccactgttaccacctctgcctcttagaagatggcatggtcattccgtgattcttggaaatttgcagggagtagctgttggcccagctggtccctgtgtctcttggaggctgggtgccagtcagctcgaaacctgttggctgattgcgtgcaccctgaggaccccacagcccttcctggggcccagaaggatgagaatggtgagggaaacagtgtgctgtgaggaaatggccccaggagtcccagaaacattcccccataaagagaggatatgaccagtggagaagagaagcgagaggaagaagcccaaacaaagggcgggaaatgccattctgagtgggtagctcctgagaaggagctgttggacaaaggacacatgtgaaagtggaaacaatttagggcctccctcctacagaggaacatccttcttggcccccagggcagaacagaaatgcaggctctcaggccagctgtgaagagacagtttgcagttaacatttgccaatgctttctctattacttagaaaaagttagtgagtgaccctccagggctctcagctggctcatttttattctttcatcacctctgatcctagttgccccttgtcgtagctcaagctgctattttaaaaaacaactatagactaggtggcttgaacaacagaaatttagttctcacagttctagagattgggaagtccaacatcaaggtgccagtagttttgattcactggtggggactctcttcctggcttacagatggccgccttcttgctgagtccgcatgtggtggagagagcgagagctctggtttctctttttcttataagagcacttcacatcctgaccctcactcatgacctcatctcaatcttattacctcccaaagaccccactttcaaattccaacaattgaggattaggttcaacatacaaaatttgagggtacatattgagtccataacaccctgcctccagaaaatgttccctgaaccatgccaataagctgggttgggtgcccctgctctgtgctgtgacatcctgtactatgactacctgattactcatctagactgtgaaccccatgggggcaggaaccatgtcacattcaccactgtatccctggttcagggcctgacacatacttagcaggtgttcaataaacctttgatcaatggtgggatgaatgagcaaatgcctgagcagggagagagccttcttatagccgccctaatgtcctattctagattccttaggtcccctcctctcacctcctgcctttgttgtggaggaggaagaagacagggagaaggaagaggaggaggaggaagaagaagaagagggaaggatgtgtttgagttgctttatgccttcacttaaggctcactgtccttaggggaacctgagctgttcactagggacagacacattagtggcttgggcaagtggtgctttgggattttatttttggaaggaggggggatggaggaggatcaaaccactttttttttttttaaccagcaggagagcaaagggagaaagctctaggctaaaggccagaagacctagccctgccaataaaatcaacctcattttgtgaatgcctgttgtgtgccaaggaccctgctaagtgctttgcttgtacgtaatcctcagaacaaccctctaaaggaggcatgatgagtacttttatcatcaccctccccattttacagataagcacactaaggcacagaacagttaaaattcctgccaggaaagactcaagtcagacctttctgatccccaaaccactctgcctgctaggccccgggctgcggcttcaggatgggggcttgtattctctgtgactctgctacacctagatgctcccactcccacagtcaccctggtcatttctagaaggcaacagcagcaggatttgacacatgccccacattaggctaagaggtctcaggagaaatgggggcctttggcacaaagactattggcagataatccagggctgggaggaacttattggcaggaaatagcctgcactgcacctgcaggaggagtgaatcttcagtgttggttaaggaaatgcaggctggccgggcacagtgatgtgcacctatagtcccagctagtcaggagactgagacagaagaatcacttgaggccaggagttcaataccagtctgggcaacatagcaagaccccatctctaaaaacggacaatcaaactaagaaactatgtttccattaaagcatattatttagttacataacagtaactaccaaaagaagcagcccaaactattcccgtgattgtttctggggagtagatttgggggccaatgagctgtgatggaggacacttacttttcatgacttttccaatggtattagtactttaaaccaaaattttacttttttaaaaagcaagtatgtcaaggcaaaggatccttctcacttataaatgtgtataaaagaaatttctttttcctccccctccactccttctatttctgccctatttttttccaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgctgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgt

SEQ ID NO: 38342 - DNA, 10615 bp, Homo sapiens
gcctgggttgcgctgccggccacgtccccgcgccgggcctcaggctccttcctactgtccgagggccaccaggccgccgggggcctgctgcgcccgggtaaggggctcgcactgccgtccgggtagctgctgtcagggctccctgactggcttgggactgagagacagaggttggggggcaggaggagggttggatgggggcacgaggggcagtgggagagtgagtggggctgagagaggcaggaggaacgggacaggaggagcggcggatggggcacgcacagagtgcaagacgctgagcaatgcaggtactgaagaagtcaactgggggccgagcatggctgggggcccaagagacaggaggagggaggagggccgaagggggcccagactggagaagaggccggcttgtcccattgtgggagcagaatggggacactctggaagggggccgaatttgtcctggggtctttcccgggcaagcccaggacgggactggaccccaagaagtgtcgctcttacttgagtgacacagacctatcccccagaccctctctctacctgggtggaggttgtgcattgccccagattccctcccctgcccatctgtctccctgcctgcttcccccgtgcgagtcacttagtagcccccgtgtggctgcttagcatgttgacttaatcgttaggctgataggaggaatcggcctccacacgcatggtttgccaccagaaataatcatcgtgcttagaaatctgactgtaataacttgcagctatccctcgccccaggaaaatctctaacatttcgataaaatcagctaggaaaatctttaaaatacagatgtttccatttatacagtggatctgcctaatggacaaaggaatgtcagagctacccacgttcttagcaaaaactaggccctagtatttagctgtgttaccaaaacttccagaaacctggaagcaagcaaggtagttaatgtaatataataaatgtccaatgttctaggttcccgtctgccacagagtcacatcctttggactacaggacaatgtctatatacacaaagccataagtctgtgttccttgggcttctgctaccaaagttcagccaggtgacgtgtcaggattaggtacctgcagtttgccctgtatttgtgtttgcagttcctactccttggtatctgtagcttgcctaacttggtgtgggggcctggccatgttgcggctgagtgagtcttaatagcctgatagaatgtgggggtaacagctgtagtcctttaccaagcttcaggattggtctttggaacctctctatgccagaaaaaaagaattaagttatttctttccctttttttttttttttaagagatggggtctcactatgttgcccaggctgaactcaaacttctgggcttgtaatcctcccacctcagcctcctgagtgtctgggattacaggcatgcagcaccacgcctggagtccagttttgtgtaacttgcataaagtgcgccacatataacaagccaaggttcggaacacaagaattcagacaagatgccttgggaggcatctcgaggtcatgaaccagaaaaggatagggaggttgacacccaggggcatagttgggggtgcctttgtcatggagtgtcacatggctcaagggagtatcctgttgcaccttccttgcagatcctatggggagctgacccctgaagaagggagctcccagtgccagcctaaccttccgtctttccatctgccctggtctccaacttaatacaaacttaattctctctcgctcattcccctcctgcccctggggtctcttttttcccatctattatggtctgagaccctgatctacccagtctccctgtaccacataataatgagaataactggtggggtcccgagacccacatcctaattttggcttgaagcctttgcaggggaaactgttattttaaatgttgttaatggtttgtccatcatgagtcaacttacatagatgaccacaggttcccgcatgggatcttgacatttagaatattctgttggaaagtggaggcaggaccatagcagagggatgaagtcataggacaatgaaggcctgttctcgactacacagtggccaattcctgtttctgtgggagtgaccaccagccccaccggctgggagggagtaagtggtgatggtatccagcagaagtttcctgagaaacccgtggagtgtcctgatatagccttgtggacctgctccgtgtgtgtgccctcacctttgtgtgtgtgattttgcatgtgtatgtgtgtgcctgtgtgagtgcacatgtgtggtggcatgtgtgcatgtgcagatggacatatgtgcagctgtgcgcacacaagcgtgtgtgactaagtgcatgtatgtgtggctgtgtgtgcacacgtgggcatctgtgttgggagcaggcccatggtggtccttgatatcaccacctactgataaccttcccatgataagaggtgacgagctgtttctgtaatctcctgagtacgcgttaaatattcatcaatgagagaagcatttgtgccggttgacatctttgcattatggctttgctcctggattcctccgaagttttggttggctcctaggaaaatgtctctcctgatatatagatcgtgtagtctctctaaattatggaaatcagcatgtgaaactgtatcaggtgggataactctgtgcctttctgcttagtggcttgaagtacttgaagaaaatatgctgttttctttccttggagcctttcagaaatgttttccaaaagtgatacatgcttgttaaaaaaaaaaaaagaaggaaagatatgaagtagagaatgaaaatcacaggtgaatccattccccagggatattcattaacattctagtgcaaatctttccagacccttgaataaatgtcccttttaacaaaaataggatcatggtccacacgttgctgtgtaacctgccgtgttcatttactgatgcatgctatatatcttcccatgtcaataagtagagagttgtgtatttttaacagttgccatagtattttatatatgaatggggccatacttgacagaactattccagttttttactctttctaaataatgctgtgagaaatatctttgtagatcatctttggacctctgtctgagtgcttccttaaaagaaactgcagtagaagttgctgcattggaagtcgttgttgttttttgttttgtttttttgagacgcagttttgctcttattgcccaggctagagtgcagtggctcaatctcggctcactgcaacctccaccttctggtttcaagcgattctcctgcctcagcctcccaagtcgctgggattacaggtgcccaccaccacgcccagctaatttttttgtatttttagtggagatggggtttcaccatgttggtcaggctggtctcgaactgctgacctcgtgatccactagcctcggcctcccaaagtgttgggattacaggcgtgagccaccgcacccagcctgcattggaagttttgacattgaaagctttgatccatgttgtcgttttcccagtggaatgaatgatctattgaattctgctctttttgtgcctccctcctcactggaattttccttcatgcctttcataaggaatgtggactttttttcaaactctagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctggtaagtgtcctggccctgcaggctgggcctgcttgttgggtgatgggacggtgagcccagagggagctttgcaagatcatcagagggtcaagggaaaaggaaagacagccaggccttatagtaaccaaggaaggcccaggcccagtctgtggcccttaactgtcagaggccctgcctccatttttttttgtttgtttgtttgagacaatgtctggttctgtggtccaggctggagtgcagaggtgcaatcttggcttactgcaacctctgcctcccaggttcaagccatcctcccacctcagcctctcaagtagctgggactacagatgcatacctgtagtcctggccaatttctgtattttttgtagagatggggttccgccatgttgcccaggctggtctctaactcatgagctcagtccatccgcctacctcagcctctcaaagtgcggggattacatgcatgagtcattgcatctgatcaggaggccttatcttctgagtggactggggtggtggcccatgaacaggatggggatcacgcaatcccctgcaaccctcttcggcttcgtgacacaaatgcaagttacctcaagaggttctccctgaccttggtgatgccgtgggcactcacagaagcctcctctgtgctgcagggaggctgtgtcttactcatgcagggtggtggaggggcgcctcttagcagaagatgatgaaaggctgtcccctctcaggaaggagaaggtccttgtctgttccaaggcaaagaactggacaagaaggaggaggttcattcagtacattgagtctgatcctccctgctgtagctggagcacggtccctgaagctggctgaagtgctaaagcaggggctagcaaactgtggccgaatcccacctgctgcctgtttgtataaataaagttttattgggacacaaccatgcccaccattcacttctattccagggctgcctctgtaccgtagcggcagaatggagtagctaagacacagaccaaatggcccacagaatcccaaatatttgccatcctgtcctctatagagaaagtgtgctgacccctgccctagagatttgtagtgagggggcagcagaaggcctggggctggggtacattcaggagccgagaccctcttcacccataagaagcccctgccacatcatctcacctttaactcacccagaggacctcaaatcccgggctcgggcctggggaacataccaggggtggtagcattttaaaaacattcggtagatgttactggcccaagagagagccatttaaatactcatatttatcaaaagcccagctgcactgccttgacccgtggaggattgtgagttctttgtgcccgaaaccttccagtttcagttctgccttgcatgatattggttagtttcttctctccccatcccccccgccacacttttttctgtcagaacaaagaatgctttttgcactctagatctgtggtttgtaaggccaagtaatttttctaagcccctaacacattaggagcccttacagaccattttgaagagaaagcaccatttgaagctagagaaaagttagtgactcttggaaagagaccggaagtctcgtggaacacaccagccttccagaggagtgtgtgctctaagggctttctccagccccggggcagcttgacaacagtccacatggattacaggaggcaggaagccacccaggggcttcttgttgcgcagtggctgcttttgcgtagctggaagtgcttctcgggtgggctgctggctaagccaggcgccatgctgggtccttgcccgtgtgatcccatgtcccatgtcactcccatgcagctcagcggggctcagaggtcctgtggctgcacatgtcacttggttagtgagcatgggagctggagttggaacgcaggcagtgctgttggcctctgtgtgtcctgctggtctcccactccccttgcatggtctcttgaccctattacagtagcttcctcaagggaatgacagtgaatgctgaaagagctaaaaggctgcttctgccactcatgcattcaatggccccttcgtccctgagtgaccaatgggcagctcacccagcaccccaaagccccagtctgcctacagctatgcagctggggccacactttgctgtgggctgctaagtgctggttaccttgtgactgttttcattattttatctaacaaaacaaataaaccaaaccaaataatttttttataatacattaagggccgggcacaatagctcatgcctgtaatcccaatactttggaggccaaggtgggaagattgcttcagccgaggagctggagaccaccctgggcaacatagcaagaatcctctctccacacacacaaaaaaaatagccaggtgtggtggcatgcgcctgtgatcccagctgaggtgggaggatcatttgagcctgggaggtcaaaactgtagtgaggtacgatcatgccactgcagtccagcctgggcagcagagcgagacccatctcaaaaaaataaaaatgtgttaaggcgtccacatcacttctgtggagcattagaatgaaggagagggctttgctttacagcaacttgggccggctgtggggaccactgcagtctctgaagtgggtcagtcactcattcactcatgccttcattcattgagagagcctctgtatcaggtgcctggatcgctgcccctcactggctgcccctgcctcccctcttgctaaaagcacctttctgttcttgtctaaggccccggagggactcgcatccccctactgtgaaatctaaactgccacatggctcatggggcctcctcacgctctccagactaattcccgcctcaccacgctcttccttgcctctgaccctgctgttgtcatctgctgctccctctccacctgcctgcccacccccacccagctttcagaatgcggcccaggcatcgctttcccaggaagccttccttggcatgccgaccacaccaccactggctgaactgtgtcctctgggcccctgtggcaccctgtcctctggggcccagccacccttggggcttctgcccagagtatcagcctacctcactcttcaaggcctgcccgcatactgtctcctccttgcttcccagcactgagtcacaccctgcacaatgcttgtgccagcctgcaatgacctcttttctgtgtctcccatggactgcaggtccctgaagagcttgtgtgtttttcacctttttgtcctaagtgtactgcctggcacatgagaaagcactaagtaaatattggatgaaaggatggctgggtgcatggatgggtgggtgggtggatggatggatagatgaacagatggataggatatggtgggtggatggatggatgagtgggtggatggatgggtggatggatggatggatggatggatggacttatggatggacaggtgagtagatggatagaatagtgggtggatggatggatggatggatggatggatggatgagtgggtggatggatgagtgggtggatggatgggtgggtggatggatggatggatggatagatgggtaagtgggtaagtggatggatggatgggtgagtggatggatggatggacagatgagtagatggatagaatagtgggtggatggatgggtgggcgggcaggtggatggatgaatgggtggattgatggatgaatggttaagtagtatctcccatgtgaaaggcacagtcacctgtcacagggtgcacatggggtgcattaggcttgatttgtactctgcagactatgggggaagctgaggaggaagacttgaccagtcttggtgatgagaaggccttcaccctatgaacacaaccaagtcttagccctctctcctgctcctttaaactctgaactctaggatgggagaatgggaacttttgcaggttgagattcatagtgaaatcgggtcaagaagtgatcagatgcaaagcacagggcagttcattactataccatggctgaggtcttcctgggcaccaggccctggtctcagcacttggctcagtctgcaccttggaccctgccagagccctccacagcaggtgctctcaggcaaggctgtgtgttgctggccagacgccttctgaccagcgtgctttcttgaccacagatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgtaagtgagaaagctgtgtgactgctggatgggcccacggtggccacaaagcatgctgagcccttgaaagcagcatctgcaaacccaggccaacgcgtcaggaaccgcagccctcccaggtgccgcacagggaagggttgtcaggccaaccttccttctccagggccatggtgggcaaagagcccctagcaggaccaggcagctgagccctgaaaggtttgctcgcttggcctgcaagatttgatgtcatctctaaattgaatcttcactggggaattgattccttcatacatcagatctttaactgcgttcccactctgtgccattcatttccaagaattcctgcagtgaatcctttcacaaagccaagcgttcttttatgatgtgaatacctgtgcagtttatctgctttgtaaacctgggtgtgcgttcagtgggcttttaatggtgaatcacacctgttgtgtgagacttttactctgatgttttgggaattggatcaaatagtgaaggtctgaagccttcaatgggcagggggttcatagagggcaaaggagttttaaaatcaaattgacaagggctttttcaatgagctgcatgccaacagtgggaagagagatggggaggaagcatgttcgcacatcacctcccccgactctggctgggctgaggagggggccccacaggcctgggtggaagccgatccctgagcaatccccctgtgcaggattgaacatgattgtctctctttttctcctttttctgactttaaggcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgcc

SEQ ID NO: 38343 - DNA, 8924 bp, Homo sapiens
ctcgcccaaagaagactacaatctccagggaaacctggggcgtctcgcgcaaacgtccataactgaaagtagctaaggcaccccagccggaggaagtgagctctcctggtgagttgggggtcgtttcgcccaccctagtaaatataaagagctctttaatccagccagcttactagtgggggtggggatgccctgctttcagcaaaccgacctttacatttatctctgatttgttctaataggggcgtggttgttcgtgatccttgcatctgttacttagggtcaaggcttgggtcttgccccgcagacccttgggacgacccggccccagcgcagctatgaacctggagcgagtgtccaatgaggagaaattgaacctgtgccggaagtactacctgggtaaggcagatcgctagggtcccaggagaagagaggggactggactagagcacccgagggaagagggcctcggggcctggattcttaagtctaagagatgaaggacctgcgaacgccgactcctggatttgagtggggagggcctgggtcctgaggaatgaggaagctggggcctcaatttctggatcccaagagaggagggggattgagggcctggactcttgggtcctgtgaaagagatggttgaggaatcagattcctggatcccaaagaggagccagattcctgagtccctgacaacagaaatctccatttgaacttgggtgtgggagagtttcttccaaatagatctcggtgggagttggagaagatcttcattgccttatgaggttttggggtttgtttgtttgtttttctttctccctaggggggtttgctttcctgccttttctctggttggtcaacatcttctggttcttccgagaggccttccttgtcccagcctacacagaacagagccaaatcaaaggctgtgagtctagagcacagaggagggaggccagtggcaggggagagggggaagcggggaatcttggtgggaagggacaatggaggatccaaaatgttggggctctgggtgagaagggaaggctggtctagggaagtctggagagcagccggaggccaacccttccagcttctgtttcccatgacagatgtctggcgctcagctgtgggcttcctcttctgggtgatagtgctcacctcctggatcaccatcttccagatctaccggccccgctggggtgcccttggggactacctctccttcaccatacccctgggcaccccctgacaacttctgcacatactggggccctgcttattctcccaggacaggctccttaaagcagaggagcctgtcctgggagccccttctcaaactcctaagacttgttttcatgtcccacgttctctgctgacatcccccaataaaggaccctaactttcgatactgacttcctgggatcttttagaggttgaggcataaatgattattaatatttaaaaacatctgttgagagctttgtacgaggcttagtatttagacatgatgtacattttttacagtgcatactactcataatcttctgaactaggaactttcctgctcaggaaactattagatgagaaactaagaaaggaatagtgcttccatttctttttcttttttcttttttttttttttttttgagacagagtcttgctctgtcagccaggctggagtgcagtggtaggatcggcctagtgcttccatttctaggggctgttatcctgtactggtagtcgtgaattcaaaaatataactttcctactgtgggctgcagtattctcatcagaagtgtagatcacgatgctacttcctgggatttatctggaccaagacgtgtgacaaatggaagtttcccgttttctgaaggaagtgttgtctgcaaaaataaaaatagtcaagagctttctcagagaatccttccttgaccatccatcttatttaaaattcaatcaccaccttgatattcctatgtccctttcaggctacactttttttgtgggttttttttttggggggggagaggggtttgttgttgttgtctgtttgtttttctagatggagtcttgctctgtcacccaggctggagtgcagaggtccgatctcggctcactgcaacctccgcctcccgggttcaagcgattctcctgcctcaaactctcgaatagctgggattacaggcgcatgccaccatgcccggctaatttttgtatttttagtaaagactgggtttcaccatgttggccaggctggtctcgaactcctggtcacaggtgatctgcctgcctaggcctcccaaagagctgggatttacaggcgtgagccaccatgccccgcccagatcatattctttctcctattacatttcacttaaaatttacttgtttactgtttatcttccctcctttaaaagataagctccattagcgcagggatttttgtctattctgttcctcaaggtgtctccaatgcctagaagagtgcccgacacactaataaatatttgcaaaatgaatgaagttgtacctgcaaagagattaacagatacctggcacctagcgagtgctcagtgagagggaacccaacgttattttacattagtcttcctcttagggatgaagggaccccaacggttggttaaatccggtaaagagctaacttggtgttgctcaacccttctcacactacaagtcccgggaagcctcgcgatgccctaatcctttgtttcccaccgtgccccgcgcggcgcaggcgctgttactcagggtgagtctgggaagctggaactacacctcccaggaagctagggggtagatggtttgtttccggaagcaaagccccaggtgggtgggacctaaagctgggagactacggaggcagctctcaattggtcaggatgcgagattgacggctgcaataactaataggaacaagctactgccgaaggggcccgcccacagaagggtggtggccacggtccaggctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcaggtgaggaccctgacgtcgggggcctgtcgggaccatcgggttgacagggtgtggagtcccggtggaagggagtatcgcggaaaggggactgcacgacttttccctgaagcccacctgacaatcgctgtatcaggcagcgagcgttgcctgccaccttcacaccctcccggtgtgcgcttgaagtcgctttgagattgaatggggtggctcgggcaatgacgtgcgtggtaggacatggggaatcctgagccggtaactctgagaagggcccttttctttcctcttttttttaatttaaatttttaaaatatttaaatagagacggagtatcgctatattgcccaggctggtctcgaactcctggtctcaagcgatcctcccgccttagcctcccaaagtgctgagattacaggcgtgagtccccgcgcccagccgagaagttctcttttcttggcttcccctcagtttccccatttccagcagtgatcagagtcacacatcttgctgtgagcctgaagtacaggcactcttaatcctcacagtcactatattccagtaatcctagaaaataggaactgtggtcaatgggtgaagcttagaaagaggagagaattttgggttggggcggagctgaccggatcccaggcctggcatggtaagggcagtgggaggggtgcagaatttagacagaaagataatagtaaaatgatgtaggatgtcccatggcaaaagtgttattaaaacaaagtgggaggctgggtgcggtggctcacacctgtaatcccaacactttgggaggccgaggctggcagatcacttgaggtcaggagtttgagaccagcctgggcaacatagcgaaacgctgtctctataaaaaatacaaaaaaaaaaaaaaaattagccaggtgtggtggcacaagcctgtagtcccagctactcaggaggctgaggcaggaggatcgctggagccggggaggcggaggttgcagtgagctgagatcacaccactgcactccagcctgggtgatagattgagaccctgtctcaaaaaaaaaaaaaaagaaaggaaaagaaaagaaagaaagaaaagagaagtgggtgtgaccacaaatgatggtgagggaaggtgtacacctgtgagtgccaggctgaggagtgcagactccacccctgggtgctgtggagtcatggaagtttccaagcaagggaagatcagggtcaggtttgttatttttcaggaagattcccctggctgccttgtggagggtgtatcagaagggggacactgaggcagggagccaagggggagcaaaggacaggaccaggatgggtagagtagggaggaggtgggtgggagagacactcgggaggcctagtggacaggccatggggttggtgggctgggtaggggagggagaggggtatccatggtgaggtacagggagggacttggggacagtgaggcgacccttgagagggaggcttcaggcccaagtcgggggttcaggagagaggctgggcctgaggagagttgtggacgtgatccgtaccctctgcatctgcccaaggctttgctgcaatctcagctactcccttccccaccctcactctgtctctcctctgagctatgtttgaatccctgtgtctcctgggcttctcaggaagtccctggactggtcaggcaagttcccaggtgtcccctccaggctctgagcactagagccagagctcccaccagtcagaaaggcagagcaaacacctctcaaaggtaggaggacagcgtaacatcatcacttcctcaagttctgtgatgacgggaggcagccacaggctaactgggcaggaaggtgggcctagatctcatttcccgagggggaaaaaaaagcccaaacaggatgttttaggtgaaatctcccaattttggctgggtgcggtggcttctgcctgtaatccagcactttgggaggctgaggcaggtggatcatgaggtcaggagtttgagatcagcctggtcaatatggtgaaaccctgtctgtactaaaaatagaaaaaattagttgaccatggtggcacgcgcctgtagtcccagttctttgggaggctgaggcaggagaatcacttgtactcaggaggcagaggttgcagtgagccgagatcacgccactgcactccagcctgggagacagagcaagactccgtctcaaaaaaaagaaaagaaagaaatctcccaatttttaaatgtcagctcattcagattgaattcagatttaaaattataccactgttggccgggcatggtggctcacgcctgtaagcactttgggagcctgaggccagcagatcactgaggtcaggagtttgagaccagcctggtcaacgtggtaagaccccatctctactaaaaatacaaaaattagccaggcgtggtggcgggcgcctgtaatcccagctatttgggaggctgaggcaggagaatcacttgaacctgggaggtggaggttgcagtgagccaagattatgccactgcattccagcctgggtgacagagcaagactccgtctcacaaaacagaaatacattaattaattaaaataaaattataccactgcctcaaccagattctgcactcaggttgagcctctgtctcataacttcagctttggaaccagacagcctgggttcaaatcatcagctctgcaatttctttgctgtgtgcctttgagcacgtggcctaacatctctgtgcctcagtttcatcatctttaaaataggaataaaaatcatatctatctgagctgggctctatggcatgtgcctatagccccagctacttgggaggctgagacagcaggaccgcttgagcccaggagttcaaaaccggacaacatcgtgatatcctttttcaagaaaaaaaaaaatcacatctacctctaagggttattgtgataattcagtgggttattatttgtaatatatagcatatttaaaccttgccactgggacaggcacagtggctcacacctgtaatcccagcactttgggaagccgagatggctcacctgaatctaggagttcaagaccagcttggtcaatatcattaagactccatctctatacaatttttttgtaataaatttatattatattaaaacacatttttttaaaacccaaaaggctcataaggtaaggtgattggccttacctcctgtcacagagcaatcacgtgggacagctctggaactcagagctctgggcatcactccagccatctctgcctgttgcaccctttcaggctgcctgggcctggctctgagattggccagggcagaggacacgcacgcccttccctggcccagtcagctgcccacctagctggggcctgggagctgactcctgctgggtcctctcttgccccagagctggagatggtcaaagcccggaaccaactggatgctgtcttgcagtgtctgctggagaagagtcacatggacaggtaggccagcgtggggtcacagggccgggcaccctggtgggttgggccctctgatcctgggtggattgggtgggaccccacaggctgacttggggaggaaggtgcttaatggggaggctgctcggtgccttccttctctggggccctggaaccctgagctgagagatctcttctgcctctagggagcgtctggatgaggaagctgggaaaacaccctcagacacccacaataagtgagtttttctgattggatttggagttgagagttcgtggttggtaacttctttccttatccaagccctgaccgctcagcccagcgctacctccatcgtggcccggaccactccacctgtacaaagaccctgtggcaggagaagcttaggtccccccgtggttgccacctagacccccatgggtatgggtgggacaaaaggcccaagaggcaagtggggttcatgtgagcatctcaggtttgataccagtatccccagggtgccctctgcagggttttgcacaggcgtttgtctgagggtcaactgtctttccccacagggactgctccatcgcagccactggcaaaaggtaaggtggcagggtcccagccagctgactagaggctcccagctcctaccccagtcctgacactccctctccctacgcgggccatctgcccgcttcccccaccagcggaggaagaagaggagggagatggatgatgggctggctgagggagggccgcagcgatccagtgagtagacagtggccctagagggtcggtaaggagccaagggcctatgcaaggatgctcacacacctcccatccccaccttcccagacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggaggtgggatgggtagtgggtcccagcccagcagcctggtgccagggcagtgggtggataggctcaaaggatcctgcccctaagctagtgggatagacagacacaggtccctcacgtgaatcctggatcaggctaggcacacagatgtgcactcttaggttggggtgtggatcagagtccctagggaagacatacgtaaccacctggcctgggagacagggaacagggttaccctggacagttagatgtggacctccaagatcaggggttcccaagagccgaggggctagacaagggtccttagtacagacagaagtggccaccaggccttgaggagcaggggctgggcaggaatggatgggagtctataagccatctgacccagcggggtagacaagggtccccaggacagacatataggacccttcagacatataggactgtcagaaatggacagagcttcctaggtggcacagacgtgaccccctagacaggattccctgaggcaggcagacgcgactccctgggctgacaggtgtagatggagtctctgggctggataggagaagacaggggtccctggggcaggcacacttgacccgctggctggttgaggtgtctgcccttcatacatgcctcctgtctgagtcccttagcgagcccctcatgccatttgttgctgggaaaggcaggagggatgaatgtggattcccagcccctctgctttgactctcttgggcctggcatggggcccttgtgtccccagggctcagaggtaaccaacagcaagagtcgtgatgtgtacaagctgccgccacccacacccccggggccacccggagatgcctgcagatcccgcatcccatctccactgcagcctgagatgcagggcacccctgacgatgaggtgagtatgccaggctggcccagggttatggggcacatgcggtagggctcaggaatggccactcaacctggcctgtctgtccatgcagccctctgagcccgagccctcaccctccacactcatctatcgcaacatgcagcgctggaaacgcatccgccagaggtgagcgtcccccagcctgcttgcccctcgtagggccctttgcaactgctgagtctcccctctgcctccccaggtggaaggaggcctctcatcggaaccagcttcgttactcagaaagcatgaagatcctacgagagatgtacgaacgacagtgatgttcccaggtccccccacaccagtaaacatcccccagctcc

SEQ ID NO: 38344 - DNA, 14416 bp, Homo sapiens
agtgcgcaggcgcagtttgccggccgccatcgcgcactggggctccgggcggctgggaccggcctggggtagctgcgcagcaggtgggtcggtcccggggatgcagcgcgggggtcagagagcgaccccaacagggtagacggtgaggacgcctcagtgggcagcgttagggaaaggggccagggtgttcccggggttggggtgcgagcccccgctgtgcgtccaggaggccgagggtctggcatcccttcgcgtggagtgcggggcaggggccgggtccccccggaggtggctgagatccagatcggtgaggggccctgcaggcaggtagggaactagtgcaacccccaccccgtgtaggctcgtggaggggaggcgcttagggcaccctgtgggtgggagaacaggaaggggcggctcctgatgggggagagatgagggagggggaggctcctgatgggggagaaaggggggaggggaaggctcctgaggggggcgaaaagggggagggggaggctcctgagtggggaagagaagggagggggaggctcctgaagggaagaggaggggaggaagtgggggctgagggtgtgaggatgtgagggtgtccgtggtggggggacgctgggcaggctgtggccccaggggctggagcagggaagggatggagggtgcggggaccaaaggggtgcctagaatgggcattgtctctgctgcccccacccttggaatatctcgcctctccccagtcacctgggggtgggttctgtttgagttaggtgtctgcgcccaccccggagacctctctcgtggaagaggcaagagtgggtgtactggcttcggtcctgacccagggggttggggtgggggcctgactcaccctcccatcactccttccccatttcctttctctcaccctcctgggctccttccttttcccaatccccctctacccccgtccagactatctggctttccctgctcttgctccttcctctcctgtcttctctctccctgctaccttccctccccgcttcccccatttctgtctgccctccttccactttcccatatattcgcctgtgtccttgctgactcctgggcgaggctgagtggcacagtcacttggttccatgtcacctcctcggttccatttcacttcccccatcccatcatgtcctgcggatggtttcctgccctggagtcagagcgggaccacgtgtcgcatcgagttgctgttttctgtgcatgatgcttgaatctgtgacttcctgggtatttctggcctcgggttttcggggagcctaggccagttgcgcaggacatctctctggttctgtctgtcctggcgagtggatcagggaccacaaaaggcagctgagatgtgaacgacgacccttactccatgttttttcattcttttaaaagcacttttacccctttttataatgagtaagtgatctgtggatgaagccagggcagaccctgggaatatccggcgacccatcaacaaccacatcccatgcattgagcttccctggctgatcctcaggcctgtggctgtggggtggtttgctagaccctgccgatgagtgtggtgggatggagagctgcgatgaatattcctcaggtggccagggctgggcccacggagggccaaaccaggcttgagctctgctcagcccaggatgaaggggatttgctgcaggactctggagacccaccaggcttgggacccctcagctcagccacccctcacccaccgtggagctctctgcctcagcttctgtattccaggcctctgggtgcagcaaagcctacaggactggctcaagacttgtgcagattgcttcatttgctgaggctggggggctgggctccaggaaaatcccatctgaggcaaatcctggacagtcccaagattaggggagggaggtttgcccagtgaccaagccagactccaacgaggtgtggcctcattcaagcaggctgtggcaggaaagggtcccagtggtatctctattttgtttgtttgtgagacacgggctcattctgtcgcccaggctggagtgcagtggccaatcacagcctccaactcctgggctcaagcagtcctcctgcttaagactccccaggctctgagattatagatgtacgctgccgcacctgccccggtgagatctctgagagtcctcttgacagtgtggccaggaatggggctgaaggaggcaagaagacacagggccagagatttctggaggctcttgagatggcctcatcctcctggctgtgagcatcagggtcccagtaggaagggagatgaacagggagaggctgttttcacaggaggcagcagcttccttggagttgggcgttttaggagacccctggttccatggaagcttctgctttgcaggtgaatggaggaagtggaggcagaggtggcttcccagagaggctcacaacttgtaatgctgagggggaagggcacagaggcgaggagctcccgttcctgtccccaggggctgacatgtgtcccccactgtcttggccagtgacccagccggagggtgtcccgtcctccccacgtcatcccgcccctgccaatggccgaggacccttgctcattctacctagaccccgatgcctccaccatgctcagagctgggaagttggagcaggaggagaggggctgggggagctggctgggatctgcccactgtggaggccatgagggctagaggggagggccggcaggaggcctcttaaagggcaggcttatgggcctggacggggaaggatgagtggcagcgtcactttgcaggtggggtcccagccttagtgattgcctgcctcgtgcctctatttcccacttgcaccttggggctgcatgtggttcctacccctctgggattgtgaggttctgatgagggaaggttctgtgcacacacattatggagctcacagtttgttttgtggagacaggttctctgcaaggtgaacaagcctctggcgtcctaagaaagccaaaattacatgcctgcaggaccacacctctgtccatgcaccaagtagagctctgtgcctccattgccagggggtagagctggcgtcacgcctcccatcaggagaggctccagaacaggggttagcgtacccacctgcaggccagcagtgacctgttttgtttgtattcattagagacaggatcttgctgtgtcgcttatgctggagtacagtggcacaaacatagctcactgcagcctccaactcctgggattaaggggtcctcccacattagcctcccatgtagctgggaccacaggtgtgtgccaccacgcctggctaattttttttttttttttttttttttttttttgcgacagggtctcactctgttacccaggctgcaatgtggtgttgtgatcacagctcactgaagccttgacctcctgggttcaggtgatcctccaacctcagtctccagagtagctgggaccacaggcatgcaccactgtgcctagctaatttttctattttttgtagagatgaagttttggtatgttgcccaggctgttcttgagctcctgggctcaagctgtccacctaccgtggcctcccaaagtgctgggattacaggtgtgagccaccacacctggccacctgtttttgtaaatgaagatgcataagaacatgccaaacctgtgggtacgcacagggctctggttgcttacttgccacgaggcagagttgagtagttgaaactgagactgtctggccctttatatctgctattctctgttcctggaggatgaataagaggatgtatttcttttttttttttttgagacagagtctcactctgtcgctcaggctggagtgcagtggcgcgatctcggctcactgcaagctccgcctgccgggttcacaccattctcctgcctcggcctcctgagtagctgggactacgggcgcctgccaccatgcctggctaattattattatttttttttttgtatttttagtagagatggggtttcacggtgttagccaggatggtctcgatctcctgacctcgtgatctgcctgccttggcctcctaaaggagaggatgtatttctaatcccaagggaaagaaaccctttttaagtgggtttctgaactccgaagtccaatttaaaaaatggttgaaggctggctgcagtggctcactcttgtaatcctggcactttgggaggccgaggcgggtggatcacttgaggtcagcagttcgagaccagcctggccaacatggtgaaaccccgtctgtactaaaaatacaaaaattagctaggcatggggcaagtgcctctaaccccagtgactcgggaggctgagggaggagaactgcttgaacccaggaggtggaggttgtggtgagctgacattgtgccacagcactccagcgtgggtgacagggcgagactccgtctccaaaaaaaaaagtgattgcattagatagtaagaaacattaggacattacctgtgaccaaaagacagcgtggagtgaaaagacaagccacagatggggacagtagcaagatagagccagacagggaactcgttaactggttgacagaaagagctgtaaagaaaaagtcacgggaaagtgggcagtttacccgccctcagagattaaatcatgagaaagcgctcagtcacagagcaggcagatgcttgggtctgagggtcctctggcagcaggtggagtgtgtgaggagagagggcaccccggtgggggctgccataagtaggtgacggtcgtgaggttgtcccctgtgccctagctatcctgcttctccatatgtcctttaaatagatcagaaaggaccccacagagatggacatgagggtccacaactgccaaaaacaaatgaggcacagccagcatacccctcagcagaactgcactgtttgcacagtccacacacactgagccagctctgcccaggccaagggacctgcctgtgaagaacccttactctcctgggtatgcattccagtgggggaggcggtcagtagggaggtaaaaggcgggggcagtgagcgggtgtcaggtgggtgcgtgcaaggagtgcagaggaaaagtctcccggaggggccagttgagagctcaggcctatgaggtaacaaaagggtgggggtgggtgcagtggctcacgcctgtaatcccagcactttgggaggcccaggcaggcgtatcccttgagtccagaagttacagaccagcctgggcaacatagtgagatccctgtctctacaaaacaaattaaaaattagccaggtgtgggtgatgtgcacctttagtcctagctactcaggaggttggggtgggaggatcacttgagctcaggaggttgaggctgcaataagctatgatcatgctactgcactccagcctgggtgacagagtaagaccctgtgtttaaaaaaaaaaaaaaaaaaagtagaggtatcgtggtggtggtgatgatggcacggcatggctctgttctgcttgaggtaagtggaagcttgtgtagaatgtcttccaacagcacttaagagttccgcacttccctttaaactctggtagccacagagagagaggttgatagttgactctctgcaaacttctggttcttttttttttttttttttttgagacagagtctcgctctgtcacccaggctggagtgcagtggcatgatctcagctcactacagcctccacctcccaggttcaagcgatcctcctgcctcaggcctcctgagtagctggaattacaggtacccaccaccacacccagctaatttttgtatttttagtagagagggagtttcaccatgttgaccaggctggtctcgaactcctgacctcaggtgatctgcctgcctcggcctcccaaagtgccgggattacaggcgtcagccactgtgcccagccctgtttttttgttttgttttgttttttaaacagcttattgagtgtaatttacatactgtgaggtttacctatttaaagtggacagttcattggtttttaatatgcagtactcaccgttgagcattttcaccaaccaaagaagaaatcctgtacccattagcagtccctcctcattcccccaaaccccagcccctggcaacagctgatctacattttgtctccatagatttgcctgttctagatgtttcatttctgtggaatcacacaccacaccccaccccacagcggtgaggtctttgcgccccatattctggtggagcactgtcagagcagaacttgacgacctgagaagggctcacagcacctggcctggtgtggtttactctatggttttccctataaaactgggcttgctgcggctgtgggaaatccccttccagctgtctctgtggaccttcagacccaggcggttcctgggagaaggtggacagctgcagttcacacccttgtgtgtccatagccagtgacatgagagcccgaggccgactggaggcctggacagctgtgacccgctgggttctgtttagtgagctcattgttggtgcacagttacaatcaagagagttcatcctgaatactggcttcacttaatgatagggctgccctgtatgtggggattcagctgagggtggggcacaggttggcaggacctgaactctctcagtcattgtggtctcccccaccccccaccccccattgtccttgctcctgggtacttcctgcccctcccgcctggttctgtggatgctttggtcaaagcctacatcctgcaccatttccagaaacggggaggtgggtggttgttcagtggcctccagagggagccccccgctccctacgcttttttctaaataattttatttcagatttgtggtggttttaactggaggaacagtcttgacacctagctccttcatgttattagaaattgacatccctataatctatcttttttttttttttttttgagacagagtctcaccgttgcccaggctggagtgcagtgacgcagtctcggcttactgcaacctctgcctcagggttcaagcagtcctcctgtctcagcctcccaagtagctgggaatacaggcacccaccaccacacccagctagttttgtatttttagtagagacggggtttcaccaggttggtcaggctggtctcaaactcctgacctcaggttatccacccatctcagccttccaaagtgctgggattatgggcgtgagccaccgcgcctggcctatttcaaggtttttacatccaggtttacatagagattgtcaagtaatttttcattttcatcctattcatgactgattttttaaaattctggtaatgatgctgggcgcagtggctcacacctgtaatcccagcactttgggaggctgaggcgggtggaccatttgaggtcaggagtttgagaccagcctggccaacatggtgaaaccccatctccactaaaaatacaaaaagtagctgggtgtggtggtgcatgcttgtaattccagctactggagagactgaggcaggagactcgcttgaacccgggaggtagaggttgcattgagccgagattgcgccactgcactccagcttgggtgacagagggtgactcggtctcaaagaaaaaaaaattctggtaatgcacagaatgagttaccctccatttacatgctactttttatctacatgagtacaacactgaggttctactgatgcctaacaagcgggtttcttggaaatctgtgtgaactctgggtgtggtgtctttgttctctggcagctggggtggctgcgccctggccttatgcaaggccattgccttgtccgtgtcctctgcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccaggtgggctgtcacagaggagaagcatggctcagaggagatggggaggggatcctggaaggccccagtgccagccatggcttgcctgagatagttaagttccccacactgctgaggcagctccttggtcctcgggccaggacagatgcctgggctcctgccttctagatgtaaggaagccagaggaatgagggaaagggaccagcctcttttatttacttatttatttatttatttatttttgagacggagtctcagtctgtcactaggctggagcgcagtggcgcaatctcagctcactgcaacctccacctcctgggttcaagcaattctcctgcctcagcctcccaagtagctgggattacaggcgcctgccacgatgcccagctaatgtttgtatttttagtaaagacagggtttcaccatgttggccaggatggtatcaatctcctgacctcgtgatctgcccgccttggtctcccaaagtgctgggattacagttgtgagccaccacacccagcccagcctcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggcctcgatctcctgacctcgtgatccgcccgcctcggcctcccaaagtgctgggattacaggcgtgagccaccgcgcccggcccccagcctcttaacagtaaatattctgggtactttgcaggctggaggtctcctggtccaagatgaggtgcaggatgggtagtgatgtggccctggagcctgcaggtccctgtggtttaactgtgtgattgttgttggcacgtgtcctgacctcttggggtcacaggtccctccactgttgacagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacacgtgagtgcccagctagcctggcagcctctgctgggccttaggtggggtgttgggcagaggcctgtggttgggagagggcagaagggcagccagggagtcaggggctccatggtccatgctatcattgggacttcctcctgtagtttctctgaatgttagacattgtttattaaattagtcttcagagattatgcagatcatccatacttaccacaaatagtgaagaaacatcaatacataaagaaaagaatctcccaacccccgaccatgaaccctctgaaaataaagggtctcaagtgtcctgatgcacgtcccctcatgtctccctgcacatcacacatgcataatcagggcctggggtcgggctctgtgtgtgtggtgtgctgtgtctgagtgcttgctgttcgaggggtgggtcccccaggctgtggttgggtctggttctttagttgcccagcatcgcgtgctcagcccatccccatcctagaggtgggctctctgccccttggagtgaagctgccctgacacctcctgacttgtgtgcccatatgtgaggctctgggcactgtgggtggactcctcaggaccactgggcaagtggtgtgtgagttcgacatttcacataaaatagaaacttccatgtggttttccagaagttttgtggctgttcattaccagcacggaaggtgcccactggcctggatacagcccagcactatgtggtgttgctttttaggatttccacgaaggccaggcacagtgcctcatgcctgtaatcgcagcactttgggaagccaaggcgggcagatcacttgagcccgggcattcgagaccagcctgggcaacatagggagaccccatctctacaaaaaatacaaaaattagccgggtccgcacttttagtcccagctacttgggaggctgaggtgggaggattgcttgagtccaggaggtggaggttgcagtgagccaagatcatgccactgcactccagcctaggtgacagagcaagaccctgtctttaaaaaacaaacaaaccaaaaaaaaaaaagatttccatgaatccagtggacttgaatgggcatctctggggccacccaagccctgtggccaccgcgctgctttgtaaatcagggaaaggtgtagtgtccgttgagccttgggtgctgctgtcacagaagcacactggggcctgtgtgggaggcagcgggggctccttgacccttgagggcacctggccacagggagctcattgcctcagctctgcctctccttctccccagcctggctttctccggaccccctgtttctggaacagaggagggtcagagaagcaaagaccgaagaggacggccctgccaacaccgagcaggtgggtgggcacgagcaggtgggtgaggggccttggcctcagcttagaggcatccccctccccatcaccagtgctcagcagagggctgtggccccaaacgtccacagcgctgaggcccagaacccaccctggtgggagcgtgagggcggaatctttgtggtgcgaagggggctgcctcctgcagtgcacctgggttagagtccctggccagggctggctcctagcctgctcctgtggctgtggggctgcggcgggtcctcccttctctagggcaggtgggaggtctcagccacgactaatgtttcagaagctgaagtcctttccagaggaccctcagcacctgggggagtggggccacctggaccctgccgaggagaacctgaagagctaccggaagctgctcctgtggggtgagagtcgcctgcctcggggtcacgccccactccccatccccttccgcaggggttggtgcaggagactgtgaccccagggactttggctgggacactgtgatgtcttacaggatttgaacttgcacgtgttggagcttgaatttattcgctgaagcccccaccctttctgatctaaacatctgagttctgcccaggccctgcctgtaggactgaagcctcggaatttggaaaggcctcctggccccaaggcgcccacattgccaccctccttgccagatacagggcctcacctgcatggcctgatcaagggtctcctcttttgtagacgttcttgccccagaaaccctccttttagggaggccccccgactcagactcctgagcaatttttgtcaatgtctttctttagctttgctttctctgagtcctgcctccgcctgccccgttgcccttccagcctcgccttcttctttgctccactgtccaggggcctaacagggaggtggccttggtgggggtcccagtacagagaagaggaggtgggctgcagcctgccctggctggcccacgacacacaacacccatcagccactctgtgttgatgccttttatttctttggtttttaaccccactcagggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctgaggctcggctgggtcctcctctccctggccctgggcggggcgctcacgctagggctctgaccttgttccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacat

SEQ ID NO: 38345 - DNA, 155188 bp, Homo sapiens
ggggagagcggtggcggcggctgcgccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggtgagtgacccgcccggccccctccggcggcagcgaccggcaacttgttttgtttgcccgcgtgtggagggagcaggggcggcggggtcgcggcacggcgtgggcaccgcagctccgcaggtggtgctggcgcagcgcgggccgagggggtgccgagccccgcgcactccgacctccctggccgccgccggcccgccccctcgccgccccttcctccgctcttccccgccccgggctccgtcgccgacacccgcgctgccgcggcagcggctcgggcggccgctctccgcgccgggactgcgggcggagcgggcggagagccgggtccggggggctgcggccgcccggcgtcccgctctggggggccgggaccgcagcgctcacggcccggggacgcggggttggtccaggctgcggcctgtggcgcgtgcaggcctgaaggaggcgagatgccgatgccgccaccgctggtccggtggaccaggccccttggtccagcctcccctcccgcagccgcccgtctgggggtgttcgcagccccgggctcccccggcccgcccgccggggagtgggagggcgatggcgccccgcctccggctcttacggagagcgcgcctccccctcaactccggcggcggggagccggggtgcgatgcgcggccgaggcctcgcccggaccgccggtccccctcgcgtccctgggcgagggaggggcggttggccggagatggcggaggggcgtccccgccccgcctgcccgccgcccccagccctcagcgcctggggaagcccctgctgtggcagtgctcgggcgctatccgggggaagaggagcagttcctcttccttggctgcggcagggctgcttgggccggaaaactaacttgtgtcggcgcccggccgccccgcgccggctgccggctagctcaggccgacgccgaggggagcggcggcgcggagctcgcggcggctccgctgggacgcatttgtctgccgcccagggcgcgagtgttagcgctgacattccttggatttggagggtttagtcaggcgcctcggaacattagttacccggagccgcgccgcgcggggaagggaccgcgggcactgcggcttccctgacccggcagcgggcggcgcgcaccggcctcgcccccgaccctgacctgcttccccccggatgaaccgttgcaccacctgcttcctcctccccgctgggacagccaactgggccggctgccagtgggggtaggagagggtatgaggggctcacgaccgccgaggcggcggggctgcaggaggagtcgagtcgctctctctgttgtaaagtgctttttgcaagtgtgatgagcatcgcttctatgtcatgtttatttaactttccttctggaaagttagcatcaagaagttgggcaaaaaggcttgtggcgtcctttcaagagtaagaatcctaggaggagatcccattatcagctcttcgcctatatcatgagattagatgtaatctggaagttttagtatttgaagtctctacagcagtggaatccctttgtaatatctgggatagattcccatctaagtcatctaaattgatggtaataaaaagtatcagttttccttttcagtacatttgcggttttaagcttctcagctcatggagtgatggtgatctttttataattttgctctcaatatgacttattgacaaaggataactgaatattgcaattgaggatatttgttttaagtcatcaaatggctttttacatgtagctagaaatgtttaaccccctattttctggtagagaaactgacgaaaaactgacaaaactagctaggttcagaatgtcccgcccttctgatgatcttttaaagaggtggcggaacatcagcatcacttgccaactcgtggaatattttattagtgcaaacaaaggatgggccataatgcccatttcagtactatatggtgatgataaagaaggtgatgatatcttgattttttgtttgtttcagtgtacttgataaagtttctcagtggatccagtgtaatttctgtcatttgtcaaaaacaaaaggtagattttaaagacttaacataattaacattaagaggaatgcttaggtatcagaagagcaagaaagacccttttattggcttcccaggtaaatagtaatacaagcaatttaaagtgtagcttataaataataagagcataaataagggattattgccttcctttaataaagactaacctaggagcttttaaggtacagtgctagaaggacaaatcctgtagggaggattctgactcctgagtttctcctcccccttgtggttcttttacttcgatgactattgcatatattccacccatggtgagatctctgcttctctttaatgctgatctacacatggacttttttggatccctttaaatagcctgaacgatccagtttaccaggtatgggttctgcctctactccagcaagcttgtacctgtggctccattcaccctgtgccactttttgtcttgaactatgaatatgtcatacactaaattctgttacagccttgacaacttgggatggtcctttctcatctgcactatttccttgttttaggtctgtccacctgtggagtcaagacaaaagaaacatgtttcttatttccttcccatctctgggcctcttgccctttctctgaagtgaatgatgtgaaaaatgaccttacatttccgatcatattctgttgtgtgattttaaatattgatttatttgaacatttttgagtgccaattatataccaggcatggtactagttgttaaggaaatactccttgtccttaatctcatggatcttgtaaaaaccacacagcaatcaaacctcgataaatatataaataaaaattgtgctactgctttcatagtgaaaaccatagggggcaagaaaatggaggaatttggtcataaaagccttacttgaagaaatgactattagcagtagcaaatccacacaggtctgaagcaactcgattcttacctcctgtgggaaagaatttattggaggggcataaggcagagtgagagaccgaggcaaatttttgagcaggagtgagagtattaaaaagctttagagcaggaacggaaggaagtacactttgaagaaggccatgtgggctacttgagaaatccaagtacctcgtctgaccctggacttggggttttatacattggcatgattccagggtttgcgtttcttctcccgtgattcttcccttggggtgggctgtctgcatgcgcagtggcctgccagcagcggggaggggctgcctgcagtgtgtttactgaagttttactcatgctcacttgaggcatttttcccttacaatttgagccttcctagaggaagggcatatactagttaaaagctgccattttgcctattagtgcacatgctggagcccacttgcccaactcctgagatcttagtgggaacctgctgataaccagctttaggtgttttctatctaatgggagactgcctttccatggtgttggcgcgaccaattattatttcagagagacagtttaacaacggcctgaccatcacctgatggccgcctgacattcctggtggtggggggcctttcctgccctgctcatgtctgcctagctgcctactctgacttttgaggcgaaatctgaacatttcaagaaaagtagttaatctggaagtgggtggcagcattcttgagaaggagcatttgggcaaaggtcctgaggcaggaggtagcatgagtgaaatagtgagaaactaggagataaatattgttggaacgtggagaatgacaagtagaatgatgccacacaggaaagcatgggtctcgtagtccatgctaaggaggagatcttaagtgcggtgagaagccgttgaaagattttaagtagggaagagtggatttgtgttttgaaaagatcactctggctgcctacagaaagtatgtatttgtctatagaacaggtagcaggagtcctggtgggggtcatcattattcaggtgggacataatccttgcttagattggcagggcggtggtagagatagaaaaaaataaattgattcaagagctcctaaagatgcaaaggcatcaggatttggctattggatatggtagtgaaggtgtcaggaggcctaggatgatagattatttgtttcattatggaaagttctcaaagcaaaatgtataccttcttgtattgtattttatgattatgggaagcttttttttttttagtctttgccctctggatattttaaggtcagcatttattaagattatctgcttggacttgcaaagcacagaaagttcctttaattaaataaattatgtcccagactaacaccatttatcccaggttttagccctgagtgactgtctacagttgacccataagcctctgaaaataaaggtttttaaaggaaatgttgacagatccattaaaacagcagtcccccacctttttagcaccagggactggttttgtcaaagacaattattccacagactgggggagttgggttgggtgggggatggtttggggatgaaactgttccgcctcagatcattaggtattagattctcataaggagtgtgcaacccggatcccttgcatgcagttcacaatagggtttatgctccatgacccagggttggggacccctgcattaaaacattcagtactggtgagaagctgtgtgtaaactaatgactctctggatatgcaaatgcaactttagtcaagtcattaatgccacttaggttcagggtgtatataataggactaattcaggaactagtaggccaagaggttttatgtgataggcaagctaacaggtttgaaaggaatatagcttaaatgaggattagtggctgaactgattaccctggcagtcaagttccaccttaccaaagccattttatctcagtgatgatcagttgtaacctgaaaaattctgcccttgaacatgagattgtacttcaaatggaagctctgtttatactattagggatggagctatcacttagtgaaagtgtagtgtcttaagtggtcactgttctctcagtttcccaggctatacaccttaggattggtttttgtttcctttgctgttttcagtgtcccatcccccttctccccccacacataataatgattaaaaatatcacatcaccaagtctgagaagtctggggtttatagacttcctgaaattaatgcagaacttttgcatacatctacatttttttctaggttgataatcagaagctttcatgtttcctaaagtgtcctctaaaccaaacaaggcttccagccactgaccatgtgccctttgaaggcagggttcatgtttcctgtttgttgagtatttcctccatctttcctggtgctaattttatggaaggcacatattaaatatttttcaaagaaactaaggtacatccatttatgtctcccacataggtctgaacatttcggaaatgtttggcgaattcctaagaattgttgtatttatcacttctgtggaaaagttttccatccagtggtctatgtgaggtcaggcatcagccctgttaccacctgcttgcccctcccccatccccatcctcccctccctaagacctcatgaagaatactgataacacctgaagtgggagttcctgctctcacaatctagttgggggtggggagagctattgcttaatccagtagcaatgtaaagaaataatacaagaactgtcacaaggatatgtttcatcagtagtcaaaccagtaggtggagaaggcttaaaatggcctttggggaatgcacagttactagtaaagagagaatgaaaacttttgaacagcagtctattttgtgacttaggctggttgcatgggatgggagataacgtgtgagatacgatttgggttcctgtataaactgttagacaatagtaaattggagaaagaggaagagagaaaataattcacgaatgaaaagcaaaattctgagcttgagccatctgtaaacagaatatgtggaaattctaacttgagttattaaaaaagttggtcagcaagatttgagtagctattgaatgaaggaaaatgactgtgattattcagctcctaactagataattgtctttgttcatattttgaatttcgattctcattcctgaagaatgaatgtacaatctgaaaagtaactaaattaaagatttcagtaataacagcaacaataatagtttacatatattgaatccttactttgggcctaatacatattctacatgtatttggttgtttatttgtaacaaccaccctctattgcaagtccgatggaatcccaactttatagatgagactgttgtggtatagagaggtgaactctttgtccaagtttattcacttaattaattgtagagccaggattcaatctcaggtgttctaacttcagagctgtgctctctgatcttgcactacagtttttaacaacacagacaagtacacatgggctacattaaaaggtggatatgtagacgctagctgggtaatttcagataaacactgaagacaatatagatggtccctgacttaccatgattcagcttacgatttttgacttttcaatgggtttatcggtgtgtaaccctgtcataagtctgagcacatctggacttaagatgtcttatgattcttcaagtttacagtgggtttgttgcagggtgtaaccccttgtaagtcgaggaacatctgtacatggtaatatgaaagagaatgggaggctggtgcggtggttcatgcttgtaatcccagcgctttgggaggcctaggcaggcgaatcacttgaggtccggagtttgagaccagcctggccaacatggtgaaaccctgtctctactaaaaatacaaaaattagccaggcatggtagcacacccctgtaatcccagctactcaggaggctgaggcaggataattgcttgaagccaggaggcggaggttgcagtaagtggagctcgcgccactacactcaagcctgggcaacaaaacgagactccatctcaaaaaaaaaaaattaaaaacaaaaagaaagagaatgggttggaagggaccactcagggaatgtcagggaaggtgatggccagagcagagtcttcaggagtaagtgtaagactatcatgcaaatctggcggaaaagcattccaggcagagggaacagaagtgcaaaattcctgaggttggaatgaggctggagtatttgaagccagtatggccggagtttgttgagtttggaggtagtacagtacgggatgagcttgaagatgtagtcaggactcagatgatgggggtgtgtggctcttgtggtctgttattagggtgattatttgttttagtttacatttgctgcccattagccattattatcctttcactctcagaagtgtcctgggttggatggtaaattatatggatgtcttgcttaaagtgtattttcctagataaataaaatgagtaataaccctttttggccacagtttgtgggccagatgcacaagtaaacaattgtgctgggtaagacaaaaactgtattagttaagtccactgagtcctgtgggagcacagagaaaggagcatctagtgtatgggactggatgctgtcagagagcttgtcttataaaaagagatgctggagagatgaggacagaggagactgtgcaacagcataaataactgtgaccaatcctggggactacatggctgaaaattgggttggagaggggtggaatggaagagaggactctagaaagataaatagaatctgagccatgaaagactttgaatggtcagagctgggctataaggaataatctggaaacagtgcaagctagattttagtgaggagagaattatgtccgaaggatataatgaagcttaaactaaggagaaggacctagaaactgaatacagaggaagagattatggaagtataatagaattgcccagtgggaggaggaatcattcttgatggtaaaggaaaggatgttgatgcctttagaaggaatacagctgtccaaagcactggctctcaaacttctttaggcttcggagtcacctagagggtgtgagaaaacggattacttggccccatcccccgaatttctgattgagtagatttagggtagagcagataatttgcatttctaactagttccccggggatgctgatgctgctggtccagggatcatgctttgaggagtgccagtctagaggttatatagatttgggggctgcaaaatgaaaatgaaaaatttggtttggtttggcatatagtattttatagaacacaggtcagtcaagtgaaggtgtcttaaccaggtcgatggagctcagaatggaatcagaagtggatgcatttcattggccagagggtggtgtctgaagcacagggagtgggttggtaagttaaaggagcctgtgtggatggaggagaaaaatgtgtgtattaagaagaaacatggaaaatgccttcttttaggctctaggaggttggtggggagagatgaaagaaggcatagacagaagtaaaatgacttagacgatattgcctaaccgtgagcaaaaataatttctttaaggacagggccatcaacaaattcagatgttaaaatgtttgagaactgattagaatgaaagctgaaacgagtggctgtggaagcattacctgcctgctaacctaaccagtagtactttggtctagagagggactacagcagcatcatcattagcatctcagtaaatattgtggcccagaaaaactggttcagatgataaagaagttcaggtcgtgaagagtcatcttcactatgggaaaaatacaaatagagaaaaagttttattagagaactgtaactatcaaagaggaacttaacccatttttggttatatctgggctaccataactttatgtgcctttccacctctccctatccgcaagtctgtgtgtgtgtgtgtgtgtgtgtgtgtgtgtgtgtgtgtgtgtgtgcgcgcacgcgcgtgcgcacagacacctatgtatatatattttagttgtgatcatatataatactatataagatagatattgcaacacatattagtctttttttactcatgtctgaaatctggtgatttgaaaagctgtgactagaaaaccaatttaatatttaaagttggaaaataaattttattctgagaacatgaggcaatttttagtttttagtacattaatttgactgaaggatattaaaaaaacaatagcaaaactatgctattctcagcgtagagaaaatgtatgctcagcatttcaatactcttagtttttaaaaatgaggtttatcattaaattatagttcagccctgtgatcctgaaagcaacactgagacaacatgaactgcagtcacctagggcctatgtctttttggaaagggaagagctaactttcagttgcttaatttgctaagaatcctgaatatttccaaatgagaaatgttctcatttctgcaccattataaattcccttctgggcttcccagccttggaagcattttcaggcatcactcccaagaagcatttaaacatgccgacagggagacctgattcacttcactgaatacaagaactggtacactgaaacttgaggaaaaatttaactttacattatctaattaggtttatagaattggtgcagagcagcctggtttcccaaatctagaaggtacgattaactatagtattatatcaataccaactagtctgcgaataggcttctaagcaataggaatctgttattacaaagaatattttaaactggatgagttaaaattaagtcacatactatcggaaaccattttgtatgagaatagagtagatgacctagtcattttttaattttaatttttaccaattccctgggtttaggaatacatctgagcctcaagaggtatgctactgtcttcagtagtaaacttaacatgctcagtgattatctggcttaagtgtaattttggcatttgtagttacctttatgaaattattttttatgcatagctgtttactatgaaaactatgtattcactggtaaagctatgcttcctatgaaaactgtgtattcgctggtatcttataaaaagaaatggtattatttattatgtaagtatatcttaaataggcagtaactgagaaattgccaaaacttttttggagcgagttcactcttatcagaagttgggtatgtcagcatttttatttattaaactgtttgtattaataattctcctttaacttttagttttccttttaatagaaacatcagccaggtgtggtggctcatgcttataattctagcattttgggagcctgagcctggaggattgcttgaggctagaagcctgggcaatatagcaagaccttgtcgcttataaaacaaacaaaccaaacctgataagatattctttaatgtgagcaaggtttgcaagtagctttttcaactgtgcaaatgcccaactccttctacaagtggaacccttgatttaaaaccaacccattgattctagttattaaagtaaaacaatagtttcaattcctaatgtagtatgaagagacccctttgaaccatttcacagaattttaagaattaatacttgtagagaagtgatatcatgacaacatcaatgtagtatctttatgcatctgtgagaatttggtttttaaaaaatatattccttagaaagcctaaatagaaaacaaaacaaaacaaaagaacagtaaggtacagttgtacattgcaaaaaagaagtccttaagtcatgatgcgtgaagttctctagaagttcttgtcagtacttactgctgtacttcaaattttttattctgtagatatgaagtaaatattttatatactttttattaacatttattatcgcaaaaatagttcccttacaaccctagcataaattaaaactatcagtatacttaagtgagtcatgcaagtgtcattttgccaggatatataaaagatatctgagtaatgatatttagaaatggaaaatgtgaaaatagcatcattataggaagattccaaatctgtttagatttataggttatggtcatttatataaacattttaaaaatgacaggaacagtctaattacgttaagtcaattaagttttttttttgcttgattgtttaatgctcttatgaaaaacacatatttgtaaaagaaattatttgcctagaaaaatttaccatgcaatatatttcatcatattggagttccttttttttttttttttttgagatggagttacactgttgtcatgcaggccggagtgcaatggcacaatctcgactcactgcaacctctgcttcccaggttcaagcaattctcctgcctcagcctcctgagtagctgggattacaggcgcccacaaccatgcccagctaatttttgtatttttagtagagatggggtttcaccatgttggccagactggtctcgaacttctgacctcaggtgatccgcctgccttggtttcccaaagtgctgggattacaggcgtgagccactgcacctgcccagttctttgttaatgaaagcctgtgtacctggaagtcaaaggtatactttgcatagccatttcaaaacttgtcttaggtattttctaaaatgtttgtctcattggatataggttttgattgtgcttacttgagaagacttaaatctttacccttctcctggtagttttcttctggcagttcagtattttgccatgcaatttttattagacaatttgatcattgtgtttcttattgcctaatccaacagatttaatcttttaatctcaaatacagcaaggtgtgctgtgcctttacagtctgtttgcagagttttacatcttcgtttgaaaggaagtgtttaaacacccctgttcaaaaatctgctagttcttgccaggatgatttaaaatgaattttaaaaatccattagatttttggcaaataagctctcaattatggtacagaataaatgactacaaagtgctttttagagtaatggaatagaaatgactgaaattttattactttacacatgcagatttttctactgtggtagatgttcttaaactaaaagattactgtcaagattggaaatttttatcacttaaaatatataattatatttgaacatttaagcagaagattgctggaatggggatatacaggcctgcagtttcgttaactgttgctccctgtgtgatggcctcagaggaaattctaagtccagtgttcgtcaaagaggctggagaatgtttcccttttagtgatcagtgaaaataaatttgcttacagtccagggagatcatggtagtagagaaaaaaatactttagtaaataattttctaaaattctctattctaaaaatatactaagaaaggatgatttttaaataccttggtattttaaagaaatacattttctgtatgaaattaagataactctattcctcttcttatagctaacatttagactctaaatcatggcacatgtaacacttctattttaaaataaatgtagggtacgtgaaagcacagttgttaactttgaaaattttgaagagtggaatcacctacagacataataaagctgaaaataccatggcttttcccaggtcctgctgtttgcttagcctgagaaaggaactgccggtatcatccaagtattggtcaaaatacatatatactgtatggtcattctcatattatttttcccagtgtcctatttgaaaatctgaggaaggttttaatgaatgcggcttcgtcttactttccattaattatgactgcaagaagagtacagccactcttgtttgatcagcctatacactatgactaaatggaaagtgaatcacagccagagagtctaatagtttcacagtggtaaaatcatgttttgtaagaagcagttatcatccttgaccaccgctctgttaactggtaacagtaagataaaagtaaatgttaaaatctttcttatatgttggcaaaaatcacttcctaaagataaatgaatggcttgaaacatttattcttatttgcaactacttctttagcttaagtgacaggtacttatgtttaaaaataacatgtcttgtgtaatgatttatgattctgcatttataaatgcagaaagaataactaaaaggaagttgtaagtgtcagttaaggaatagatgcttttttaaatatagaaaattagaaaacttaaggtaagagcaaaagtaatatacatttgttcagtatttttgttttctggtgaattgagatacttttcctactattcctttaattctttttaaaaataactacaatctatttttttctcccttggaacagtggattcctttctctgattatgaggcctggaatttgagtgattcattggtcagtttcttttgggttccagtgggtgctaaaagtaagaatgattattttaaggataaaaaatgtcagttgtatattttattgactgcaggtagctagaaaaagtaaacttgccatgtgggcacacagcgtgttgcctctgaatgatgaggcaagcaggttactcataatacacacacacacacacacacacacacacacacacagcgtgttgccccgaatgatgaggctagcaggttactcttaatacacacacacacacacacacacacacagacacaacagcgtgttgcctctgaatgatgaggctagtaggttactcataatacacacacacacacacacacacacacagctttttctctatgtacctgattcttttaaattaaagataaccaaacctttgaatgatgaggctagcaggttactcataatacacacacacacacacacacactctgctttttctctatgtacctgatacttttaaattaaagataaccaaacctttgaatggtgaggctagcaggttactcataatccacacacataaacacacacacacacacacacacacacacacacacacacacacacacactgctttttctctgtgtacctgatactttttaattaaaggtaaaaggtaaccgaacctttaactcttgagccagtgataatgagaaaataaaatttcatttctaaaattagagataatggaacttaaaaaaaatgtgttctctgtgtcatctctgtgcaccccctcccactattcctctcacacgctgcactttttttttttttttaaagctgcattaataggctgttatatcctttgaaataccacaggtcttgagagggatgaatgatgaaatgtaaagatcagtgattgagcaggaatgggagaaagattagggattgggttttctggcacaaggctcctttctgtcaaaggactgcaaattttcctgggttgacgtgggcttaattttttttttttccccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagacggggcggccgggcagaagcgcccccccacctcccagacggggcggcggccgggcggggtctgccccccacctcccggacggggcggctggcctggcagggactgccccccacctccctgacggcgcggctggccgggcggggactgtcccccacctcccagacggggcggctgccgggcggagacgctcatcacttcccagacggggcggctgccgggtggaggggctcctcacttctcagacggggcggccaggcagagacgctcctcacctcccagacggggtcgcggccgggcagaggcgctcttcacatctcagacgggtcggtggggcagaggcgctccccacattccagacgatgggcggccgggcagagacgctcctcacttcctagacaggatgagggtcgggaagaggctctcctcacttcccagactgggcggcggggcagaggggctcctcacatcccagacgatgggcggccaggcagagacgctcctcacttcctagacggggtggcggccgggcagaggctgcaatctcggcactttgggaggccaaggcaggcggctgggaggtggaggttgtagcgagccgagatcacgccactgcactccagcctgggcaacattgagcactgagtgagcgagactccgtctgcaatccctgcacctagggaggctgaggctggcagatcactcgcggtcaggagctggagaccagcccgaccaacacggcgaaaccccgtctccaccaagaaatatgaaaaccagtcaggcatggtggcgcccgcctgcaatcccaggcactcggcaggctgaggcaggagaatcaggcagggagattgcagtgggtcgagatggcggcagtacagtccagcctcggctcggcatcagagggagaccagggagagggagctcggcatcagagggagaccagggagagggagagggagggggagggggagggggagaagtgggcttaatttaaaattgccttatatatgcagtgatgaaaatcaaatcaaatttaaattactatatggaacaacttcctgataatgtaaaaaaaaaactgatttaggagagggttttcggtactttgaaatattaatattatgaaagttgaacactgatgtttcaatctgcttcactccatccccattacttcttgtcagctgtctatgagcattgggccacttgccacagttttacatgataaccatatttaagtggtaaaaaagatcagaacatatacagtgccttcttaagtcaggttcctgatttatttctggtactatccatttagatacatattaatttacctaatttcttaaatccatggaccagtactgatattcctgtttgtctttatttaggattttacatgtgtacgttaaaaaatacattggtaacagctgactgacaaccaaaaaagtaaaaaagcaaaacaaaaatcaccgtgctttgacaggtttgtcatgaagcaaaatgcatgagaaatttgatctgtttcagtttgcttgttatcagtcagaaatcacctttgctttgcccagagaagactcaggttcactgaattctcttcaccactccgtgaaagtgtgtagcagcatggacagcccatgttatgtacagagtaaatggtgcactgggtggcatgtggaatcttgaaaggacagtgtctcttagatgcttaacttactactgggagtgaagaagatcaatgaatctcaaaaaaaaaaaaaagtggaaaaattccttttggggaaaagaagctagtataatttagggttttaattactatcatacttgattgagagaaatcccttactcttaaaataatacaggtactgcatttcttattttataatactgcttaaatgcttcctgtcctaggcagtataatgaattaaaatgtagtagatatttagcacaagcaaaaaggacttacagtttaggaatactaaattcagaactctgtattgtaacaagttaccaggaagtagtgggggttaaatctgtgctgctgggaaagtgtgttttgttttgtttttttaatttccttgtatacatcttagagtctgcagtttgtatgaaccgtgtgctagtcaagaaagagataaataagcattatttaggttcaagagatttagcaatcttatggttttgggataagctgctatcctagtgatgttttcttgtcactgtctcactgagattttgaaaaactcaaacacatccttaatcaatttgaaagattcctagggaaattacattcaacttgattatggtattccttatgagagcttgggcatagggcaaggagagtgaactttaaggtgtaggaagaagataagtatgtgccacataaaaggaggaggggcctgctatatagtacaaggtcatggcttaagccaatcatttgtcatggggttggggagtctgaaggatgagtgggtctattttaaaaaaaaattgcgttgataaccatgaacattaatccttatgaatactaaatgttctagagaaattatattgatgtgtaattttccttattgtgaaacatatagctccccaaggacaaggtggcagctggcggattaaaaataaaagctgacatcattatatagtaaaagtacacatggactctgacatgggttaaaatgctggtgcaatcactgttaatagcgttagtgagtttcgctgagtgatttactttctgagagcttccttttcctcatctgtaaagtagacataaaatcaacttcatagcaatgttcttgtgcttcctttagatacgtttatcagagcttctatggctgggtttaacttgcacttttatacatactgtttttccttccttctgttccttcttcttggatgagcaccataatttgtacatagtttcaagagtgctttaaaaatgaaaatacttaagttctgcaaacttattatgaattcattattttgaattgtaagtgaaggagggctgaatattgtcttttctcctggacttttagacttttgccttaaaagttatatccttaaatgaacagtgttctcaaatggggaaagaggaaaatattattgtttacttacttttttttttttgagatggagtcttgctctgtcaccaggctggagtgctgtggtgcaatcttggctcactgcaacctccaactccctgggtctcctgccttactctcacgagtagctggcattacaggtgcataccaccatgcccagctaattttttaatatttttagtagagacggatgttggccaggatggtctcgatctcctgacctcgtgatccacccgcctcggccgcccaaagtgctggaattacaggtgtgagccaccgcacccggcctacttacttttaaaatacatttacattaagaaaaaaagaatgtatgttcattgtagaaaatattacaaagttaaagcaagtaagaaacaaaattatctacaacccatcctatccaaagataattatcattagctattggtgtatttcttgcctaaatatatgtactatacatagacatagtccacagtataaataaactctgtggattgcttttttaatttcactgtagaaatattttaattgttgttaggatatgtatagatttgtaattttttttaaccatctggtcattttagtattgagatggtttgaggaaagaggacattagaaaaaaaaaaaaaacctgtgtactgggaattacagatctgaaattgtcatatacaccacatttgcaaaattttttcacctgcccttgaaaaaaaccaaggcatgattttgaattttataagatggtctattaagattgctgaaacttggagtgctttctggcaaaaccagcaattaaatgaagagaaacagaagccatcactagaagagcaactattttgtggcagttacttgtttcactatctcttccctgttctttaccccaacatagttcataacttaaagttgtggactttaaagcactctaaggcttttaaacttctgcctagtgagttagtattaagaaatttaagtcagtgccatggggttaaatatgaggtttaataaaaatattggtttcttaattttgtttattagtcttactcctatagtctgtgtgtcgtgaagcataatttctcttttctttctcctgatgcaactcagccactccaggattttctcattttccttcatattatgaatatgtaaaaattaaaacaaataccttttcttttagtcattgcatagttggactacacttatttcactctgaggtgatagggctcttcttttctatgtctttgcatcttaaatacatacagacattatgcatttatttatacttatatactaatacaacaggtcagcacagtcactcctcacccatgtggggagccaaaattctagtctgaaaattgagcatcaaatactaataagtaacttatactgaactcttaggtatgtttacattcttaatttaatcttctgacattttacagttgaggaaatttgtggcttagagaagttaaattaccttgcccaaggtcacttggtcttctaggtaacaactagagttcaaacctaggctgactgcagagcctaccttttcaggtgggattcagtaccaccaagtagcactttctgaactgtgttctatgaaccaaggtgtattatcaggcattactttaaacaggggttttgggccagtaaggttgataagtgttgcatattgtatcaccccctcagagatttcacggcatacattggtacgttaaaagctttgaaaagtactatagaaaagaaacttcagcattttagcatatctttcacaaactgacctggtcactgatccagtttttaaagaacatccagttttctttaaagaactttagtgtcctgagagaagagaaagcgctgtggacagatggacctgtcttcaggggaggaatctggctgcctctgctcgctgaattctgccttgaggccttcctttcatgttcatgtgcagcatggtatcatccagctgtgtaaatcttaccatccttcaagatcagttcaggatctacctgttctctgaagattttcctgaccacttgagtccataccgatatatctgacctcagcaaagttcctgattatgattgatggtaatgctctttagcacgtggctgtttccccagttggttcctaaactcctcaaaagcagacacaccctactttatattattcccctgtccgctgctgagtagcccctggccttactgccctcgagggagaggttaaagtgttccagtggtttttgtttggtttacaaatactcttcgtctccctggtcttgaaccccggttgagacctgcagttcattctcaatcctcaaacttgaggtgctcatgtgatcatcttacactcatatcagcacttatgctccccatattgttttccatctgaacacctctcactgatcttgcggttatttatcaaaaaagatttctgtttacagtgtatttcacaattaaaaattctactgatagttaaaataggtttcctagaacaacccctgcttggcagtcacctccatcttgctacattgccacagagcctgatgaatctgctaagtatttatgtttaggaatttcttttatgcaggaaaccccaacgttaagtggttccttgactccagttatgagtcaaatggttttaagtataacccatattagatttctattcatacagaaatagatgtccagtgtatgaattatgtttcagttatcggaaactcatttcatatcatggaaatatcaaaatagttcctccaaatcaaatatacttccaagaacattttgcaagcactagagccatattgtgtctattagttggataaatttttctgcataggcaagattgaatgaagtgctttaaaattaaattagtctaataaaagtatgcaccgaaaacaccaccttttcttttggcaactccctgcagtagtcatggatattcttcccttgctccgagggaattctgtgtacaaaattaacattatctatcttcaacatttttactccatattcagtgttcatgaatggctctggaagtctttgaatggtacctgctgggaaacattatttctaccactatcccaatcttatggaaatacatgaaggctgaacaatagattcaactctcagttgattctgttgactctgtgtgaactttaagggatagtaaatatttgaagtttatgttaattaaaatatagatttggctactataacagcaatccaaaatgttagtttttttttttttctcttacataaatacccaaactgataatggcaaaatagacttcatagtcttttatggtactgttagggatccatgccccttctctcttgttactctgtcattcctggagagttgctttagacttcatagtcttttatggtactgttagggatccatgcccttctctcttgttactctgtcattcctggagagttgctttcatctacgtggtctgagattttactaccatgtccacattgcagcagtaggaaggaaggaaacagaagggatttgcttcttcacctgtacgtgtcactttcagtatctttattctaggtagccatgtgcatagctaaaaatggttttagtgagtgggtaactaatgagatagaaagggagaaaggatattgggaggaatcgtagtctttgctacaaggtaataccgtataattttttaaatgataaagttgtataagtaagggtcaaaagtcacttgtagctaactttcattagttccaccttttccttgcctagcacagttagcatggtcttggtatctagtgtaaatctgatcttatccaaacatgaatttgttactttttatattacttggttaactgttgatttcaagtctcttttcagacttgtctcccaagttcacatgaatagggccaggctttaagttttttttaatgcgttcattattaccaagcagtgctttttaacactagtgttcagtaagtttattgaacattgggttatgatgatttattgaaattctacatttattgctttgcttggttgttaatagagtcaatgtctcttgtcttttttctgccaactggaataatccctactccacgtatgtgagctatatcctgtatcagaaatgtagaggaggcgtggaattggcaaagatttgttaccaaaaatcactatcagaccccattgctgttggcagtcagggaaccatggaaaagattatgggtcatggaaggttataagcaaaagtctgtggatttgcatagcagcattgagaggtaggtcttacaatgggcaggttgtattggaggactgaaaaaaaaaaaatggaaatattaaggaaacacacagatagtgattccaagaagaactagcaccaatagggctaaggcaataaaaggaagaggttgggattatcaaaatttggaagctcacaaaagcgcctggcaagttggggttcagatctctggggatgggatggggggggtacttggctggctggctgcctgttgtgtctctagaaaataatggggctggtttggggagtaggagtaggcttgaataaatgctgagaccactccaattactatggtgagttgcctttaagcagcgagcaaaaggatgtaagtctcttccgccagcccttctgcttctgtctagtgtcccctgtttggtaaatcctaatgggaaggctgttggcaagaaatttttgctaagttctagagccagattcacaaagcaaaatatagaaaggtgggtttggaactgaaagataataatcactggcacagtagtggatataaagtcttcctttggcaagttcagctggaagatattgtgccaaacagtactgtgacagaaattagagatggatctgggccagatggtatgtacaagattgagtagaagagtggtctgctcagtcttgaggagtgtcttgcacatataccaaagtcacttttacgtgagaaagcatgctttctattgcagtctagagtttcctttctttccttagaaatccgttgtgaatctattattcatgagtttccatgaccctttgttgaatttgtttgtttttagtttctgtgactcatcgaaaaactacttagtggatttttttaggtgtcttttgttatactggactttgaggagagaaaggtaactaagatataatctctgttctcaggtaagccacaccctggtttgtggtagaaggtgaatgtgaagacactaacattgtatgttaaatattaaaataaaatgaatcatacctgggaagtggaaaagggcaagtctggagaattaacttcgtgcttgtctttcaaagtaggactttgtcaggctgagggagaagtgtgtggagaagtgtgtggtgggtgaggacagcaagtagaaaacacatatttaaagggcatggagaaataattgttaagatgacatgtgctgtatatttaccagttactatataaagaagcgttattcctttgccctgaaatctttctttttttggcttcaaggggtcctccttgtttcagaattttgtatttgatatataccctccccctgtccattatgatttttctgtacttcagccatattgctgagatattcaactttataagcaacaagttcctttaaaaaaaaatacctttgtcttcaaactgaaagccgtctcatccctgtttttatataagttgccctttgcagaacaatttgtagtttctgtatgtggatcctccctacttctgaaaggttgtctggagaggtatcagaatcaccaaacaatgaaagatgcccaagctgccatgccaccagaagggggcatgtctcattcatatgtacactcgagttcttgaattatcatcgttgccttgaaaggctgtagaagtaaattattgggaaaccatcagaatgcacctgcctgagcctttctccctcagtcttcctgtttgtgttcagtggttaatattatcctctccacgtataaaatttgaattcagcaggaccttgtaagacacatgcgtttcattttaagctacatcccattctcagttctctgtccctatccatgggtgggaaggttcaaccctgttccatggacatagctgatgggacaggagtatccaagctaggtcaactgtattctctctcctgggatttttgaatcatgtggtgttgtccactaaagacggcacagagttggttggtaggcatagtaccagggtcagctccttatgcatcagtcacataccaggcaaagttatgggggaggaaaacctaaaaggtttgccaaggaagccagtctatagagaaaggagtgaagtagattttcactttctttccagaaaaagagataaaagaaagatgatatggacagggacaaacagacaaaaaggctcggcctctgcctctgcctaaggaccttctaatattaccatgagacgtgcctgttcttcctgctgattaggttgtgatataggcctgaatccttataacaaacactattttatttaagctagcttaaattggttttggtaacttgtacataaatcattctagagtaacatacactccttacagaaataatctcctgctttaccctaaaggaatttactattatggaaaattcacatggaagccaggaagggagatttttgagcaggaccctcaaatcacatacatgaagtttctgcctagcccttgtgtctcatctgtcttttctctcccctcaccccaactttattttttttaaaggcgttacattcacagaagacaaagcatgtttttgtataaccgtaaaattatttttctataattttttaaagtgatacttagctttttgttgatcttttttgacaataaaataatcatcaactgtgatatatagtatgaaatttgaagaaatttctgtgtaaataagtgataaagcagaaggcagcaaacaagaaaaaggcatttaccaacctcccaaataatgagtagtgtgttagctttgattacaatcccaaaactagtttttttgggtggttaaggttttcatttttaatatcctttctaaagaatatgaaattaatgaatttgaaataaatctgttattagggaggcatccgagtggcttataaaatagatgattttaccaaaaactattgttttttttaaaaggaggctaaatatattcggttgttgacaatactaattattgctttacttatgatgtagttactgtaaattttattcatatgctatgtagttatagtgaaagcaattagactttagttttcaattttcctatttgtaaatggatttaaagtctttttgatagtctaggaaccaattaaatatttctttaatggctcaactaattgctttataactattacttattttaaagtgtttgcttagggtacagagagttaaaagcattaagagataatagtaggcttaggagactaaggatgtaaactaattggggttcttattgtcagatttaatataacatgttaacatacagcatttatacagaggcattctttgtacatgccttaggttgtttaaaagggcaatttaaatttaaagaaggcaatttacttatcatctcggaaattctgtcttgttgccctagggctagtatgcaccatattgcatttaaaaaaatgtttggaaagctgttggaaactttttgtcaacacgtccacatttgcagtaatattctgtggctttgaatgtaaatttaggaatttatcatgttcacaaataaaggagagatgaagtttactaataataaaatgaaactgataatcagttttgaatctaagcagttgtttcagaggcggtttcatgtgagtctttgattaggattttgccttataggagataaatttatttatttattagttttttttatgttatattttgagttctagggtacatgtgcacaacgtgcaggtttgttacatatgtatgcatgtgccatgttggtgtgctgcacccattaactcgtcatttacattaggtatatctcctaatgctttccctccccgcttcccccaccccacaacaggccccggtgtgtgatgttccccttcctaggagataaatttaatctggttttcagccatagtagcattcagactgaatcctgaaaatgtcctctccactttttgctgctgttgaagagatcagtgaagggttttgtaaacctgaaaactctggcttagattttcttagctaaatttctacttagaatcagtgagtaagtgacatatgttaattttcagtgctagtttaataataactttttcataagatttggtttcacacacacataaagtctttataaagccatttgtttcctttaatttcaagacccaaaatattaatttggaattaatattgagtgttttgctcctgatgaagtgtccttaaacaagtctgtcatattgtttgaacttttatttctacttcctcatcttcaagtatttgtgactatttctcatgttgctaaatttagttatttctgaaaaagtaccaaatgacctataaacgcaggaagaacagtcttccaaagcctgaagggggctctgagtgactgactggctctgggcctaggctactttgaagtgcaattcacgtttgaaacagttctcggagtctaatgcccttccattcagaagacctgtaaatgcttgagttgtttctccatcttctctaaagaaaacctgactgtgtaatttctctaggatcttagggtcatgctgcaaaggaacaaaggtgacattaaaaaacactgtacttcctagttgccaataatacctgagtataaccccaaaacatatttcttctctaggaacactagatcctgaaggtaatctctcaaagtaggagcagagttgtccttacctggctaatcttcttggacaatctgtgattactgtcaagaacttctgttccattccatgcttacagtgaaatcagataagatgatgacttccatgagacaggtaaaggaatttacacttggtttactcagatgcatagtctcttagttaagacagtagatctggcatttgggatttaatagtgaggacaaagagagtgcacacacatatcactatgtggtttctattaacaatttaaaacctaaaactaaaacatgcctcttattaatgttgtacagtcaaaagaatagctgccttcaagttaacatggacatgactaataacttcagctgcttactttacttgctttcagatgtggaagagatacttactcgcaaattcctaattaataggggaaaaaaatctaacagttggacaatacaaaattacataacaattttctagttcatattttaatacagaagggagttttaagttggaatttttttttttttttgagacagagtctcgctctgtcgcccaggctggagtgcaatggcacaatcttggctcactgcaacctccacctcctaggttcaagtcattctcttgcctcagcctcccaagtagctgggattacaggcgcctgccaccatgcctggctaatttttgtatttttaatagagacggggtttcgctatgttggccaggctggtctcaaactcctgacctcaggtgatctacccgcctcagcatcccaaagtgctgggattacaggtgtgagccaccaagcccggcccagaatgtattttaagctgtttaaaatggaagcattttatatattctataagaccttctaaaaagaacttggaatttggagcagggataaggcactgttatttggtaacgtgaagttttttttcttcaacttttaagttccgggttgcatgtgcaggatgtacaggtttgttatataggtaaacgtgtgccatggtggtttgctgcacatatcaacccatcacctaggtattaagcccagcattcattagctattcttcctgatgctttccctgtccccacagacaggccccagtgtgcgttgttacccaccatgcgtccatgtgttctcatcattcagctcccacttataaatgacaacatgtgatgtttggttttctgggtaacatgaagatgttgttgtcatgaaaacaggtttgatgactatagtgtaatagtgtaataagggcctaacctcagagacactttcacatttggatttttctttgcttcctagatgttatctttattcctgttgcttaaagaaccagtttaatgcatatagaatttgggttctttgcccagacacccagaggtacatttgataggtacctgattcagagaaggtgaaaattttagattctctatctctctctctcccttttttttttttttttttttgacaggtaaacagaagtaactatcatttggggttgtcaagatatgggtagtagatacctaattccatgaatgccttctctgtgcaagtgctggaaagtaacctcagacttccagactcatcactgagattctttttcttaagcaaaatagtgacgctctgcaggatttctataactgaagttctctaaaagataaatttatattgcattaagagggtagagggtagtatttagagctatgctctcttaaaaagagtaaagaaatttcatgtatatgaaggaacagaaagcatggggataagttttatacaccctagagtggacttttatgataaaaagtaatttacttgttaatcaatttaattcagcaatgggaaaagatctttctcttctttctgaaatcttacacagtgaagggatgaaaatggttatactattggtaatcagagatgttcctattttgttttgatgtgtagattccgtagtacctagtgttgttggatattaagaaaaattctaatccctgttcttgtgggaattgcacaaggagcaatgtaaacacaggtagtggaggtagagatgtgctgtcgtctacttctgctctaacttgagcagccacatctcactcagggtcatcccataggatgtccaggctgtggttggagagaagtggggggatgaagacgtggggtgcaataatgggaggaggatgggctttgggaccagaaggttgtgaatttgagttctggtccatcttcttggcagctgggtcgattagggtggtgaattagctggctgaattacttcacacatcagagcctcactttcctggtttgtaaaatgcagattgtgcccctctcccagggctgccatgagggttagggaggccaggaattaaaacatgtaaaccatgcattacactgcatttcaacccctgcaagggtgatgcagctagctttacctgattttacttggattgtttcttttttttttttgagacggagtctcgctctgtcacccaggctggagtgcagtggtgtgatctcggttcactgcaagctccaccttccgggttcacgccattctcccgcctcagcctcccaagtagctgggactacaggtgcccgccaccatgcctggctaatttttttttttttttgtatttttagtagagacggagtttcaccgtgttagccaggatagtctcgatctcctgacctcatgatccgcctgcctcggtctcccaaggtgctgggattacaggcgtgagccaccgcgcccggcctggattgtttctttagtgaagaaaagactggggagaagggcacttcttaaagcaatgtcaacagcctctcatatagttaatacatctctatgtggcccttcccagagtgtccttctgtgaggagatccattacaaatacaaaaaattcatgtggccagataagttctatgaccagataagtctggcaaaagctgtttattatacctgcctcttaaagattcacaaggctgaaaagtcctgaaggaatgtaactttctctaacccagaatttcacaaacttatatgaaaacaaaatctttatttagtatgataacctattggcatcaattcatatattatttcagtaaatgttggagactttctgtgtgccacagacaccttcacaggctgcttcagcgaggactgggggagggagagagagatgagtaaaaagattgaaatgatgattccagatcatgagggatacgttgaatataataaatcagtgtgggtattctgggtgagaagtgagagctatttcagatcagatggtcataaaaggcctcttgaagaggtgatatttgagctggaatctgaataattcaagttaactggccttgcaaaaatcttggagggtagaaccttctaggcagagataaaagcaaaggaattagtgttcttgagagcacactttgaggaaagctgttgcaataagagcaaagagcatgtataagaagtatttcaatcaaatttttatatacaaaatatgtagtaaatctttttcgagcattatgtgctagatactatgtgccacagacacagagatgacagttacatttaaagagtagagtagttcggagaagaaagactcaacatctaggggattgagtgataagttgcatggtggaggtagcatgttgtagtggctgaggttagagccagactgcccaagttcaggtcctagatccgccacttacttgataaccttgggcaagctactgacatctgcatgcgaacactggggacattcctagtgcctctcagtggattgttagtatatgcaaagttgttaggacagtgcctggaacataaggaccacatgctaaaattgaagatgatgatgttagagatattcccgtcataaccatcatcgttacagttgtcatcactgtaatcttttagtgccatggtccagctcagatgcctgagtcttcatgccctcctaatgggccccaggtttgcccatcagagtcttacacatgatcacccacaccatgtaggcactattcttacccagcaaagagattaaaacttgcttcatctgttttctacccaatttaactttgttaaccaccctcttaaaaagaagtttcttgaggatttatctctggttgtcttccagtttgggcggcgggtggtgggtggtgatagttggtaatagggttgaggtaggatggaataaatcagaatctgcaatgaaccacttgctggataattagggtagatgagaaccacaggactgtaataaaaatggattatcataacgatgaccctacggtgctaaatgatgcaccatgttccttttgaatcaacaaaagttaaagtcttcctggaatagttttagtacattattgatctctaattcttagaaaattggcaatccatgtatagaataagaaagtctctattgctgcaaatattcataacctgaagaacccattccctaaccattttagataaataagatttttataaaattaaagcaattattaaaattctatttgtgcatggaagaagccatttagctaaccaattatatatctaacttctgtaacagcacttcggaattaatctaattgcatcctattgaaagtcagtcaccttttgcaacatgacaattttatgccaagagaatgaaaatgtcaggtatttccattacagagagtcacattttcccttgattgtttcaggcagaaagaaagcgactcagattaatctgtttagaactattttcagttatctgtatatgtcatacatgctgtcatgttctaagaccactttgttcttggatactgctttccaaaatctatgggattctactcttaaaaaaaaaaaagaatatctcgctttacatatcattttattctggggaagcctaattagcacattaatatcagagagctgacaacctcctacatgttattttaggattccatgtgcaagaccatattattctagttatttgaatggcacgtattctccacagcttgctaacagtagttttgtcttttaaaatttatgtgtttccagtgtttagggtctgctaaggagtgggaggtgaatgtgtcatcataaagaatgttgcagcaaatatattttgcaggatacagccatttccattttttgtagtacaaagatcctatcatcctgaaatcttacattgtagattgtgttatgtgctgctttttatttcagtgagatgaaagtaatattctgaatgagaaaagaattagagtagcatttctcaaatgccagttttgaacctaagtttaaaatagagagatttatcactgaaaagattaagagaaaagaaagaacatttatggaatagggattacactaggtattttcatagaggtatttaattcttgcagtcaaccttcaagatctgtgagatttatccatcacaaataaatgtgttcagattaagtatgtggcctagcaattttgtaaattactgttttttactttgcatttaacatttatgtaattccaagccaatattttgaacctacttttaacagttacataagaccttttagaatgaattttgtatttatcttttttctcctgattttctggccttcatttttctgccaaatattttaaaaaatagtgttttactgtatgtttttagataagccacctcatgccattcttgatataagttgtggttattaaattaatttaataaattaactaattataaacttggccaaagtcacacaggtaagaaatggtaggtccaaatatataaacctaaatatgataaatttccaagtacttgctgttctctttgcaccttgctgccttatggaatcaaggtaaaaataaagaaaaaaatgtaagtgctttgaaagggttcacagctatttgtataactagaatataatctattttgagcaaagagaattgggttatatatcttatttctagattgggccaaaccagtaagtcattttcggtttacaggattcaaatcaacattgtattaacattaatgaaaatgccaactcccattcagagcagatgagcaacaggtgatatcagagaggacctcttagaaaaagcaccttttttttctagtaactgctgattgtgtcctacaaccttctgtgttaattagcttgaagtgcctcaataatgcatcggccaggttgcccagaaccctgcaaacatcttttcatcatccctcatgttgtgggctttccttaataggaaggcagataacttcagatctttatgtctcttagattttatagttttgaaaaagtgacaagtctttttgtcaatagatgcctgggtcttcttatacttctgaagagaggaaaatcaatccaaaagaaaacacaatagattctaattttatggactgttcattaggaagtctggttttgcttaagacaactgtgctggtctagaagttcatagtatttattgatttttcttctttctgatgatcattattgctattttgtagcaatattgatattgtataatataaattctttttattttgctaaagggaagtgcttctgtattcttgaaaactgagaatcaaacagtatttaaagtactttttctggtttatccccagtgtctgtcatagggcatagctctaaagaagttcactcagatatcaagggtgaatgaaaattctctgaaagagaagtacaaattattgtgggtccaactctttaccatacattatagaaggcagagaaaccatgaccacctaaacttgtaggacactgtggggagaagagcctatgaagttgattcctaatgtaggtctgcagtggccatggagctgagaaatcaccgaaatggggaggaggaggagggatctgtctgcctaacttcagtaatattattgccttttcttagataaccctcttcactcttttctgtctcctcaatccttatctagctgtcaaagtctcgttcaaatcctgcctcctccaggaaatcttatctgctcactacaactcaaactgatttgttgacctggccatttacagcatttgtttgaccataccacctggcccttaaggctgcctggcgttttctaataaaagctatcatttttctgaatacagactatttgcttgcttttatttcttagcagctccatgagatacatactatcattgtcccaaatttatattgtctgtctctcccttcacatctattaatatttgctttatgtatttaggtgtgctaatgttaagtgcatatatatttataattattctcttgatgaactgtatcctatactactatataatgaccttctttatctcattttacagtacttaaagtatattttatctgatacaaatatagctaccctgaaagtatagctctcttttgatttcaattttcatggatttttttttttttcatttctttactttccgtctatgtgtccttacaggtgaagcgaatctgttatggacagcaatagttaggtcttgttttttttttgagacggagtctcgctctgtcacccaagctggagtgcagtggcgcaatctaggctctgcaagctccgcctcctgggttgacaccattctcccacctcagcctcctaagtagctgggactacaggcgcccgccaccacgcccagctaattttttgtgtttttagtagagacggagtttcaccgttagccagaatggtctcgatctcctgactttgtgatcctcccgcctcggcctcccaaagtgccgggattacaggcgtgagccaccgtgcccagccaggtcttgtttttttatccattcaaccactgtgtattttttgagtggagaatttaatccatttacattcaaagtaattattgacaggtaaggacttattattgccattatgttcactacttcctggttgctttataaatccttcattctgctcttctctcttgctatcttttttatgattaggtgattttctctgctgctatgccttgattccttatgatttaaattttgagtatcctccttaggttttctttgtggttaccgttaggtttatatacaacatcatctagttataacaggctattttaagttgataacaactcagattgcattaaaaaactacacttttgctctacttcctcccacattttacgcttttgatgccacaatttatatttttatattgtgtatcaacaaattacattgtagctattatttaaataatttatattttaaccttcatactaaagtataagtgatgtatacaccactatcacagtattattctgaatttgactgtgtacttttaccagtaagttttatgctttcatatgttttcatattactaattagcatccttttctttcagcttgaagaactccctttactatttcttataagacaagactagtggtgattaactccctcagcttttgtttgtctgggcaagtcttttatctctccttaattctgaagcacagcttagccaggtacagtattcttggttggtgatttttttctctttcagcactctgaatgtatcatctcactctctcctggcctgtaaggtttctgctgagaagtctactgccagtctttctggaactcccttatatgttatttgcttcttttctcctgctttcatgatcctctttttgtctttgatttttgacagtttgattatagtatgtcttggtgtagtcttgtttggattgaatctgagtgtagattgttggccttcctgtacctggatatttatatctttccctagatttggaaagttttctgcttttacttctttaaataagcttactgagcctttgactctcttcttcaattcagttcaaatatttgctgttttgatgctgtcccataaatcccagaaacttcctttgttccttttcttttttctcctctgtatattttcaaataacctgcctttaatgttacagatttttacttctgcttgagcagttctgctgctgatgctctctattgcatttttcatttaactcattgtatatttcagcttcagaatatttgtttgaattttaaaagatactttcattttttctgttgtttctcattttgatcatttattgttttcttgactttattgaattatttctctgcatttaagtttccttaaaacaattattttgaattctgtgtcagacagttcatatatctccattttggcagggggcagctcctaggagatcttttgtgttcttttggtggtattatgtctctttgtttttcatgttttttgttgctttatgttaataatctgtgcatttgaagaagtaaggacttattccagactttgcatactgggattttctggggaagcctttcaccagtcagctcatccagagatccagagattctgagcaggtcatctggtgtggtcctctggcagacttactactggagcccttggactttgtgcctggatcagcaggtgggtgggcctggtacctgggtctctgggtctgtcgggttggacctggagccttggatcccctgttcattggatctgtaagggtaggtctggagcccgtatcctcagaggttgatctgaagcctggggggctgacctggtcctggggtaggtcttgagtgtgaccttgagaggctgaccacgtactgggatgggcctggtacccaagtctgcagggttggtcctggggtaggtcttgagtgtgagtctacagaggctgaccacgtactgggatgggcctggtacctaagtctgcagggttggtcctggagccttggttcatgggtccagcttgtcagcagggtctgctgggctgggcctggaccctgggtctgctggagcatggggctgcagggactttattctgttcttctctcttgctgtcttttttttatgattaggtggttttctctagtggtatgctttgatttcttactgcagggaccagattggcactgggaaatcttgaagcctatgtccagagttgccagcctggtgcctcagacccagtccaatgacaggttagccagctgaatgacagacccatcccctgtcactgggctgggtctgaagtctggggctgtggtctgaagtctggggctgtgtagggcaatctggccctgggatggtctgaaacccggggtggaacctggggtcatagaggctggcctggtgctgggtggcatggagcctatacctgcagaggctggcctcatgactagggctgcagggccagcttggtagcttgggtgggcatgaagtctggggctaatggggctgttggggttggcctggtggtggggcaggtccagagacagcctgccaggctagcctagagcctggggctgcaggatcctgcctggtgctgggaaagactcggaggctcagtccacagatagttaccatcctggaacctggaacctggaacctcaggggctggcctggcactgggtgggcctggagcctgtatctgcagtcaggaagcagggtctgcaggtgcaagcctgatgacaggctgcaggggatagcctggtgctggcttttattgaggcaagcttcattttgccggcagatccaaagcaaagtctagtgcttatttctctctccttcccccatactgaggataccttgctttaagctgtgctgcctggggttgggagtggggtgatgcaagtgatgtcaaactgtccttcctaccttcttcaatgctacatccaggtgctgtaatctctcacttggtttccttagttcttgtgaaaggtgtttttctatgtggatggtagttcagattgatatttctcttgggtgggggtgatgtgtactggaaagtcctattcctccatttctttatatctgtctcaaattgtcccagatttacagatgaagaaactaaagttcagcaaacttgaatatcttgccaatgacacaaaactatttagtagagccaaggttcaaacttcagtctttgtgaattcagaggttgcttgcttccactgtgcagatgtggaatatcaaactagtctttagattctgcgagatttttctttctctcttatgttctaagaaatgggaggtagaaaagaacagtgatgggtgagggagaactgtccttgagtctgcaccctccacaggaattttgttgctggggaaggttggggaggggctgtggagagagggtccttagtgcccagctgaaagtatttttcccactggagtggttccagatttaccaaactgccatgaaacttgcaaccaaggtgtgacactacccctggctacaattgtctaccgttgccaggcctttggaaactgctgcttttgccaccagggcctttgtgcaaaagggcactttgctttctgtccctgtggccatcaccagcttcccattgatagctcctgtctataactgttggggtttaccatccaacaagcggactctatatcagctctcttcacctgtgttgtcttgtatgttgctgtgtgtctaaggtgtgataatttgccctttcttcacttgtttttcatagctgtctaatttatattgttttgagtaccaggactgtgcagtgggctccagaactttctccaaagggaatctgttgccatttaactggggctgttctagtgtgtgctacccaagaatgcccctttatatgctttttaaaaatcttaattcaaaaatacattttttgtgaaaaatacaaaaaagaataaaataattaccacccaaagacaacttgctaaatttagtatatattattccaacattttctacatttatgtatatatattacataaagaaaacatactttttaagtaaaatggcttgttttgtacctatagcttagtgtcctgactttctctcgaaaccatctttcataccattaaatattttccatatcgtttagtagtaaaattgttcagctaatcctctattaaggttgtttctcacctctctgatgttgtaaacagttctgtggtaagagttgatgtagctaattctttgtgcaccttcttaaatattgtacttttctcccctttctggtttattttttaagtaatatgtataaatgagggaagtaactaagttgctctccctactgatccacagggtcatgatttctttagggtacatttctagtattttaattgttggatcaaaaagtatgcaaaattttaagtcatttgcattttagaaaggttatgtaagtttactcttttaccaataactgaacacctttgtggacaatggatattttcatttcagattttgtcaacttcataggtgaaaaacgaatctcatttttttaacttatatttttaaattgctagtgaagttgaacgtcttttttatttacaaattggtcatttggatgtttcttattttgtaaattgcctgtttgttttttcctgttttttaccattgatgtgtttatgtgttcctattgatttgtaagagttctctaggggaggggacttggatttaagaatattaacaatttgggtgtcataaatattagttactccccccagttgttttgtttttattttatttgtgatattttaaaatattattcaaggttacaaaagatgtaatagttaaaaatgaaaagtataatcatgctgttttcttattttctacctaacagcattagaaaatatacaattctttatatttttgttttagcaatagaaaatttctatgcacttcttgatagaaaagatgtgaatttgacttaccctttcccatttgcctcttatcctattaatatttgatattttaaaaattctggttatttatccttatgacttgaagtaactcacctaattctattttgtactccattatcattcagcggcatctcttgactgtctactttataaaatgagaatattagcacctttatcccttcttaccccctcctccgcacccgcagactgagcccagagcatttccaggagtttcttcttcctccataatctacacaggacaggctttcatctccactgcagctctttcgctggttcatctcccagctggctctcatctgcttcctgtcgttccagcccgtctcttccctgttacaagttatcctccttgtacctccgtctttttatttaaatggttctctaaagatgaaaggcaaatgtgcctagcttgccatcttgagctgaacattgcagtgctttgtatatatagaaattttaaaatttttatgtggtgaaacctgcaagtgattccttttggtttccacctttgccgccatgtttagaaagtctttctccaatttaagattatgttttctttagtacttttgtgaattacttcttactttgaaatctttgttcatttctagaatttattttggtgggtagaatagtttagagattcatcttttgttcaaatggttagccaactactcagtatcatttattaaataatacaaagttttgaagtactgaattcttacatatatttgtgcccgttgctgagctttgcttctttaacctgtctctgatgcacactggtgccaaacttttaattattgccatttcagaattttaatatctggagggcaggtcttcaccaccatcccccgacatcattgttctttatcaaaatgtttttagctgatgttgtattctctcttccctgctgcaaaaggagtttactgtagtatacacgtttgaatgaggctgccttggtcagcccacgtcttagctcttcgtcagtatttctttctagctaggcagaaagagtaaaacttctgtgtaatactagttccctgttccacccaggttttgtattcacttgcttttaggtctaggactggagaatgcagtacatgccaataattctagtcttctctgatctgtgaacatataccttcactgacatttgtgtagttacttggagccaaaaggaaaattgtcacttagccagatttcactctcaacatttcacgtctccttccactacctgacacctgctagtacctcccagtcacccaatctgatctcctaatctctggcatctgacccagcctccatcactgcctccctcaggaatgtgtagatggccttcaggccatttcgtcaggctccctctttcccaccctacctgccagtctatccttcgcctgcctgccttcctttccgggtgccagcacaaagtttgtgacctcaggtgcctttgtgctcaggcagaattaggcacctagcaatttacgaaacactcatggctgggtgcagtggctgacgcctgtaattgcaacactttgggaggccgaggcaggtggatcacgaggtcaggagttccagaccagcctgagcaacatggtgaaaccccgtctctactaaaaatacaaaaattagctgggggtagaggtgcgtgcctatactcccagctactcaggaagccgaggcaggagaaatcgcttgaacccgggaggccgaggttgcagtgacctgagatcgtgccactgcactccagcctgggcaacagagcgagactccgtctcaaaaaaagaaaaaaaaaaaaagaaatacttatttaattatgcttacctagaaacattgcagcatcaacataactggctccagccagaagaatgagtacttgtttcctggcgggaaggatgccaagaaacctatgcttcggagtctctgtgggcacagagcctgtgtttgaggcagatggaatttcatccgtcggaaatttaccgtcattgactctttcctaaacatacttagagctaactgaaaaatggtcacctttgcacttttgcacaaatctctatcaaaagccagggagaacagaaaatctcttttactacttttttattttcctttttttttggaaacagggtcttgctctgtcgcccaggctgaagtgagatggcgccattttggctcactgcagctgccgcctcccgagtcctagcgatccacctgcctcggcctcccaagcagctgggactacaggctaaatttttttttttgtagacacggggtttcaccacgttgcccaagctggtctggaactctgggctcaagcgatccgcccacctcggcctcgcagcgtactaggattgcaggggtgagccaccatgcctggcctactttttccttttacgtttgctgatttttgtcccatccttctttttgattctgcaacaaaaaaattaaaatgttaaatattaaatatcttttgtagaagatactttattaaaattctatttcagtgctatcaagtggaaaaataaatgcaagtcacatttataattgtaaattttctagtagccatattaaaaatagctttaaaaacccaggtgaaattaattttaacatttaagctagtgtattcaaaagaatgtatcagcgtgtaatcaatcttaaaaaatattgagatgccttacattcttttttttttccatttgatatctgatgtgtattttatacttccagtacatctcaatttgggccagccacatctcaagtactcaatagctacatatgaaatcactttacctccaaattctgagtgattttactagtgactttatattggaaataaccacatctagaagttcttatctagggatgcatgttcagaatcacctggaagctttttctaaatatgcattcctgcctgtaccctcactagatctgttaaggtaaaaatctctgctctgtgtgagcctgggcatgtgtgtcttgagaaaggtacataggtgatattgacaagtacatttaattaaaaaccactaagatgatccagcttcttcagtctacctatgactaaacacgtcctgtgtgatcaaacagctttcccacagagagtaatgatacagacctcagtcttccattcacaaatctggtgtcctttttgcctcatcatttctaacatataggataagaatgtagactaatattatacacagatttgttcaataacaagagtcagcaacaaaagggagtttcaagttactctttagattatcaggaaatttaatgtaaaatatcctacctgcacatgtgtgcacgagcacgtgtgcacacacacacacattgtctaaatagtcttgttaattgaagtttcattgtgatgggcatgaccgtgtagattttatatgcatttccatgttcttgataccttttagactcacctcatagattatacttttctgaaactgcttttaaaaatctatatcaaaatagataccaagggctattataattattttagtatatctctggacatcataaccaaatacaaaagttcttcagcctgtcagttttcaaagtgtcagctctggatttttcaggttaaaatttcatatctttaataacaaggctgccagatatcagcaggcagtgtggttgactactctgtaatttaatgggagttcttcataggtgagtcacagtggctttcttctctttctttcacatggtgctgacaaggacagcacacgtgctatactgaaagatagtaagtctcagaaaggtcatccaaaggtaatttgtggattatttttgatgagttggagatatggagaaaaatgtttgctctttaacacttaattttgtatgaagtgaccaaacttagattatctagttttatttcatgcaagtgaatttaacaattaaatattttcatagttctttaatccgtatgcttattaaaaatcaacttaagtctacaaaagtcacaagtaattaacaagcctgttaaataaaataatgatatccataatagcctacaaataactactagaatttttaaaaagcattttaaaggtccaaaacgtttaaacaggttatttagcagtaatcaggatggttatatgacactcacttgaaagaggcttcagtttagattatctagactaactgtctttttacaaatggaaaattcagagagatccaaagagatgaagggattaactccactcacatagagattcccttccagtgctagtttgccactgtcttctgactcacttcagttggctttttttttttttatcagctatgatgactttcttttgctagaatgtaatatcatgttaaggtatagtgatttgcttataataaaatgatttaaaatattttgacacatgtctattggacatatcaatacaacagaacaaagacaatagccccatgacttcagtgcttcagagttccatgtgtgtttccttccgtgtgtctaacataggacattaaagagcatgatcatttcttcaaaaataggttccttcaagctgagtacaagatccaaattttaaaaataccttttgtggaaaatactaaaacttggaaccacaaccttgtttctctcttttaacgtaattgctcacttcatgaaaaaaaaatcccctttggacaaatggatgtaattgtatatgtaatgcactgggaagtatgagttactattgattaacttgtattaaatatctgagaaaaaggtatgtattttatttgtaattttaagttgacgagatgataaatagaaaaccccttatttggagttccctgatgtattcttagtggtcaagacccttaaaacaaaaaatgtgatttctcgttttacattctcctcctttctagtttttttttccttcttatgcagaacagagattttattgtagaattaaaactgataaacctgatccctcagctctgtgctattttgtttaccccatgaggagttgctccccataaacctgagagtttgttagaaggtaccttgttcagaagattatcaggtttaagcaattgccattcaagagagtaaagaagaactagtctggaagctggcaagaaaaaaaaagttgttatttctaagtcaatgtttgtagaacaattgcctggttaggcaatgagacagtagtgtttaatacaattgagctgtggtgtataatatgagtagtcatacactcttttgtaagagtcttggattgatatttttgttatactttgcaatcaaataaaggaggctgtttgcacatatcctgaaaacgatttgataactatatagtgattatttctcggtaatttttgaaggtctactaaccaaaaaattctaataaaattcactcttatgaaattaaagattaagtcacaaaaatacaactgtttagataaatattcaagcactgacaggcatatagcacctcagttctgtttgtttgctggccattatgtttttaccagcttttgttttaaaagtctcatctttctccttgattaaattaaatgaacatcctttcctgttactccaaaggattccttataatttttttatagcacctttgattttagactgagggcttttagatagacttaaatagattcttctactgtatgtttctgaaatattggcccctgtactttaccaacatacatttcactttataaagttaatgtaagggcttttcagtgactccaggcaaacctcaaacaatctctgatttgcaaaaagatcaagatgcctctggaaataacacacaacccagtgttgttattattatttttttgcaagacctaactagagaagtgatcattatactgtatattctttaatcttgatgtttttaaagaagtttaagtgttgtatcctttaagcaattaagttcagttcaaaagacagaataaatacaaagctctttaaaaaaaaaaaaaacccttaagagaccacattgtggtaagtatttcagcctctggattttgataaactagaaagctttattttgaggagtcattaacttgcaatttggcccagatcactctgtaaggtcatggtagcttcagaccccttatctctaactagcctgcccgctgggacagaaagtgtgttccaagagaaagagcaagatctctatgattagattgagtctacaggggactgagagccctaagaaaacttcagattttaagaaatcttcaaagagaaaagagacttaacagatccagatgagccatgggaacagtgaagtgcttggtgcatgtatatataagttctcaatagagctgtttcaaccactagtccaaattcaacttctcaagcctggtagagtcaaatttctggcacttggcagcagagagtttatagaatgccttgatggaatcaagtagtaacctgtcttccttgtcttccttttgcttccaaacttatgacttggatttttttttttttttaatgctctttccagccctagtagtgacagcattttccaaaatgttactcaaaacctctcaaatagcagaggcagtaccaacacatcctggcatctagcctacggtcgtgcttcaggaatacactgactgccttggtgatggccaaatgccagttcttatagttaagttgtggcttggacatgtggacccattcctttctgtaatcctatcatgatcccctgctttctttcttccctaccagaatctaagctcctggaaagcaaatgctatgacttttatctcttgtattcccacagccatgttggctagaaatatggtggatacacaaagaaagttagttgaaagaacaaatccaactatccaagaggttctgaatacccactggccccaccaccaacctctgctcttcttcttcttttttttttttttttgatatggagtcttgttctgtcgcccaggctggagagcagtggtgtgatctcggctcactgcaatatccgtctcctggattcaagcgattctcctgcctctaccttccaagtagcagtgattacaggcgtgtgccaccatgcctggctactttttgtatttttagtagagacgggggttcaccatgttgcccaggctggtcttgaactcctgacctcaggtgatccgctgcctcggcctttcgaagtgctgggattgcaggtgtcagccaccatacccggcctgctgttctccttttaatgcacccaagtcctggggaacccgactggggatcagagctgtgagctgggggagggcccgttgttttgaccctaagacctagcctgacttgagaagtttcaggatgtggaatttcatcaggctcaaggaatcctttcaaggagcattctgacaatagaaccatataaaatccactcttctttttgtcaattattttgaaactgttccagtaattaagattgagctagaaaatatgaactacatttttacaaatactcagaccttcaaaacaggctttaaaaggccgggtgcagtggttcacgcccgtaatcccagcactttgggaggccaaggcggcagattgcttgagcccaggagttcgagaccagcctgggcaacatggtgaaaccccttctctctctaaaaataaaaaaataaaaataaagaaatcagccgggcatggcagcatgggcctgtagtcccagctacttgggaggctgaggtgggaggatggcttgagcctgaaaagcagatgttgcagtgagctgcgatcacacactccagcctgggtgacagagcaagactctgtctaaaaaaaagcccacaagctggctttaaagtgaactaataatgatgtctatgttatgattctatatgatatttgaatatgttcacccttttctcttttaatattgtttcaactactgatttactttagcaaacactttcttcattaaaagtgcaaaggtaaacttaaaccatccaaataatcagccaaatcagtcgaatctacatgaaatatacaacaatctaaatgcttaaaatagataagtacaatagtggagggcgtaatgtgttactgggcttttgacatcaaggacgtctgtgttcgaatcctgactttgtcagttgttagtaccagttgtattgacttagataaatcatttcacctttccaagtctcagtgttttcttttataaaaactatggttgtcaggaggattttgtgagataattatatatgaaagaacctactaggatgtattctttagtaaacattcagtatttggctctctatttggcaactgagtggtggttgtgttccccaggtgtgagggttcctgggctgggctggggctactgtcttgtagtttcagtaatttggtttcttgtgtactattcatatatatatatatatatatatttttttttttttttttttggagacggagtctcactcttgtcccccaggctggagtgcaatggcgcaatctcggctcactgcaacctctgcctcccagcttcaagtgattctcctgtctcagcctcccgagtagctgggactacaggtacctgccaccacgcctggctaatttttgtatttttagtagagacgaggtttcaccatgttggccaggctgatcttgaactcctgacctcgggtgatccgcctgcctcggcctcccaaagtgctgggattacaggtgtgagccaccatgcctggcccttattatatatttttatatactttagaaaatttgatctgcggaaaatctggttcttgttttttggccacattatcagatcagtcactcatctactgtaagtacattaaaaagaatacatggtcactttgcccagttaaccagagaatggtgccattaagttaaaaaatgcatatacatgtataggcatgatcctcatatagattagttttgttagctgcacagtcacagatcaaatcctgagttattacccttcttacagaagggtgtgtcgcttgttcatggtggggacaaggttgtcagtgaggatagcttgatagtaataaactattactaccattggaagaacatttcaaaatacaatattatgcatcctacttaggttattttcacttcatatggtaatagtccattaatttaccctaataatatttagtagattttgacatctactagaacataaggttgaagtgaaaagcatgttttagtttgtgcattttaaaacaattttctacgaaagaaaaccaaaattaccttccatagctttcttatttaaattggacttaatatttctattgtttttaagattcaactcttggaatcttctacatttctttgcctaagtaataggggatggtttatgttttttgccattcataatttttcttaaaccttcatacccacatttagccatatgcgctttaagacacacagtgaagatgaaatttaatacacatcaaacttctgtgcagacttggtgagaaacagatattttgcagcctgctttcactctgtgagtcattaaggagtgggttgataaacttgcattgcaaccttgcttatagaagattgtgcctattgtaagatactccctataaagccaaaagataaaaaaatgctaagggtactgacaattgtttataaaatacagtcataaagacatcccgctccagagagttctctgattaaacttcacaataactgtaatttctctgcctgaatcactttgttaaattttgtcttggcttctggagacagggtagggagacagattaaatttcaataccttatgctattcattgggcttgggagagtttcttcagcataaatgataataaagatagattagtgattctggtttatcctctaatcttagcatagacattttctgtagattagaagtcatttcatttatgaaccaaataaggcttctgatataaaaagaaaaatgaatcttactcagttccctaaggcttagaaaagattgctggaatttaggagttgggtaaatggttttactttagctactaatccaattgaaaaaacgtgagacgattttctgaaaagctaaaaagctcttatagtaaatttgagaggatttttaaattatggagaacaagatagtattgcccttacctaaaattctccctcaatattttgtttcctttgctttggaaacagcatccaagcagggccactgagaagggtgtgtgggggtgggtgttttattgacagttgtttgaaggaaattatgcacaggtacctaaaaagagcaactcaggcaagtttcccagccacttagatttcctgtttctttaagttaagcattgctattcacattgtgttgactgtagaaggattgatagtgtccagtacaaataataatagtaaaatagaatttctgcttagagtttgtggtaaatatcaaaatatcttagtgataagcacatgtattcttttaaattttgtcagttgcccagtgcttccattcattcatcacttgtttattttattcaaccagcatttattgaccccctgctggttctgggtttcctctcatactgtgctagatgcctggtatgcaaagataaatgagtcatggtctctcccctcaagcagtcaccaactactaaattcttggtcattttagttgttttcttttttcttaaaaaaattttttttttcaacaggtttttgggtacaagtggtgtttgtttacatgaataagttctttagtggtgatttccaagattttggtgcacctatcatctgagcaatgtcactgtagccaatgtgtagtcttttatccctctcctccctcccagtctttcccgagtccccaaagtccattatatcattcttatgcttttgtgtcctcttagcttagctctcacttatgagtgagagcatatgatgtttggctttccattcctgagttacttcacttacttaccctccagttgcatccaggttgctgcaaatgccattatttcattcctttttatgtctgagtagtgttccatggtgtgtgtgtgtgtgtgtatacatacacatacataccacggtttctttatccactcgttgattgatgggcatttgggctggttccatgtttttgcaattgcgaattgtgctgctataaatatgtgtgcaggtatctttttctataatgacttcttttcctctgggtacatacccaggtgtgggattgctggatcaaatggtagttctacttttagttctttaaggaatctccacactgttttccacagtggttgtactagtttacattcccaccaacagagtaaaagtgttcccttttcaccacatccatgccaatatctattattgtttgatttttttgattacggtaattcttgcaggaataaggtggtatcacattgtggttttgatttgcatttccctcataattagtgatatcgagcattttttcattttttttggccatttgtgtatcttcttttgagaattgtctgttcgtttccttagcctactttttaatgggattgtttgtttttttcttgctgatttgtgtgagttccttgtagattctggatattagtcctttgttggatgtatagattgtgaagattttctcccactctgtgggttgtctgtttactctgctaattatttcttttgctgtgcagaagctttttagttcaattaagtcctgtgtatttatctttgtttttgttgcatttgcttttgggtccttagtcatgaagtctttgcctaacaaagctattgtctagaaagttttcccagggttatcttctagaatttttgtggttttggatcttagatttaagtctttgatctatcttgagttgatttttgtataaggtgagagatgaggaaccagcttcattcttttacatgtgatttgccatttagcaccatttgttgaatacagtgtcctttccccactttatgtttttgtttgctttgttgaagatcagttgactgtaagtatttggctttatttctgggttttctattctgttctgttgttctatatgcctatttttataccagtatcattgctgttttggtgactgtgatctcatggtatagtttgaagttgggaaatgtaatacctccagatttgttcttttgcttagtcttgcattggctatgcgagctcttttttggttttatttctttttttaaaaaaattattattatactttaagttttagggtacatgtgcacaatgtgcaggttagttacatacgtatacatgtgacatgctggtgcgctgcacccattaactcgtcatctagcattaggtatatcttccagtgctatccctcccccctccccccaccccacaacagtccccagagtgtgatgttccccttcctgtgtccacgtgttctcattgttcagttcccacctatgagtgagaatatgcggtgtttggtttcttgttcttgcgatggtttactgagaatgataatttccaacttcatccatgtccctacaaaggacgtgaactcatcattttttatggctgcatagtactccatggtgtatatgtgctacattttcttaatccagtctatcattgttggacatttgggttggttccaagtctttgctattgtggatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtgatggtgagcattttttcatttgtttcttggctgcataaatgtcttctattatttcaggagatctactagatgctggagttacagcagaagaaagacaggaagagtttcttcccttatggagttattctctagcctaggaataaaagtcaacatgaataaaatggagaagcaatcaatgctgagctgaatttttcaaatagagtagagctattaatcatattaggtcagagatgtaattctttggtgagagactaataaatgaaataaaattataggtctttttgagactaattgaaattatggaacaaccgatagaataaaactacattctaaaattgtagtttccagattcagacttagaacattccttaattaacttagcatttgatttatagagaactttaatatttcaatagtattatctatcaaatagttaatgaactattttaactttctttgagaaagttaaaaggcagatatctccagttttaacattcggctctgactcaaattttggttaagttttgctgtcacatctagactttattacataaacaaagatttaaattaattacagttacttcaatgggatatataattcagatttattcaactttccccattctttaattactactggtcagagattgttcttgtgagagatacactattttagcatgactcagaaaccttagtaacaaagtgaacattttaaaagcatacaaaatacaagcccgaattcgattcagaaggcataaaattaagctattggatgctgtagtttctcagtgctggtgtgactctctgcccctgcctcatgatagaactaggaaccataacagttcactgagtcatgctaggccatggtatcagcgcgtgcttggcagaccctcagtaaacctttgtgtgagtgggggcatttgttgcacagtgatgatctcaacattactttaataatctataccacatatttatgcttggtattggtttgttttaaaatgcaatttttaatttaattttattattattattttttgagatggagtctcgctctgacccccaggctggagtgcaatgacgtgatgtcggctcactgcaacctctacctcttgggttctaggattctcctgcctcagtctcctgagtagctaggattacaggtgtccaccaccatgtccgactaattgttgtatttttagtagaggcagggttttgccatgttggccaggctggtcttgaactccaaaatcagctattctttaaaaattatgcatttgaaacaatgaagatttagccattctaaacacttctttagaaactttatgcctgcccttccttaatcgattacatttagatggaacttttgtataaagtgttctcctacacatgatctcatttgatcttcttgacagttctgtgactgatattggacacttattattatccccattttatcaatgagttaattgctatttacctgcgattatatagctaattaatggaaggcattggctgtacaatgggatttgtgactcccactttacagctgagctcaattctttctaccattgacctgcaacgatgttttaaataaaatgactactaaggttagatgttttaaataaaatgactattaaggttagatgttttaaataaaatgactactaaggttagactgctaaggttagaggttagactgctagtttctgccaatggatcatttttgccaataataggataattttttttcacaataagaatcctaaaaaaaaatttcatcctagcctcagcacttctctacattaattctaggaaacacttgtacttagatggagcttcctaaggaccagcaatctttttaacaaaagatgagcccttcaaaagctgcctgataagtgagtgcaagaattataaccattgatacacactgtagtcatcaaaaagtcagatcacacagtctattctgcataggactccattcattgccttttaaatgcaataaacttcccctccctttttcacaccatatcctgcctttttctaacctatattaatgattcaatacatatggtgaataaattaagtgatagagtttttttaattagcaagatttttatatagcaagatataacctgagttatacctgtatttcactttgatctaagagaagcaaatcatactagctcttatataaaaactctgtaatggtagcataactattcagtaatgttactaaatgaaaaagaactgcacaatgcattttgttatgcatattttctttaggaattccttcactcttggaataaacttaactcttttccataaatgagacccccaccccccgcagtccaaaatttgtcaagctgaatgatcactaaaatcacctaaagaacatttttaatgttatttttctcaagctttttataactaaaattttcttcccatatacaaaaagctgaaagactagtacaatgaacattcatacaagtacctcctaaattcaatagctgttaatattttaacaaatttggtttctctctctgcctttctctccctctgtgtgtatatacatagacctatctgtataagtcttggcttgatttgagtttaggtaaaacattattgataaaaatacttcttcattgatgtgtgtacttcatattgcattacatcaggtggcaaatgacgtcaggttgtttcatcgctggtaattgtatttaatcatttgttcatggtggtaagtagcagatctctttttttttgtaaataacaaacgtgtctggatggtagtttggtactatgtgaatatcctgttgctaacatttcacctaaaggaaaccatccttttgtccctaccagaatctattgttccatcagactctgttgttacatctacattgattagctggccttcttctgtaaaggtgagcatttctttatcaactgtgggtcgactacagtttcttctaaaaagttagggtaatttgtaatccttcccctttaccacgtttcgagtagatctcaccatatcgaatttttcccattattttttcagggctacttttctttctgacacaactaaatttgctcaccttccaatttcctgcctcagaccccaaatcaaccatttcttcaaggaacctcagttctttttagtgaaggatggtatgtataaatcaagctctaagtgttaggcatacctattgtacttgtatctttgcttcttgaccttttcagtggacagtgcaaggaaatatgtgtatttctcttaatcatgagttcatgttagtatttgtaatttaaatttaacattaattttaaaaattatatttgtatatcacacttaaaacttgcaatatatttatttgattcatatatacatatatagttttgaattacaataaaattctgaacgaagtttaagatttctttgcaattctttctgtccctggggagtttttaaaaatgcaaatattggccgggcgcggtggctcacgcctgtaatcccagcactttgggaggccgaggcgggcggatcacgaggtcaggagatccagaccatcctggctaacacggtgaaaccccgtctctactaaaaattaaaaaaaaaattagccaggcgtggtggcgcgcgcctgtagtcccagctactcgggaggctgaggcaggagaatggtgtgaacccgggaggcggagcttgcagtgagccgaaattgtgccactgcactctagcctggacgacagagcgagactctgtctcaaaaaataataataataataataataataataataattataattatatctgtgcccacttccccaagatcttctgaattagaatcctggagatagaattttgtcagattgtaggtttgtatttttaaaataaccaatccatgatctcctgccctagtcagcctcaggactgctggaatatgtgaaatctgttttactttgggtcatatctctcaatcctccctcccctcttttttccttcttagacatttttataattttgttataatgtaattacagaattactgggcacagggagaaatgtttaaggaaatgggaaaagggttgactgggaagtaaaaagaaaaatcaagaatttgcaggaagatggtatagggagcttagaagctactggcatgaacagtaacttttcataggctatcattatcctcaatatcttccttacagttcttcagaagattttaaacagtaatcctgttttttaaaacaggatttaaaacattatttaataatggcctagcatttattgcatatttagcattgccaggcactcaaagtattttatgtagtgcctcatttaatccttgcaggaaccttattgtgctcatatattaatattccaattttgtaaatgaggaaactgacttaaatatatgtactctgcttaatgagctactttctaaggaaaacacaagttttatctttgccacaggttgggttacccaggaagcgcactctgagattgagatttggatgccttatgttgttagagatacctgacagatctaacagaattgatctctggggatcaatacctttggaagggaggagatgcaaccacaaccactcagtgaagctgagctatgaagtggttctctaccaagtcctgaaccaaccccacagagagctctggagctagggtagttgttcaaagtccttccaatttggagcaagaggactggcctttttacctctgcattgacccatcgctgtgtgcagactgcccctggaaggaggcttgatcttggatggggaccctcttctgctggcactctctgcagccaggggaataagttttttaatcctgaaagggcttctggggtagaactgatcgctgatcacagtgtccaccacatctccagtaaatttgctataatttcttcaaaacaaattttcttgataaagactttttccctattggctattcttttcttatttttcccattgaagaatatatatatttagaggcatttgctcttatgtcattcaccataaactcaaagtcttttttaacccagttgtaccagcttttaactccgtgccttatattacatcggataaaccaaaatatttttatgcagtaacttgctgttttttttaaacatcaggcgtttagcatctccagtcctcaacattttactctgcttgtctttacagccattcttgagaaggttctcaaagaggtcaatgcaagagaaagtcttcatattaatccatgcttaggatctcctcaatttcaaccccttctttgttaaagcgtcctctttgacactcagcatacatccttcatcccgtgattttctggtggagaaaattactcactctcagcttgctggctgactgtcccaactgtctgtcttctgtgtgaacttggaggcagaagggctgtgtgtgctatcactccctggtgtagagaaacacgtccacctcctcctgcctctggtgtacctggtcccttgtatatgggattatgtgctctcagcataagaaatgcctgatttttccatttaaatgaggtgaggctatgttacaaatgcactatttgttctcttcttcctttgggagtatttctggtcttcatttttattggaagacctcgaaatactttaaatatgtttgttctatagtttttaaaaaataaatcatttctgagtatgttgaaactcagtacccagcaacataattttctttggttaataatttttctaaactggaaatgaaatgccttaaaattatgcatttgtcaaatatgctttaatatgtggttaaaagccaatctaataaggaaaaataacctaaaaattagtccaaccattccttttaattccttgcttccaatttaccatgtatatctaccactttggagagaaaaactgttaatttaaccttaatttttaatttaatttaaaaattttaaaatgtaactccatttaaagaagtatcttgaggaagattgaacctgggagcaggtaagtaggagagatcactaaagagcaaagtgtaaggtagagcatttgtttccttcttttttgtttgtttgtttttgtttttgttttgagacagtgtctcgctctgtcgcccaggctggagtgcagtgactcgatcttggctcactgcaagctccgcctcccaggttcacgccattctcctgcctcagcctccccagtagctgggactacaggcacccacgaccacacctggctaattttttttatttttagtagagacggggtttcaccgtgttagccaagatggtctcgatctcctgacctcatgatccacccacttcggcctcccaaagtgttgggattacaggcctgagccaacactcctggcctccttcttttttataaggatgtgtgcctcttcacatagagtgctgtgtaggacttgaacttctatctcatgaatgtctcatgttggcggaggtcatgcagcatgattctcattgcttttaagtgatggataattgagtgattaataattgatttcactgcattctgtgttttttgcaccttttaaaaaaaatcgcttaagctagggtttttgtttctgttttttaaatgctaccccaagtttggttgtgttctcaagtgaaaaacattgctagctatgccgtgtgtgaactttcagcctagtcattttgtggccataaatattgtttctatgagcctcttttcagctgtgctagtcatgtgttttctgtttgttccttaaattatgtaaaatgacccctttggcagccaacaaattttatagcttactatgataaagagcttccttatggaaaaaatattcaagttatataaaatgttttctagcaggtcaatttttttctgaataaatagttttaaaaacaaatttaacaggaagcttaacaattttttgaaaatttgtacaagcagtgctcaatgtagggaataaggaaaaccaagagatgagaaaaattaacacccaaaagctcatcaccagagaaaactgcttttactctctcttcttctagtcatttctatgccccattattatttttgcatatttgaggtgatgtggtgtaaacagtatgtatattcaatgtgtatattctacttcttcaaactaatattatatataaagattttctacaaaaattattttttgaacgttttataattatatactattcagttgtgttaagttcagttagcataatttttctaactgttctcattaagggcattttgtttgtttctagtagattggctagtatacaggctgcagtgagcatttctgcataatgtctcttctgtaattagaattgtgtccctagaatatattcacaggtctgaaattttgcagtcaggaggaatgaatgcttttaaagattttgatactcacagccagatggctttacaaaaaaaactctaccaacattaaattgtttttactttttttccccgcctaggagggtctaagatctttgtgaccctaaaaaggttaagagccactggtatgtttatgaaaaacagattttatgcttcttgaggtcatcactgccttttaacttccaggaaccctaccagtaagcataccctgaagtagatgtgcaagaaatttgttgaaaataatgatcttagtgagatctgcatgtgaccaaaattgaggatgcctttcaggaatactaacatgccttaggcagtggaaagggtggccaactcctctttggtgtcaatttgaaaaccttattttatttacttcatattgtcagtggcagacaacagatttttgaagaccattttgtgtttttgcaaaatcacaatagcaagcacggtagctcagtttaatggtcctatgtgccaaagtgactagctgaaaataaagtatttcatttttatctgtagcagtcaagtcacatgagatgagtatatcatttcctgcatattacaatttattacatcttaatattcacctaccctagtgggcgtcatagtaagtttttacttctattacagtagcctttcctgagctgctttattatgaattctagttagtagtattttattggtttgaaaataaaggaaatttttattgaaataaatgtattgaaattaacagtgattctaaggaatatatttgttttagcatttaaatagtctacaaagataactatcaatttatttagctagaagttccctagaaattctagttaaggatatgaaaagcatggatgcctccctcgacctagagagagtataatagttaagaacatggaatctgtagccagagaccttggatttgaatcctacctttactgcctccttggagcacggcttttatcaagttacttaaactctgtgcctctgatttcttaactgtaaaatggggtaatagtggtatctagctcaaagagttgttgcaggaattaaaagagatacgtatgatgcaggcagaatcatgcttgtttcattgtatgggttcttctaccttctcctcatcgtattatcgtagtctttgtagtcgtcttcatgatggaagtcagtattcaatgaaatactttctctgataaattgatttactactttttttttcatttttatctccatttttcttggtaagcctttggaggttctgttccaactttgacaatgctttgactgacacattggcaggctgtcttaagtgtgtgctatagtaacaacatgcttcctttttcatttatttgtagataccaggataaatgtgctgcttaccttcattataccaggtaaaagaagggaaccttttcaatagaaaacaaaaaacctgtatgacttagggtcatcagaagagtatggcaaaataaaactgagatattcagtgagacttgccagtgtagtcttccaataaattattgcatattatttgccagagcttcaccttttgttgcaaacagatagcaaatttcagttgcaccacttcagcagcttatgttcatcaactgaggttggttggaatgtgtcagaccagctaaatttaagcatatgttatatattctttcagttaatgggtagagttgcttcctgttgcttaactactgctatgtttccttctctcaaagtgccaaaaagtttttgaaataaaatgattattttaatggtttggtattgtgaacatggttatggtaaaattagaatattgcttctttcatctaaaaggtggtaggtagcaagatgaagaaatggaaatagaaagtaagggaaagttaaagttaactatcatatttttaatgttttaatatgagtataatctgtttactatataaatcagaaattaaattaggaaaacattccatattattctgtatgaaagtagtgttttgatatgtcactcctaatcctcacttgggtttcatagtgaacattttcatgtgtcctagaaaacagactgttggttgtatttctggataagtactctgtgaggggttttctccctttctctcactgatacctcttacattatgggaggggagaaaaatggaactctggtcttatatataatatagttagcatgtcctgggaaatatagtaaattattctgtgatagtgtaattatcttctgctgtctttatggaaccaggcatttgataaatttttggttagagtagaatatcagcaaagctataggaataggctcaattgtgaataatttagttttcctccatagccacagcactacttttgctcacaaaaaggcaagagtattcatgagcgatagtttgaacatctaaaaattcacagtagtacctcagttggaacagtctgcttaacataggttgaaaagcactttagtccttacttatgggacagactgatttaattctttgtatcaaatttttaaaaatgtttttccctttatttcacaagctgtcaggggaaatcatgacctaacacattgaaggaacaaaacacctttgacaggcagatctcattgtgcagtgtaagaattggcttctttggtgtaactggttgccaaagatagccttataacatgattttaaaaagcagaataaagagacattaaagtatatattaatcgcatgttttaaaggcccctcgagttaattgtttttgtaaatttctgggtttctacaaagtagaagtcattatcaagcagtcttcttgaagttgtttagcattgtggccaccagcacaggatcaggagtcacaggccagggttcaaacctacatcagtggcttactgattgtgtgacttaatgatgtatgatctcctctctaatctttggcttcctgaactataaaatgtgagagtaaaattacaggtcctgtctcactggatagttgcgaggattggagtatgtaacatacttaacggtgtctagtagttttattttttaaaatcaaaaattgcactgctgttgccccaaaaatccatctaaaaaacataaggcaggccctcctttaaatatatggaggccaggaaacatgtttcctgttgaataactgttattatttttgtatatgggagtagaaataaggaaactagaaatggcacagaatttaggagaaaggaagacacataacagaagctcttcctgtgcaaaaggagcaaaatactaagactctcctcaattagagctttttagtctggttggggaagaaaaactaacatataggacagttagagaattataaaaatattgagtagaaattcataagaggaaaaatatcactggaactagagcagatggtgggggctgagtctttataaatggaattggaactgaacttagaaggaagagaggaggaaagcagggcagtgctgtaggctaaggctggtaagtgagcaaaccctagaggcaggactgaaaataattttttaaaatcatctcctgaagggacgtgactgactaatgagtacagggacaccttgagtgagtacatagtgggtaacactgaagccaggcaaagagtttgagcctggttagggagactttcagtctcttaaaaaaaaaaaatccctgacatatactagaaagcagtggtttttataaatttttgattgatacatatgaattgtacatatttatggagggcatggtatattttgatacatgcatacagtgtgtaatgatcaaatcagggtaattaggatatctgttaccttgaactttttttttttttagagacagcgtcttgctctgttgcccgggctggagggcagtggcacgaccatagttcactgcagcctcgaactcctggcctcaagcaatcctcccacctcagccttccaagtaactgggactacagacacacaccaccatgccctgctgatttaaaaaaaatttttgtaaagatgggggtctctctatgctgccgaggcatgtctcaaactcctaccctcaagagatcctcctgcctcagcctcccagagtgctgggattacaggtgtgagcttgtaacattccttttctttgtgtcgggaatgcctcagatcttttcttctagctattttgaaatgtacaataaattgttgttccctatggtcaccctactgtggtactgaacactagaacttattccttctatctaagtgtatgtttgtacccattaaccaatctctctttacccctttccccttcccagccactgttagccatcattctactctacctcggtgagatccacttttttagctctcgcgtatgagtgagaacacgtggtatttgtctttccgtgcctggcttatttcacatagcatgatgaccttcacttccatccatgttgctgcaaatgacaggatttctttctgtggctgaatagtactccattgtgtgtatacataccacattttctttatccattcatccactgatggacacttaggttgattctgtatcttggctattgtgaatagtgcttcagtcaacatgacagtgcaggtatcctttgatatattaatttcctttcctttggataaatacccagtagtgggatgggtgggttgtatggtagttctatttttaggtttctgagaaacctccatactgttttccataatggctgttgtaacttacattctcaccaacagtgtataagagttcccttactctgcatgtttgccagcattgttattttttgtctttttgataagaacctttctgactcagatgagatgatacttcattgcggttttgatttggatttccctgatgattagtgatgttgagtattttttcatatatctgcagtatttaacagagctaagtctaaatgcaatatatagaatagattaaatgggagacactgttggattaattcagactgcagtggttgaggatttggatcccaaagaagagaacaatgccagtatctgcaccaattccatctttcctattacatcagaggggttgtccgcctcccagccaggccagtccccatgactgctttggctcccatcccttcttcattctcaagaactttgtgcacttgattaccccttctctcacatgctttttaatgtctcacccttgcctttgcttttaaaaatcttcaagcttttcctattaaaaacaaactaaattttctcattccacttcatatttcttccagctgcctcttcatctctattcatcccttaacaggcaaatcaaatttttcaaaaaatgttgtctattcttgtttgtatcgtttccacatctcccaactccacacttccactcactccagttgggctcttgacaccattaccctgccaaaacagctgtcactgaagttatcagtcagcttcaacttcacgttaccaaatgcaatcctcatcttgcttggcttctcgacatagttcaccgtgccctgtgtcttgaacacactgttttggtttttggttttctttccacatattgggctagtcatctgtctcttctatagtctcaccctcttccatccatcatgtaaggggtgaattcctcaaggcgggatccaagatcctctccttttctcactttataatctctccatcactcgtcttattggctcttgagtcaattattatctgcataaagatttgtgccaaattatattctccagtccagacctcttcactgagctataaattctgtttctgtctcctcttgaatgtttcagaagcacttgaaattcagcatatctaaaagggaactcatcatcttcaattctggtctatttcagtgtttcctctctcagtgaatagtatccagttgtataagttacaaatcttaaagtcattcttcatacctccctctccttcatcacacatatccaatccatcatgattggatagcaaaagaaaacagttgctcattttacttcgtaattactataatttgaatgtctgtcccctcaaacctcatgttgtaatttgagtcccaattttggaggtgaggcctaatgggaagtgattgggtcatggaggcagatccctcatgtattgtttcagtgccatcttcactgtaataagtgagttctcattctgttagttaccaaaagcactggttataaaacaaaacaaaagaaaacaaaaaaaaactggcacctccttctctctgtatcttgctccctgtctcgccatgtgatctctgcacacacctgcttcccttccctactgccatgcatggaagcagcctgaggccctatcagaaggagatgctggtaccatgcttcttatacagcctgcagaactgtgagccaaataaacctcttttctttataaattacgcagcttctggtatttctttatagcaatacaaatgggcgaagacactaattaacccttgaatctgtccactttccactttttttcttccaccaccaagattcttatccagactactgctgtctattctggaatctatcctcagtcactctggcctgtttccaggtctgttctcttactactcagccaggggattgttttcaaaatgcttctgtcccttccaaggtacattaaagctattaactcactttttactgctctcagatgaagtccagatgcattaccatggacaccaggcctggcttgatctagctactacctaatcttcagcctcaccttgccccaggcacgcctcactctgtactccagccatatctagtccttcttgcttggcataggccttccttctacaggcactttgcacaacacgttctctacctgggatactcttccctcctgtcttcacctaagtaacttctgttctttcagatctttgctcagtgatgtactcattctcaagaaagccttttcttttcttttcttttttttttttttcttgagacagagtcttgctctgttgtccaggctggagtgcagtggcacaatctctgctcactgcatgctccaccgcccaggttcacaccattctcctgcctcagcctcccaagtagctgggactacaggcacccaccaccacgcccagctaatttttgtatttttagaagagatggagtttcactgtgttagccaggatggtgtcgatctcctgacctcgtgatctgtctgccttggcctcccaaagtgctgggattacaggcgtgagccaccacgcccggccacaagaaagccttttctaacttcctaaattggatcaattctccttgaagtttcttacagcaccatgtttatatgattatttgtttatctgtctgccccactggacagaaagagccacaaaagcagggatgtatttgcttacctttgtatctctgtaacctggtacatagtaggtactcagtacatatttgttaaaccatcagttaggcatttgaaaggaatgtctagggcacagcaacaaggggatcacaaaaatgctttgtgtgctctagaaggtagaaagcagtatgacagatccatcctctagctgggtaggagagaaccgtgaggagtccagaggcctttctagttccatgctcctggggcctccaccgttgtctatcagagagctggcgagcgagccccactgcagcactgccattaccatacttccctggcctataccttcagactttgtcattcttgttacttcaacatcatgactgcagtttttagccctgttgaccactcctgccttgaaattctctcctactttgccttctgtagtattttatttttaagttttttcttatctctctgacaacatcttggcttctcttcccactcatttgctctatccgagtactcattccaaaattcagctttgatctcatggctcccatgtaagaggataaagtctgaacctctcagcagttcttaagagaccctctgaggaacttgccagtatctcaagtttcatctcctgcccttctgttatagcaaatgatttggcattctctaagcactccgtgtttttatgattttgtgccttttcctcatgccccaccttacatccccaccgcctatgtactggggagcctctactattttcaaaacgcagatcaggtcacttaggcctgctcaggcattcccttcctccaggctgtgactcccttagaggcaaggcctttttctataacatggcacttttatatagagtacctggcatatagtagacctgtaataaatattcggataacagaaaggacagttcttttatcttttaatgatgcatataaatagtaacctgaatgacaaataacactcatgataaaccagagtatcactgaataagcattccttcttgagaacagacctcttgatagttaaaaagtaaaatgtcaaaaagtttattacataaataaccttgatctactctgactgtatttttctgtctcacataattctgttacattgtcacaccctcctaaaatggatttctagtcgtgccatggtaataaaatgttgttctaggctttaaaatgatacatctgccctgaaagctttgaggtatttttttccctggggtggttattttttcagattgccaagagaaggttatcatataccaatcataatgtatgtgttgtaaagccacacattgcaatactttttttatgagctgttatgtaagccatgcttcagggcaaagcagggatgcagtggaggaagagccgttttatgcatttccagctgcacaaagtagtaacatttcatgtggcagtgctatattcattttcgagtttctcccctagagggataataggacattgcttttttgcctttcaaaagggtataacaaacattctctcccaacacaaatgccacatttgacctcattctgctctcagtcagtaaaatgtttttcttagtgtcataagaattattttctgttggtgactttaatttcctataaggtttttaggaaggtttggaaatcattatatggtttcactgggtttgccagatgtgaaggaggattaagaattaaactgtttgcttggctttggctggtattagattataaaatgcacttttattggaaacaagaatcaaaggataggcctaaataagtacttccctggattaaaaaaaaaaaaaaagtgttaacagtgtggtctccagggattgatattcggaatgctattttaaaatattttaaagagcatcgagaaaagagagagtcttagctcttctaggtactaaagtagggttgattggcacaagctgaaagttcactccaaaacattatgtgagtgggcagaagaggagcagatgtgacctcattttcaatcagttcagcttttaagccattcccctttctccacctgatgaaatgctgtggttattcttttgaagggtctgtttagcagggttaatttcttattatcctactaagccatttggtttttaaatgtatatttcctctctccatgtgcatacataatatatatgcatacataaattattcatatgtttaaaatttctcacagattttattttacaatctttctttcattactttgctttcattttttttctcttcactttcccaatacctttcttatttttagacagatcattttgtaggaataatgtggtaagatatttcttgtaaaatattgacttctattaaaatattttgtgtaatttatgatatctcatctttagaataaaaatgctacttaggagctttctttttaaaattcaggaattgcttagttcctaaacatgaagagttaaaatctactagagccttttattatttctaaaaagtataattatcagccttttagtagctatgagagatggactgttcagtggcattcatatgccttgtgtttataggcctgtcttgtcatacgtgctcttaccactgaaatgatggcataaactttgacaaatgcagttttatcaccttttgaaatatactacaaaacgatgtattaactgtttaatatttatgtgtgatttttttcaagttcagttcaaatcagctaaagagttaatgttaaatattcacaataaaaaatattttttaaaacctgtaatgcatatttatgattcagttgatgagccaaagcatgaatttttataaggtctctgaaagatagaacttacatagattttataaatattttcaaatttcatgtgttacatagacttcttaattagttgtctatgataactttgatctgctccaattaaacagtcttaagaataaaagtttttttgtaaaacaataatcaatttgttgtttatttttctgttgcaaaaattaacctgtattttggtcctttaattacttgcttgtttttaaaatttattcccacttgagtattaactcatgtttttctgacctgatttagcagggaactgtttgcaagataaattggccaagagaactaagactaacatcagcagatttcctttttcatgtttaaataaagtactcattttccttgaagtgccaacatgatttatccaaatctgaggaagagaagaaactaaaaaaaggattattcaaattttagatttgtagggaaataatgttttcacttatctcatttggattcccaaaatgctagcttaaaccaagccaagcagtggcataagataatagacccaaaatcagtttatattccagcaggataatagatgagccacagctggatgttctccatttactcatccatgaacaaacatgcactgagtacctgctgtctactaggtactcgggacacacagataaataatacacagtatctgtcctcaaagagccctcactttgactggggagaaacatacagatactaaggcaatacagaagtgcaatgttagaaatattcacacgtacgaaagccgaaagtgcatctgtgtaaacaaaacaaaacaaacaaacaaaacaggacccaggaccatgggaggagggcagagtttcccaggagctggttcctgagtttaaatgtgctggtttgaactattgtgtagttaatggtaagttcacatttacaaaatagaacattagacattacagtgttaacacaaagaagggttttgtatgaaatctccctttttccagtaataattttaacttatatgttgagaatcggaagtttttattttgtaatttaccatgatgcctttaaaatatgccgtgcattgttatggttctttaaaagtaaatttagcataactttagtaaatttgatcacctactttagtttggatgaactaaattttgttcaaaattgtactatatacttctgagtaaatataacggatttgttacccatatttactaatatcactgccaaaaccacttttaaactatacctaatcactggaataatctagagttccaaaagatcaaacttgtgacttagaagattttgtatttctgaagtttttcttcttaatatagcctcttatctctgaaacactttaaataaatgtatatcatctaaagaaagttatacttgtccattaagattgggttctggtaaaataaaggtaatatttcttgtcagttgaagagcaattttcctaaagcctgagtgaagaggtgcctccccaccagaaagtatattcactcacaatgtccaatgatctgagattaaatgtcaaatacttactaatgtatctacttgaaatagagatggcaatggaaagtggacactggctaatttttttttttttttttttttttttttttgagacagagcttcgcttttgtgcccaggctggagtgcaatggcacaatctcagctcactgcaacctctgcctcccgagttcaagaggttctcctgcctaggcctcccgagtagctgggattacaggcatgtgtcaccacgcctggctaatttttgtatttttagtagaggtggggtttctccatgttggttaggctggtctcgaactccagacctcaggtgatctgcccaccttggcctcccaaagtgctgagattataggcatgagccaccgtgcccagccgaaactaagactggggataccatcagtgcataattattgtccaaagacagaacatatgggactaatatgtcagtgttttttatatactaaattgaaataaatctggtgggaacaaacctgtttaacccttgtttggcttcttcaatgattttaaattcttagaatggttcaaagtttttcacattgagatccagctccccatctttcacctggaggaagaagctctgtggggggttagaaacagggggatggctgtgcatgctttgcttctgtttaaaaagggaattcagtctccagaagggaggggattgcactggatgcttggagcaggcatcagaacatgtagatggttttggataatcttcatatgaggttatcttcaataactcaaagagttgattgacaaaaaatagttgattagccaggcacagtagttcatcccctgtaatcctagcattttgggaggccgaggtagcaagattgcttgatcccagtagttcaagaccagcctgggcaacaaagtgagaccccatctctatttaaaaaaaaaaaaaaaagaaagaaagaaaagaaatagttgatatttttctaatgagcatgtagtatttttggtacatttaattttcctgttaagtcaggcaaatcacgaaattatactaatgatgtgggagaaattgcattaaaactgggggaaaagagcccaagacttaaaacttacctcatctagatattctgtagttgatcataattactgtacagaatgcagagatctttagaaaattattgtgttgatacagatggggacttcttttaagaattccaaatggtaatgcataaaaatcctaagattggttaacaagttgcaaaattgtgagatttattgagaggctcttatataatggaaatcttccttttattcagatgactaggtgatcaaaaatgtgatatagacaactttttaagaagatacctttgtttttgaaacagggtcatgctctggtccccaggctggagtgcagtggcacaatcatggatccctgcagcctaggaagatacttatttatttcagtattcttcattatagtacaggatagatctgtattatatactgtattatatattttgcttgtttggttaaaggggggtggcatttaattggctcaaaatgcccccttagaaacccgataaaatcttcccagtaggtggctaaaactgcttcacagacttgcccacttgtaactgcagttaccatagtatattagaagtcttgagataaaaataaaagatataactattagctattccataataggcatcactccattgtcaagagtcccagtgtttcaatctgtaaagtaactttgggacgaactggtttactgtgtagtactcagcctggttaccctgcttaagtttaatatacagtattagagttgctgaccttgatttcttttagtggagcattatgatgtcaactctactattttctctattttgttaccctttggtttatatcttggcctgatacttaaagaaagggaaaaaaaagataaagaagaatagcaattcctctaagcgggtctatttctttgagcagataattcttaccagaatatcatactttaagccacacctagagcttatatagaatttttatatttccatagttacctgaaagcatgcttcatccattttcagttctgccctagttgctaacagaggcattgccattggaaagtggccttcaatctctttctagtttagggatattaaaatatacttggaaatgggtcctttcctgtatggatgacattctagatatttaaggactggtaaggtctctgtttaatcttgggcttatccattttaagccctgattaagcacaaattccttgaccatgcccagcagggctgcagctcccaatgcagtcatcgctcagtgctctgaaaggagcaagacatggagctcttcagtcagccggaaatgtctagtccatccagctgtaactaagcagagagaaagaagggtactgaggctggtgcactccacattcccacccacatcctgccacatgttggtgagagtctggggagccccagcctactggcacgccttgttccctctgaatttctggagcttatttatttttaccacctccctctctgctttctgtgtccattccttctgctccttttaggtaactgcagccagagaaaggatgctgataggatttttctgaagaaaggtgtttttgatcaagagagttaaaatcacagaatgaagtttggcttgttatacctttaaattctgtggctcatgaagcatgataaccaagtagtgtgcatgttgttcaagcagtggccctttcctaaagctaagtcatcatttctcaagagatcatgtgactgcataagctcatcattaaaagcttagttttctaggcttcacctgtgatttcaaattcaaacaagcctatgttactgtcatttgctctaaagaccatttttctaaatccctttggatttatattatctctaccaaggcatggccatcttggaaaaatattacatataagcaggatttgggggtaagaaggggcactttgtaagttgtaaggtggatggttactagcctgaccttacttctggtaatccatattaccatccagtgataagtggttatatttttcagtccatttccacctttatgaacatactgatcttggaaaattatctactcatcctcttttccatttctgtttaacagtgattcattagtttgggctgtagagtggatcagctggtgtttacgaaggtatcattgtaccagtgagtcacagaggcatctactgattctcattcactctcagaaaggaggagtatgtagctttcctcctcaggggagtaaagtattacaccactttatagccgttgtttgaatcatataattaagatttgatgtgattattcttagttgacttggggttagacagacaattcttgtatttggttttgccttccgatttaatgacatgcagcctctgagaagtgagcaaattcaatttttctggtgctattatatggcattattaaaagtacagtgccgtgtagggaatatagagttatgttcttggtgaattcataaggtattgccagtacgggtctatctgatttaagccctgctctcccattttgtattttccattctttatctccccttttcttttcggagtctatcttaccaccaaagcagaaattttaggattcattcatttattcagtgagtatttattgaggaattatgtgccaggataagcactgggcatgcagtggtgcgtacgatggacatagcctctgcactttcacagaacttacagtctagtgcagggactagggaaccaaatccagcccaacacctgtctctgtaaatacatggttactggaacacagccatacccattcatttacatattgtctatggctgctcccacactgcagaggcagacttgaataattaccacagggaccctgtggtctgcaaagccaaacatgtttactacttaaccctttgaagaaaaagtttgctgacccctctctcatggatagtgctgaagacatttcataaatgcagtctagaactggaaaagccttgccaacccccttgaggagtgtgtattctccagagggcagtgggctactgctggaatatggtaagcagggaaagaaacatgttgatgtatgaattttagaaaagtccctgtggctgctgtgtaggaagtatgtgtcagggcgagaagcactaggtcatagtagttaagagtgtagatcctgagccagactatttggattgaaattttgactctactacatactgattctaatcttaggtaacttccctgtcagatgtcccatctataaaatagacatggcaatcatagtacctaactcatgggattgaataagttaatgtatgtgaagcacttaggacacagtgtttaccatcatcactattattcctattgtaatcttgttcagaggtgagggtgcctgaattaaggcagtagcagtgaggatgatagaaagaagtggccagatggaggctctacacaggtgatagaattgacaggaatttatgattaattggatgtcagaagggtagataaaagagaataaaaagttgagggtgattgcaggttttggatttcatcagttgagtgaatggtggtttcagtccctgaagtaaggagacagtcagtgaaacaggcttgtgatgtgaggtgaatgataggttcagtttttggtatgttaaatttaggtactagagagatatgaatagaaatgttcaggaagaagttgcctgtaaggttttgagttcagaaaggtgatacgggctggggaaatggatgtagcagtgatcactataaaactggtcactgagcttggaagagaatgaaataacctagaatgaggatggaatgacaaatagactaataacagaaccctgaagaacactaacagtttaagattagacaaagaaccattaagtcaaaaaaaaaaaaaaaaaacaacttttggaggaaaataaacatgaatttttaatccattaaaatttctgtcattgaaatagttgaatttgaaaaatatttaaatttgcaattttggtattagcataggtcaacctaaactatggcgtgtatttcacaatttgatttcatgtactatcatattctatattcttctaatattcaatttcttctctatggaacattaggtaacttagtggatgctatggctatggatgctgacatcatatgagctgttccaactactcttctatatttaataacatttccttacctccctgtttaccaattcacttgagcctgtgaaaggaaaaactgaagtggaggagaatgtctttctcctttttgtgttatacttgtttcagcatcaacaactgggaaccagtttgttacaacattttataatgatatctctatattaatttacttacaacactaacataagtaagtataattttggaaggagccaggagataaattggagaaacgaacactttttccatcatcagaatcaccccttacctctctcttacagtcatgcgtgccttacactttacttagttaattcccaagagaatcttcagttcttcctgaatatgatttccaaaaaaacagccttctactcacttactctgacccttagtatggctcacaggttaggctcaagctaagtctctgaggtgggacaatcagaaggctgatctagaggctttctcaaccctgtaccacacatgcctgaagaaaggcatcacatttatacaatcaggctgtgttgccttttctatttaggggggaacttgtgaaaaactttgaaatgctcccaaaagatgtctgtctaactcaactttccagcttatctcaccctttcctattttacaatcctggaaattacagaaaactgagagtgatgcaaaggactcttgcccattgaaatggaaatagttctggtggaatgcaattgattattgccctatgcagagtgaccaatttaaccagatttgcatctatttgtaaattctttgcaatattcttgatgtttatgtttgtcctttggatttatttttgaaccagttgtaatatcttacaggttccttttttaatgagttagttaaaatttatgtcccatcttcaaaaaaaattatcttgttatatatacacatgtatgtttatacatgcatatcacatctgtagaaaaattcacaagaagttggtagctgtaattacccctgcagaaggaaaggcaggaaagcttgcttttcactacatgcccttttggatgttttgaattttgtgttgtatgcctatgttacctaaacaaatagaaaatttttaaaaatttctttttgaactcttgaaaatcaagacttagcgatcccttgactactaatttcacgtctgaaataactgactttctataaaggtttttgcctctaaataaactactaatagagagcagcctacacatcaacatcatacttagagacttacttttgtattttttaaggcaaactagtaaactttacttttcaaggtagctctaaccctgtagaaagattttggtcgggtggtgctaattctatgactactctgttggggaatcacacagttttagtgtagagggaagtggcagacccatcagcctattttgcatttattctgtatgcaccttgcctcttcaccagctgtgtcctctataatccccttgtctaattataacgagcagccctcccattaagccagtgattctcaggcttagatgtatattaaatcaccaggagtgcttttaaaaatcgaaatgcttagaccaattgaatcacaatgtctgagggtaagacacagacattggcattttttaaagtgatcaaggtgatgccaatgttgagaaacagtgtcttgtgcgaagaatggtactggcttaggaaaaaacttaacaaataatacctcagaagcaaaagcactcaggatatctgactggaagatctgcataggtgatgaagacggcccaaacagaaaagagaggcaccctttactgtgaatgaatatccttgtacaaagaatctgttttgacccatgctgcttctggaatggggcaaactagatatgggggagtggtttaaaagcccgagctgacttagttacagatattagctttttttatacttctgatttcagataaactctcagtgagtaaaaaataccaaatcgggactctgcatatccccgccttgttcctctgccatttggggcactgagccagcctgctgacagtgacatccatctaataccactgccaccatatggttgtgctaccgacaaaaggttatatttatcacacacggtacaactgggaaaaccacatactgtacaaacatgacctattaagcatctgttttaatcaaagattctagaacttctttgctctaacccttaaaaatatgctttattaagaggtctttgatagagaagtagatttgtaaagggagaagtaaaaatgcatcctttcattaattttgaaatagtaaggcgaggagatagcctatttcttggtatttcttctctaccctgaaagatatctcctaatgggaagtcctgattaatggcccgcttgtattccaaactgttttattgttgcctcagcctttttcaaaacctgaaaattggtctcatgagctctactgtggtggtttgccttcatgtactcattgtatatcccctcccttttgtataggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagagtaagcacacatcctcttctttctaaaaatggggcaactgttgttttcataggtttttaggtttagttagattgttagaatgaagaaataattattgatgcctttatttcaaggaaataagaggatctttgaacagcaaaatggtcagaaggaggcagtccctccatttatgccattgtattgaaggtgggctgtataaaattctggggccctctacgtcagtgctattcaaaatatggtccccagactggcactggtcaatgaattttttgttaccagtccacagtgagaaaatgagcttgcaccaggatgtaagtcaactacactattaaatattttgtttagtttaagtgacaactttttaatagcaaaacttccttgatttgttgattttcattctggagcaagtgccttatcttgttgtggaacaatagcaaacagtaacagtgttctgggtgtctcacatcattaactagatttatgtttcctttaatttttttccctcagtactgaaactggaaattgaaacactttactatatgcaaaagtaacactcagatagataaaactgtgacctaagatttccaattcttttcatgtagtatgatttttaaatgaaggattttcagctcttaacttttgatggatagtgattactgaatgaactcaaagcttttctctttcagtttattcaataactggttctactactataggatctacatagctttcattaatgtagttggaaatttaattcactgctactagaaaacactcaaaatgtattcctgatgatgtattgttagcataatcttcatttttaaaaggttaatacagcaggtgctcacactcccatacctgttcacatacacgtatgcatgtacacacacacactcacacctattcaccagcattctttatgaccgctaagtaaaatcctgtgtccaatataatgccatttaatagactttgagcattcctgtacatttactggtaaaagtgagaagagatgagtgaaatgtgcaaagaaggtaggagtggaagtgcagcagtgtgatggtgagtgatacaacctcttatacagagaacagtcagagcatctcccagggctgtgaaggaagaatcttagagtaatttattcccagtagagacttgcctagtcatagatagcattgccagatttagcaaataaaaatacaagatgcccaattaaatttgaatttcagataaatggttaaaaaatttagtatatgttccaaatattgcatgggacatacttaaaaatttttttaaattggatttccctgaaatccaattttaactcggtgttctgtgttttatctggcagtcttagtcaggagataaagatggttgttaaagagttacagctgccatgtgaggaccctttaggacccctaacaggatctcgagtccctcgtctagaacgtgtctcagttatcctcagtgcagcactcagtcagatccctcatctctgttacagaggtgctttgcgaaatgactggtggcatttcatcactgtaatgagggagaagggaagggactttctgctgcaggctgggacttagtataaagttattgaattctcacaaccaaactgtgagagagctcttacctgtgtgtgtgaagtctgaggctcagacagagttgtgacttctttgcatttacctagaagaatggcaaaactgtgagtcgcccctaggtgatttggtgtgaaagcccctttgtctccatcactgcacacctgaggtatatatctctctctctgagtagtgtacctcagtgcagatgttacaatcagagggtgagcttaacagtgtggaaacaagaaattttagcacataaactgtttatttaaaaatatgtcacttaaaacaccaatataaatatagctaacttttcaatataagaaataagaaaattaaatgatgtacaaggcttaaagcagggcacaggatttagagacatcctctgtgccttcctccccttcacccctcacatccagtccatcagcaaggccccttggttctgccaccaaaatgtagcccagatcacttctgaggtccgcttctttcctctcctctacctccacctgaggccatgcaaccatcatctctcctggaatcctgcagaagtctcgttactggtctttccatttctactcttgcctcttactgtcttttttttcagacagaaatcagtgtggtcttttagaaacccaaatctaaaaccattctgtgccttcccattgcacttaaaacccaaactcctaacgtgcagcagcccccacgctgtggcccttacccaccttgcagacctcttcttgctactatacttcttgcccacatagtccagctgtgctggcctgtctcaggtcttctgcatatgctcttccctcctccatgaatgcttgttcctttcttcccatgacgggctggctccttcccatcctttaggcctctcttgcacttctctaaccatgctgtctaatttgctaaggccccactttattctctattacttctctttagccattttcttcatggtatctatcaaattttataattagatattggtttattaagttgtttattggctgcctttctcattagataagttcctaagagcaagaactatgcctatttgtaagcctagtaactgacaagtaggaactcagtagtagtacccagttggtaaatatctgtcgagaatgaatgaacgtgtgaatgaaatcagccagggttcaaaccttgatgccatcactagatgtgagatctttgaccagttacttgtcctctctaaccctcagttacctaaacgttaagacagatctaaccataccaatctctcaggattagcattagaattaaaatgacataattgactacaaaaagtcttttattagcctgttggttagaaacctgagtattattagctgtttttactgctatggtattttcttccttaccttgttgtcaacattcgaatgttttcagttactatttagctttgataggctctgttgctttttggaaaacataaatgtcacacattgccttgtctacatcctcttgcttctactagtaccttccatgatgctaaagccttcatttcctttgaaaatttcagacacactgatttccatgggaacctcgcatctctgagtcctccttgcaccccgcagtttccttcctgtctcctttctttccttcttccatgccttgcatagccagttctgtcccgtgttctttcctctggcacaactggagcagtgcctagaaataggacattgcatgtttttgtgtattatttctgtaaatattgtgtctccagtaaaattaaaaggcccaaatctattttagtaaatgctcctaagcctctctttgaaatcctatactagtgataaaagtcattttttaatatttcaaaatgcccaaatataataaatcccagaaacttttttaaactgaatccaaattattttttaaactggattctttctcccacttaaaaaaaatgagataggcttcattcctttttgaacacttacaattcagtgtagagtataacatacttttctaagtaaaattatttatactttagaatgtggacaatctttggaatttttctctaaaataataaccaaccatgaataaaaatcgcctaagtgttgcatattacctaatatgcatattagcacttgtctgcttttactagcaacatattgaaaacatatcgcacatccatattgtgcacatgaggatgcacccttcctcatcctcatccctcatggggaatgtgcttggagcccctcagaagctggcttgctgtggctggctttttgccgcttcagaacacaggccctaacagccttgttctcctgcctctgtctgtcatagaaatgaggcacctgcatagcttagagaccaggcttgggctgtttgtccagctgtgacatctgacactgtggttagcttgttcgttcttgcggctgttgtgtagtctttgtagatgaatgttctcttccctagaagcaggagagaactgtccagctgctggcatgactcacacttctgtatgtgatagctttgaattacattcactgactgagtaatttattggctgttgattgcgtgttaaaagggtgagtaacagtattttgagtgaactggaggcctgcttcttttttaaagacttgagccaagaatgacttcacctgccttcacacttttttctataaaatacaaatatgattttcttcacagttcaacagatattgagtatctctaatatgtaatgcactgtccctgccttcaaggggctcaccatctaccactagggagaaaggaaagaatgccataatgtaaggcagaatgtaagaaccattagaaaggtattttaataatgtggttcagaggagtgagaggtcaagttacaggggagtcagaaaaggatactttgccaggcatggtggctcatgcctgtaatcccagcactttcagaggctgaggtgggctgatcgcatgagtccaggagttcgagaccagcctgggcaacatggtaaaaccccatctctaccaaaaatacaaaaaaatcagctgggcgtgttggcgcatccctctggtctcttctacttgggaggctgaggtgagaggatcccttgagcctaggaggcagaggttgcagtgagccgagatcacaccactgcactccagcctgagtgatagagtgagagcccatctcaaagaaaagtaaaagatagttttcttttctgagggggatactagggaagaccctgaaggatgagtagggtgccttcaggaagagggcacttgaacatgtagtagaagacatgagcatgtagtgcggtttacttggatctggaggtatgtggagggaaatacagctgggaagatagtagggcattggaagactacatgccattcacagagtctacattgaatctggtatttgggaagacccactgaaggtttataaagagaactttggggatttcaaactagtagaggtgttagagtagattagggggtggaggcctgttagagggttagtggcatttgagtgggaactccagtggaggttatagaaccagaaaaaggagattcagtgtaagagaacaaaagagttagaagcagtaggccttgggaggtgatggagtggaaggggaaatcaaagataaatccaaggctttgaagctcagtaacacaaagaggagtggtgccattaacagaaagaggctggttaggatagaacagtccactctgcccaaagctcgtttacctgaactggtctgctgcccggtttagatgaattcatgcagagccagtcaggataaggagcctgtttatgggaagaagtagaaaattctgtttgtggataggttagattttcttctgataaagtttgggattttatttccttttactgtgaactgctgatgcaaacacttggaaatattcttaccctttttttctgcccaacaaagcagacaatcggaggtattctgattcaaacaaatgaattaaatattttgacttattgaatgaattcatttgcttctaatatttaaccttttctcccacttacacaccttttgcatttctgttttgtagaaaagctatcttagttgcaattacaaagtgagatgatagatgtaaaagtgctttgaaaattctaagagctatgcacatgttagtaagatcgttaatatctttcttaagcttgtctatgggaaatattttttaaaaagatattttacatttacactcatgccttatatgccagataattctcctcttacctgagtccaaaataaatattaattcttatactgtaattttatctaaggtgaattgtgtttgtgaggttttcttattctctatccatattaaaggttctctttgatatctaccaagctatttagaatgtattgctataatttataaaatggttgctatttttaaaacattgatttaattggaatgctatagctttccttttagttttgttttatgtatcttgatccatagatttcagctagagctaaaaccttaaactactcataaaacattaagacaaatatttagaatatatagaaatcatacatacacatacatatatgaatcatgtatatgcagaggtatttgtactttgccctagtttctgtttttggaatatgtggtggttctatgtgaccatccaaactaattgatgacaatttttcacacacaatcccttttttacatagattgcccaaaacatattttatttttcagactacagtttggcaattttaggtctaatgttcagaaaacacatttgaaagtggtttcacatgacccaagatggacatgttgcttactgacctgaaaatttttactcttggaaactagactactttgtgaattcaggggttttccagatttactttaaaataagtccttgtgttctgatgtctacttttcttcttcacacacatataaacacaaaaacatatacacattgcatgttagaattttctcaagttgatttttgtttaaggttctggctaacaacagatgcatttagacaaactgaaattattttaaaaaacaggagttaacttacgttacccccatttctacagcagtttagggaggtaccatatttatttcagtgaggctacaaaaactggaaatcaaggtaacttgtttctctaaacttccattagcagagtagcagcaatcttgaatccctctctccctgaagtgccttcttacccttgataggttctagatggctcccttcccttggtggaaacgtccttctgctgcccagacctcatttggttgatgagagccttcccactctctggttattgtccaagttgctctattgacagaggatttatcttcatttcccctctcttcatccctctagctctgccaccaatgttacaattcacaaagtatgcctgataaaaagttataaactcacgttgcatttattgtattttcacagacctctacccccaactacgaatttagaaaaagtttcctggagactagtttgaaaaatatttacggtggcaccactagatatcccataacaacccaccccagtgacagacaatttcaggaaaaccttgactctttttttctctccgaataagtcttttgcccatgggaaacaccaacacagagattaagggatgttttttgtaccctttcctcctagagcatctcagtgtttgagctaacagtcttttcaaagtatttagtcattgttctctgccaaaaggtgatcagttccttccgaaagacagcctgtgccaatagacccagacatgctagagtgcagtgtgcatggcggaacacacgcccctttccctcagtgggtcagcatggtcacctttggtaatttagctcagactattccagaaccattagatacaggctgtctactacaatatatgtttctttgatgcatattggctcctgtgtgtttggtaaatagggaaattatatcaattcagtgtgtaagtttttgtggttcatagatttcctcttgcatattaatgtttggaagtgatcaggaataaggtttctcacagctaaagagacagccataaaaaattatttatgaagaccttaaggggaaaaaattctcttctgcagaagtgtttttatttagtgaaagaaatggggagtttaccggctttaagactcactcactgtagttgccgctatatttagctgtctgaagaagctgcacgtgcatccaaagaaactgagaaggaaactgattgatgaagaaggccatccttggatcatacttttaattttggtgaaattgctctgttattagaaatgaatgtctccaaagacctacaaaaaggaaaacacaagcctatgggttttaagtttgcaaaggatggactgtcatacgaaatgcaaaaattagttgcaattttaactgtgctgattggttttggtttctttagggctctggtcccaaagttcctaaagtttgtgtggtctggtcattgtccctattttttttttaagtcctattgccctccctctctccctccctccctcccttccttccttcccgtattttttttctgaagtctttctttctttctttgttactttctttgtttctttctttcgcatacccttgcaaaacagagattgctaggactacatatacgaggcagaaatgcctataattgcacctaaaaggtaggcatagccagactgctgggcttagggctatgctatgactgctttgcataatatagccataatataaaaggaagaatgggagatattttctatattttagattaataatttacatgacactgtctagctggtaaaccaagcataaaccaacacttatatagaaggaatatcccctacctctccatttattgtagaagcagagcatctattctgaaaaatagacgactctcaatagacagcaaggattacatatggccacaatggggagaaacttggcccagtttagagccaggactcaattttgccatagtcggctataaaactccagatgacttcactctttacatttacacatgtagatctttacctctggaatatctggtaaaaggacctgcgttggagagaaggcaatctttaaaagtagttgaaccaggctagaggcagttaggggaggcttccttcctctcattctgagtttaaaattgacttcaactccttgatctataggaatcatttgtgacagtttccccatggttaaggcaagtcattggagagagctgtaaagcaagatcataagcaccaatttttttttcttcagaaaggattgtagaagtagtaatatgaataatggttgaataattgttatataacttcttgaatgcacttataaataagttaattatctttgctcattttaagctgaatatgtaaaaggtacacttggtatatcataaatagatttagtctttcatcatttttgcaagatacaagttgaaagtgctaagaaggaaaaagggcttagcaccaaagccaagctaattacatgagttaaaattatataaataatatagtttaattacattcagtaaacttttagtctgtccctgggaaatgacctgtagctttgcttccctcttcactgaatcctaggggagattccactcttcaaaatgtagctattgtataggaggtaaatcacatttttaatagcctggtgacttattttagaatgaaccctgccattttaatcaaatggaaaatattcgtgcattctccagagtagaaaggcccagtgagcgaactaaaaccatgataagggctctagagaaagatttgagaatctaaactccacattcttaagaccctggagattcacaagtgtcactttaaaggaaagtgttgtagtcttcagtagaaggatgtacttcaacttttgtgaggcaggagctccctccagagtccacacgtggtaagctgcaggcctgctggagtgggtccccatccaaggaagatatttaaggctgatttcttctcccagtgagattgagttggggaaggggtattaaaggaggacagagaaactctcttgaaagcttctattgaagtctgtgtaaacacaactacttaagaaagcagccttgggtattcttatttaaatcaaatacaaagaagaatctatctatcttctgggcagacaataatgtaacctagactagagtttggttggttcttgacctcatatcttctgtcattgtggtactagtctctggctccagggtcatatgccagatgttgaggctgatgagtggaagggctggaattaacagtgtgctaagggtgtgcaccagtagacatagagtggcccagaaagggttcagccctagtgtacttatttacacttgtttatatggttttcaggaatacttctcgatcacttcaaatgaggtctaagctgtgtcttccacttccacataattaactctgttgctgtgactgctgcttttcttatctctctgttgcagcagctgatggagatgggggggcctcagtcagtgacagtaaggatcagcagcatcactgtccctgtgttacacctatatgcctagcagtatgctgggtttttaaatgtactatctcctgtgcttataaccatactgagatagtatattttcaatttcactatatttttggatgatgaaagtgaggctcagagaactagaaaacttgcaggtcacgtaactcgaagatggagatcctgggactcaaattctggcatatacacccattgccttgttagggatgctaacagccaagaggttgtgttccagtttgctacaggacattaacttctttttacagggaaagttagaaaaaggtaaaaggcaaaggtttagtgtgtcattattgcagaattttttcttgcctcctaagacagggtttcacaatctcggcacttgacatttgggccagataattctttgttgacagttctttgtcctgtacattgtaggatgtttagcagcatctgtggcatctacccactagatgtcaggaacacacacatccgcttccacctccctagttgtgacaaccagttctccagatgttgccacatgccccctggggggcaaaatcacccctgattaaaaatcactgctgtaaggggttaattgaggtaatgttatgggaggagggtgtgacacaatgaaaataacagagatggatttataggattaaggggaagaattggaacagattgatgaaatgggacaaatagataggaagactttgtcctaagatgaagatagttgttagattagtggagggggttacatgcaggttcacaggctccatcatggcagatctgaatattgttggtggtagtacagtaatcattcatggatgcatttataactctttctctcttctccctcctcccgctttttttttttttaataacaaataccgggagtggagaaaaaagatccaatcctgctatttctctagttctaccttttggccagttggtggccactgagggcgtttcagaatttggtgtatatttgtccaaactttattctgagttatattaaactcattctcctcttgaattatcctccttatttcttatttccattacttggttttgttttttgttttgtttttgagagagagcgtctccctctgtcgcccaggctggaatgcagtggcacgatctcagctcactgcaacctctgcctcctgggttcaagtgattttaccacctcatcctctccagtagctgggatcccaggtgcccgccaccacgcccagctagtttttgtatttttagcagagacggggttttgccttgttggccaggctggtctcgaactcttgacctcaggtgatccacccacctcagcctcccaaagtactgggattacaggcgtgagccaccatgcccggcccatttcttgtatttttaattagaagaattgctaatacctgtggggggaaattatttgaagtaacaagaaaaatatcaatcatgcttattttattaaccttcaaagacaattttacagtatacttatcaggactattataagaaattcacttataaatattgtagttacataccatcgaatgccagaatgaattatacaaaggtaaagtacgtaacaatactatgagtccttgctcagtgtcttcaataggttcaggaagaagatgtacaatgaagctaattttaccataggcaaattgatattgttgactgaaggaaaaaaatttaagcttttaaataattaaagttagttctatttggaagtcttactgaggactatagactgaggcttataacccagaagcaattctgtcaggctgttttaaggcagtattttagtttatggtttacatgtaggtggtgaagatttaatatgtgtaaaattatatctaagtttcagtgtaagagtatatttggtgataggttatagaagtataatcattaattttgtcaaatgttattttatgtataggaaaagacaaggactaggatcattgatcttttaagaaatgtagtgactgaggcaagagttgtggtggggccatgtgttttattttgttttgtctttaaagtattttttacagagctgtatgtcatcactgaatcaagagctttgtgaaattatgttggcaagtagaaatgagcatgcctttttatgtttgttattgtgccttacaacataaacaagagtcaagttcctatggcatgtttctggtcacaaaaatatcaccaaacttctaagtaaggaccaaaatacttctaatattaaatattgaaataaatgtgaagtatgcatacatttaataaatattaataaaaacaagtaagatgatgatttactcaatttttggtgaacccatgagtgatggtactcatagtggtggtgaatttaatcaacgagtaaacgtttacgaagcgaaaattgtcaggagtaccttccaccaccatgcagttcaaaaacaagcaataacaaatgtggggagcttgctgagcgcttctgtcccacatcatttattgtcctgcatctgtataattgtcgtctacattacacatttttatttcacagtaatttgtatttattcatataatttgcaatccactcattccagtttagggtggtgtgcagccagaacaaattctggctgctgaaaacacaagatgggcaccctccctggccaggacgccatcctatcacaggtgtactcagacacacccatactcattcaccctaggctatgtagacacagcatttcacctaatgggcacagcttggggatgtatatccagagaaaacccatgcagacaagggaagggtgtgcaaactctacccagacagtggcatcagtttttttttgtttttttttttctcatcagcattaaaacaaaacaaggttgaatgaggcaatgttattcaaggacctgcactacacttatttaataacttggcttgtcagagcttacagagcaccctttaacgtgcttaaaaaatagatagctacagctgggcatggcagctcacgcctgtaatcccagcactttgggaggccaaggcgggtggatcacctgaggccaggagttcgagaccagcctggccaacatggtgaaacctcatctctactaaaaataaaaaaaaattagccaggtgtggtggcacgcacctgtaatcccagcttctcaggaggctgaggcagcagaattgcttgaacccggaaggtggaggctgcagtgaactgagactgtgccactgtacttcagcctgggggacagagccagactcagtctcaaaaaaaatttaaaaaataaaaaataatagatagctgcaaataattaggcttttatttatgtcagttaactatcaaaatatacaacattgaaattaaaataaaattttaatcgttaattcatttaagaataataatttcattacatattacatattttatgaaaataatttttttaaaattaaaagaaacgagtatcattgtcttagatttttaccaacttctgtaatgtctggcttatagaagataactgaattccaacacctacctctgcattcagtctatgcccctgggttgttttagttgaaatatatgaagaaaatctggcctcactcagatatgtaattgcaaaaggggggagcattttaatagcttttttcaagtaattgtggatactcctttttgatactgtactaaaaactagtggtagttttttaaaaaagtagctgcaatatagaatctgaaagcataaaaaagaacctttagtactgtttctagtctgtcttgcactttaacaggacattttaccattgtatgatgctgtaatatcaggagttggtcatttggaaaatattggtttcccaagtaatgcagatcttttaaatattgacaatttcattatataatgataagaacaatacatttgttaacatcatcatcagtctcattggaaaggccttaactcctgagaaactgtcatatttccaaatttcttagtttcgcctgagagctcaagttttgtcattggcaacaagtgatgtcagttgtttttgttgaagtgacaggctcccttcattcatgttcaaaaaacttccagataaccaatctcagtgaccatagtttgtcctttgtttctttcaagtgaaaatggcattctattaaaaaataaatcataaaaacttattcagcatacagatcagtctcagacgcttttccttgacacacccatcatagttgaatatctaatagaagtctttcatgcatacttcccatttcgtctcacagaatattaaaaaggcatacactcaagggatttaataaaattaataaatcttcatcaaggaagacttactgcttcatcaaggtcattcagtgtaagtggtatgtgttttatatttagggtatatttatgaaggtatattaagtatattagggtatattattatgaagaataacttaaatatgggtaccatttggtgtcattgccttgatttatgctaaggcaccagcagttttacccactttgctttggtaccatcagagtaaatatccacacagtgaaaaagatagtatcttcatatgatcagcaaaataattttgacctcaccaaacttcagaaagggccttggggaccccacaaatctgtggatcatactttgaaaaagccgctgctatagattttagaatgaagaaggtgaataataagtttcctcagaaaaagtttgtcatcagcagtcttccagtttgattattgacaaatacagcattattttataaagtaaaatttaatctcttatacttgatttactggtaatttcagagattctgtgcttagtgatgatttagataattaagatgctcacttactcaaaattgtattgagctctattttaattaactgatacagaagaaaaacttgattttatattgcagaagtgcagtcaacatctgcacaaacatagatggccggatagtatgaaatcctatctctacactaattacttaggattgatggataaaataatagcaaatcggccagctttaatattcctgggactaaaatggttttaaatggtatagggcaaccagcctccaaactggaaggagtaatttattttaccatcatcctattaattaaaattaaaggaactcatgggaacaaaacccaagggttcaaggttcatcaatttattagttgggtattttattataatatcagtattttgtaatgattgcttttggaatgccaagaattcattgaacagggttcccaaaagttgtccatattttttaaagtctagagatagtgctaagataaatataaacacatcataaaataagatcaatggtatttacatgatgaatacctgtggtcagacattagtctgattacctaggttctaaactgctagctcattggtttggaacatctgcaaagctattccacgcaaagccttccccctttagcaagttacttttatcaataagtagtgatatacatagacaaaataattgttttaaagttagtcttaggaccaaattttcagtaggaaaataatataccaacctgagggcatatttcgatttttccaccccctccacccttcccttttcaaaagaaaaatatctgctatatgatacctgagtaagcagtaacttactgtttgtattctaatgattgtaaaacgttaagcagatatataatggaatcagaagaattcacccaaagccagagtaactaagatatgagtggttatgataccaggcaaaatgttataagacaaagccaaccttgcaagatgataaattgtcttatttttcccatcagtgtccattataaggtataatgtgtgagtctacacactgtggtgttgattcttgtatctctgtcccaatacggtgtgagttctctgagcacacagtagggttagatgggtattgctcttccgtattatcctctgagtctcaattttcttatctgaaaaagagggagtcgtcaatttttctaacttgttttaaccacaagaagccccagaatcctttttcaagtgacttcctaggcaactctatgcttttgttcttggcaccttctttaaatccgtgggctcctccaacaagtttggaaacctgagacctagatgttttcccaggtctctctcattttaaaattaagtttttctgtgtttctacattctcccctgggtgttccacaattgtttctctagataaaaaagctgaatagaaccagccagcaagcagctggtgtgcagctgttatcactcgagcctgaactttgtggcatgctttcttttgtggtattgcctcttcctgcatcctggaggggggagtggcttcacagcccttgggccactgccaggtgcgacagctctttttggaaaataatgatagatgtggcatctatttacttggctacctagtattggtgcagaagcaaatgctgctttgatcccagcactttagcaacttgcactgtttggcaaaacttgcgcttcatgtacaagccactcaacactgtgcccatcctggcaaggagagcatcagacgcagccaggataccaggcttgcccttcttcggtttccccaggagcaggcaggggaccagatggattagctggaggacagtcagccattttatattgccaagctcaaccatgctagcatttccaggatataatcctgttatgagaatgtcttcctctattagcctttgtttgtgccagctccaggggtggaggaaacccattttgcctgacatactaagaagtgacctttccagagccagctactgtttggtgaatagttgtcatggtctttccccatatctctgtatatacattcatgacttttagaacatagaaaacttattttttgttctaaaagcttatcatcccgtatatttccttatcctttacccttaccagccttctctacatgacctcaggtttgtgacatgtttagctcaccacctagcacatggtaagcagcaagtacatgctagctgttttactagcagtgatggtggcgtaagcatctctctctctctctctctctctctctctctctgtctctgtctctccacccccaagaccccctcattccccccaatctccctccctcccccaccccccaccctgtctctctcccttcttccttctctgaagcaatatgggattgtcttgaatttcttccacatgtcttttcagagtttttacctttttcatttcttttttctgagtctagcgctttgctttcatctcagtcttcaaatggcccagataaactgcttatcagaatggatgggagcccagtgcataagattgcactttgggagtcacatggtagcttttaaagggaatggcttggacgcttcaagaaccttgctcataatatattaaatgtgtcatagaattttagaactggccaggctcaatggctcatgcctgtaatcccagcaccttggaaggatgaagcaaatggatcacttgaggccaggatttcgagaccagcctggccaacatggcgaaaccctgtctctactacaaatacaaaaaaattagctgggcctagtggcgtgcggccatgatcccagctacttaggaggctgaggcacaagaattgtttgaacccgagaggcggacgttgcagtgagctgagatagcaccactgtactccagcctgggcaacaaagcaagactctgtctcaaaaaggaaaaagaaaaagaaaagaaaagaattttagaactgaagggggccagaggggttccttggtactgtgagagatccctcactttgtggataaggaatcccaagtataaacagtatgtgatcatccaggattaaattaagtggctgagaagaatgaatccaggtcttctaggaccgacctttcactataccagacaaaagagcacgaaagtgtgttgatcagagcagtagttttaattgtagtatttttgatacatttgtgaaacattttatagtaataaaaatttttacttaggagcaaaagaagtatgttatcaatcccaaggtaactctttttaaatgtggacatataaaattccaattatatgtagaagggcctctgcttaaatctaagttgtaagaagttatactattaataagagaacagatataaaaataataaaatcctgccattttcggcaacatggatgagcatgggggacattatgttaaaaataagccaggcaccgaaagacaagtattgcatgttctcactcacgtggaagctaaaaaatttgatctcatggaggtagagagtataatgacggctacctgaggctgggaagggtgtgtgtgtgtgtgtgtgtgtgtgtgtgtgtgtgtgtgtgtgtgtgtgtgtgtgtgtggagggctgggatgtgggataaagaggggttggctaatggctataaacatacagttagctggaaggaataagttctaatggtcaataggacagcaggtgaccatagttaacaacaatgtattgtgtatttcaaaagggctagaaaagaatatttgggatgttcccaacacaaagaaatgataaatgtttgaggtggtgcatatcctaaataccctgctttgatcattacccattatatgcatgtatccatatatcacatgtatcccataaataggtactattatcatatattaatttttaaaagccaccttagtatggcctagaagtagaggatcagtgttgagggtatgggcaaaatttaccattgtaccatgcctgtcacttagatcaccctccagcctggcccctgaaacgcgtacctgaatgctagggagatacactgaaagagcattccattaaaatgcctgtcaaactgaaggatggcaaatttctgtacttgagggtttgtggacacccataggcagattaccagccagtggcttctgcagcgccaggaaaccatgcctgggcacagaccagcaaatgtcatcagcaatggccattccttagaataggcacagcagggggaccagcttcacaggaccaggggcccctttgcagcagagtcttcacctcagcaagcagagctcacagaaaatgaggggtgctgcatggtatccgagagtgccaagttcataaatacacatgaggttcactttgggaatcccatacagagctgaaagagtgatgagcatgatattgagcatttagggagctttggtttcctcttctagcaattgtggataataatacttggcttgtaaagttattgtgggtaacaaatgtgctaaaggacataaaaggcatatcacacatgagctccaccggttggaggtcacagttgttggaggccaccttcatcccttgtgtggcatagagaagcttcagaagctcttttttctgtataggcctctcatcatgccaggtgtgtggtattcagccttatctttaaaatatggtaccctcttcattgtatttcatcctgccgtcttactacaaaagaggaggagtcctaaaggaagttagtaaatacaaagaagttcttaaggtcaacctaagataaagaaatgcttgcttgtaagtgctgggtgattgaatctataatttgcgtcaagagaagtgaagaaaaatgttagggtggtgcaaaagtgatcgtggtttttgcaattttttaatgacaaaaaccacaattacttttgcaccaacctaaccttgttttaggcatgtatctatttaaagacactttattttacctataacgttgatgggtttacattgaactcagggccaatagcactgtaactcgcacccaaacaaagcttgtctcacgtggattttctgcacaggacacagcacagcatctttgtgcttaggataccaggtagcacactgacattattctcgggaggctgttttaaacagcaaaattaccaactaaaagcacaaaaatgagaaaatctgtggcaccaaacaaactgcaaataggacacttgttttctctctcgtttttttttttttttttttttttttttgagatggagtctcgctctgtagcccaggcgtggcgccatcttggctcacagcaagctctgcctcccaggttcacgccattctcctgcctcagcctcccgagtagctgggactacaggcgtccaccaccacgcccagctaatttttttttttttttgtatttttagtagagatggggtttcaccgtgttagccaggatggtctcaatctcctgacctcttgatccgcccttcttggcctcccaaagtgctgggattacaggcgtgagccaccgcacccggacacttgtttactctatgagcagaaacaagaaacagaacatcctcgtgtgcatgcccatcaggcatctccaattgcaatccacatttgtggacgtagaatccacaaataataaggagccactgaatttttgtatatttagtatggggctcaggttaatcacagaaatatttactatatagttagtgggcaaaatgcccagtaccccattataataaacccaaatctcagtaacagtgaagatgtttctcagaggggcatggctcctctgatgtttgtcagataagcatgtcttattataggggcactcagacaacagaggcacagaacaaaacaaaatattttttgtctgttaatttatttcaaaaatgaaatctgataatggcttttagaaatgtgaagaccaaaaagcatcaaattttgtttttccatttaaggaatagaaataaagtggccgagttattattatatgttccgcccataattcatctttccttgctccttcccacccctccccactttatcttccacctccttttatagatacctaactgctaaaatgggcttgggaaggcagctggaatcatgccaaggtgtacccaacagaagctgctgcagttagtgacatgagctatggaacacaggaggtcttttgcactgattggaatatttattagatttagtgctgaaatagtctctgctgataagcagacctaatctgaatttcaaaggtccttatgaccacgtaaatgtgatagtatcatatcctcaggccccaagtgcatcacctttcctaaatggttggatgctgtattgaatctatttaatatcctggtaactagctttgacttttttcaggaatacttaataattttagatttaatcttccctcctcctcctcctcctcaacagaagtaatttaaattctttccaagtagtcattgcacctgtttcttacttcaatcttggtctcaaagaaatatacaacaaactccgatagaccacggccataaagtccaattttataatcatgcaggaaaaggaatgcttcttgaggatcaaaagttgcagtcatgatgctaggatgtttcatatccagtaaaactagagacaccccacctcatcagctgattgtgggagaagtcgtttacaaaagtcctgtgaagaaagaactagatgatataaatgtatgcatatttctagaacctgaaaaatataaaaagataatcaagtgtacttggacccatagccactggttttaaccattctgcagaagtatagcgcaattattattggcaatatgtgaagatatggatgatttcatggggaaatctttgaaattaaagtgggataatttggaggtacaggggaaatgtttttccctttaaactgtggcaataacccttgtaattgcatgtgctctccagaataaagatatagcagattgacatcagcttcagaaaatgagacattaggtacctgagggattcagtcaaattgctcctatgaaatcttgagttttgaagattgaaaaaaaaatgcttgtttttgtgacaagtgttttggggaatattttaggggataattgatgttctgcattccaataccttaggtaatgaggaagctgtggaaacagcctcctttcttttatgaaggctttcgtattcaagatcaccatagaggtcagtgctgtgaagctaatcttggacgcctatctcaattgcttcagagtatttaggatttctaaggtttttgatggatttttttcatcaaaagatataatttttcctccacatgaaatgctttaaagtggtgataattaaacatatttactcagtaatatttggaacattatactggaattcagaagctctggctttcctctttggatttataaaccaccaaaagttggcaactggcccttgtaaaagatttcttccagcagagctcttgtatctttgtttgtgttttcctttcccgcttaagcacatttatctttgcttttagctgctgcagccctctgagaaacagcagtcttcttggcagctgcattctgtgcaggctcctgctctatcagtatgacagctatctagaaggactatatattagatggaataaccagctgatatcagaagggaaaaaactggcagcaacgaagcacaaagttcccctcagtataatttgcaaatctttcaattaacctattgaatcaaaatgagaatgggtataaatagtaatgatttttaaaatatgcccttgctttttagaatagatgcattttcagcaaagccatctgcaaagtgaatacgaaaatttggtctaattctgttagtaagttgacattgttgttctggggaaagctttaatgtattattttttatgagaataaaggtatcaggctagattttttgcccaggggtttgctgattatgaagctgccagagtaatgttccattcacttgtagttgtcttaagtagcaactttaaatattttgaaaaaaggaaagaagtatttatgtttagtagaatatttaaaggaagaaagtaaaaacaatcacctgtaatcctaccagccaagtaatacatatatttatgttaaactgtttgtttgtttgtttatttatttatttatttattgagacagagtcttgctctgttgcccaggctggagtgcagtggtgggatctcagctcactgaaacttcctctgcctcctgggttcaagtgattctcctgcctcagactcccgagtaggtgggatttcaggtgtgcaccatcaggcgtggctaatttttgtatttttcgtatagatggggtttcaccacattggccaggctagtctcgaactcctaacctcaggtgatccacccacctcaacctcccaaaatgctaggattatagatgtgagccactgtgcctggccccaagtagtatattttaaaaatatgaggtcattttaaaagatgaggttagatgttatatattatttctaaaattttattaaaattgtttttacacatttttatgtatctttaaatattttttgtgcaacaccattttgctagctatatgatctgctgcatggatgaccacaatttatttcatccatcctttattttgggacatttggattattttcaggttttcactattgtaaacaatgctgtgaggaacccgcttatggctcagtctttgtgcccatcattgattatttcaagaggacaaattcctagtggaatcactaaatcaaaggattaataactggttccttttacttggtagtgttttgtcaactctggagtctctcctctgctctccatccctgtccctcactgcttccacttcatacagaatatatttgttttgcccttttccatttttctctttttttgtctcctttggtaatggtctccccctgtatatggactatctgtagaccattagaaattgagggactctcaagagagaatgcaacaaactgatactatttcaagatgacagttgaccatagcttacatgcagtgttcacatgagttaagtcattgggttccctgccagattttaagtgaactaaaatgttttctaaaattttggtttgagattttctggcatctgcctctttcagagtgagaattaacataccatctcagttgttataattccatcccatctttgagccataaactatttgataactaacttcaactcactcttcgtgactcactcgcctcagaaagatttgattttctggaaaattacaatgaagcagagatgtaaaaagataagtaaagataactcaattgattccggaaatgaggtagactaccgcaataattttttgaaatagtattaccaaattttctcctttacaacgtttttaaacatctcatatgtatcaattatatgctaatgaactacttgtttcctaatatctttaacaagataaattactaagtgtagccaacatatattcttactaaccccagaaaatgtctgttctgtgagttaataaatgttaactgttgtatattacatactcttttccatatttgttttacagtggagagggtcttcaaaaaacgatctagtacatctcttcattttgctatagggccattactatcaatgtttaagacttctgtaagtaaatattacaacctgtcttgcaaccaatcctgtaatatctaacaattctcttttgagaaattatttactaactccagcctaaagttatcatgctgctactgtaagactgtacctcttcagtcattaacagtgttgaaatttgcttttggaaatgtaagtcctccatatggttgatgtcatttcctcattgtaattagagtacatcgagaaggcatataatcactcactgagtgatgaaacatggattgggagagatgactcaataaacattttaaggaatgtttgtaaagtgtgattttcaaatctgtgttgaacttaaattcccaacttgttctctgcacaactgttttttactgacttgcaccttggtacaatgccattggtctccattgaagtctttatggaaaacagcacagtgaaactctttactgtgtttaccataaggaggcccctgttgttgttgtttaaaaacaacaacaaaaaatcccatccgatcttcacgccatgaatattgtacttcttctgaacaactggtttgttaaacacagacctcaccaggttttcttgctagaaaattcaagccaatattgtgatttacccataagaagtatttggtatacccaacccaccatgctactcacttggggtggtgcgttcatagtgtgctcattgtcagtcgtaccccagaactgtgcacacaggagcccttgaccctctggtatatacttctaaaacctcattcttgattcctccttctttttcctctcattctttctttatccatctttttccctccttctatttttaacttttgtaatactgttttattctgtgtgtctttgtaagctgctcaaagtccttgtggaataaggtgtagcataagttaataactaagtcaaaaatgcagacctttatttgctcagactgttaagttatctatacatccatgcatggtgcccaatgttgatccttactcctgttgtttcagctcaaatatattggtgtttgataagctggtacttctgtaacacagaatatggcatgtaagctcatatttgaaatgagagtccaatatagctataaacatatggcttacactgtgaaatgttctttttttcctttcccagggagttttgaagaaatatacaagaacatatgtccagtcctaggaatccctgccagattttttttctctaaattgtggtttgagatttcaaatcattaactggatacatctgtctgagtatgttttccttttcaaaaaaagaaaatttgaaaatagctacccaaaagacatagttcagtattcttaattttccataacatagttagtatcctcaacctttaaaattaaactgacattctctgagctgtgtgcagtcattttgttggtggccatgtatttcctgggtattgggtgaaaataaggaatttattttcctgtatgttgtttaagcatatatttgtgtgtaattcttagtaaacttgtaggtttaaggaaagagccttcaaattagagtcaaaggattcatttttaaatcttgctgctgtcactaactgtgtgactttaagcaaatcatataacctaacagagcctcagtttctttatatataaaatgaataataataataatgcctgccctttctatttcacagggttactgtgaaactcacatgagataacatgtattaaagtgctttgaaactaatagcagagctattagaactgcattgcctcagtctgggataaaaggagatcacaataactaatagcaaaatcaccatttatttggcttaaatactatctactctgctagaattttaactccctcaaattcacaactagttctgggagtcagccggggatgttgaacatatgcttgggaatggatcctgttggattcctcatggatgctcatgtgccttctctgtggctcactgctgtcgtctcctctgctgctcttgcagccagtgcttagtgactccacggtcataggacctgacgcctctaatgtcctcaccaaaaggaaatacagtcatccccatgcagccactcttaacaactgtcagctgtgaagttctcacctacatcttctctcatggtatctcaacatggggagcataactttctcatttttgggggctcattaggacactaagtgaggaggagcatcaggggatggctgagactgaggtgttctctaaaactgtattcgaacgtttctgtcccagagtttatacacattatttaaggttatagtagagactgcaagctgaatggtccaatgacgatgtgacctttaagaagcctctggcttccttcgtgaattctaaccgtaccgttactgtgtttgaggatcactggcagccgagctctgagtggggaactgagataagaaaggtgttgtcatgataacacctggacagctgcatcccacagactatgggagtgccaggaaactggctacctcacagcagagtagagaaaatggaaataaacacaaatataagcttttcagtgagctgtgggtcagagaaggccacaagtggtctggcagatcatggtgcagctctttgtttcatgagctacgtgcagcagtagtttttatgagctctttttgtagctttccagccctaggattcagccatggtaaggtggaaagtttctggtactagccctgctgttctgctaacaatggtccactttcctccaaacccattgattatttagacatgaaataaatctatgcatctcaactctctgcctcagaaaatgaaatctgtcccaggaaaagttcagatgcagtaacctgctaggaactagggatgcttgtcttaaaaccctacacacatggcaaacactgttttatttagattgagctgattgggaggggtggacctgatagggatatgggcatgatgagctaaagccaccaactggcgctaccttcaaaaatgggtcctaccttccaactatggcaccatacagtacactccaaagcaaggattgtagttaacagccatactttcttaattatctagtttcatcctgaaaggcagacccatccattaattccatgagcattgattttgactttcagccttaaatagagcaacaagtaaacattttttattccccttttcattaatatttaattcattaatgaggacagtgggtaatgttctgtgatatagtactcgtgtgacaaaggagtagtcccaggaaaatttttggaatcaaatcaacaagtatgtattgagttttgacataatacatgaaaatgctgttttggctaagagcagaacttctgatgattagttttgctgacattttaatcttggagatgataaggtagaattataggcttaattttgaccttcacagggattgattgataataacattggaaaaaggtaactaggttatcttagagtctctattagccaaggaaaagaagagaaagtcttcaaggaattgaggcattgtttgagaaaatgattaaataaaaaactataaccacagttttattttgtctagttaaaataaagaatatatagtattatcaagaaaagaatagtctacatgggggttagaataagggaacctaagaaaagatgtgattattgtaccactagctatccatcagagagggagcttgagtcagtcagtataaatttagtctgttcagcacaccctattgtggaggaggaagcagggagcttcaaaactgtaaggcatcagccattaaaacagattctgtgtttgccaagcaaccttctcattgtgaccagagtttgcaggcagagtttccagtgatgactaggttgcatgaaaattttttttttctcatttcaaacagtattttatgtatcagcttcttgtttggtgagcatgtgtaattctcttaagtttaattaattttgcatatttataacaatttttaggaccttccaagtagtaccatctctgtctctagcttaccttcctgtaacttcaacaatgaccatagaggaagatctccaataatctcaaatttaaagagacgatagatagattgattgatagattgattgattaaaacttagtgaaaagctctcagtttaactcttagttcattaatatataataaactaaaatttacaaaaatatcaagtgtagcgtttagacatggattatttgcccataaacaaatctgtttaactagtttaaccttaaacaaaaaaatgtggagcggggtggtgcgagctactagttgaaaggatatatgagtatctcatagaacccaaggtcaggaagtacacatggtggctgtgggagactcggaagtacaaactgaaaagttgagaactaaagtcacatgctctgtctttctcagagttcatgaattctcatctctacttctttctctctgcttctgcatgaaaatagctgtccagtccttgcctgacaatgcaagagcctagtagaaaccaacaagagttccagaagctcagagtttgcagagaaggactctgattggcacttctcaaacaggtgtgcactctgagtccattttgatggcctagggatgacgtcacatggttgctttttcttgggaactgctgtttaaggagattcttagagaaggggacctcagtagggccaagtgatggaacagctttcagaaaaacaggagacattctagatatgtattccaagtgttgtctgcaacgattaaaaaattgctttaaattctgttcagagtaaaataatgaaaaagcaaagagtaggcagattattagggcaaattatatgattttaacgtatgagaagaaagacagatgtgcaatacttttttgtttccttcttagttatctgcaggagtgatttccatattgaaagtattataactgacatcttaagagtgcactagatttgttaaagcctttaaagcctcttacagcaccagctattgaggaacttgccagatgagtttgagaggaagtactgtcagtaatcctcaggtactggagagaagaggagaaattttaggaaactggaggtgggaaaatactaccttatatttttcaaaggggagagagaaaacttgttcttggaaacttgtcactgatacacagtatttaagggagatcatttaaacatatttaaaaagtagccatcactaggtaccagcatggggctatgaaaaagagtcagaccaaagtcacagctacacctaaaagaagacatgtgtttaccttagtagaccaggagactgtgtgatagatacctcctgcagtgtgagttagcaagatatttgagtaaagtgttcagatccccgtggagaagagaaataaatatagtttgaatgatagtgcaattaggtgaaattgataaatggagtgatatcaacctctcagggaaaacacatagctttaaaacagtatttgacctcatattcctccatataaacagtagataaagtggaatcatattagtccaattttcaacatagaaaactgggagggatggttatacacaacaaatgacaaaaaccaaagagggcagaacctgctggaacatgcacctaaaccaacaatataaaatgcaataaatgtaaacatggtattttatactaagttcaactgctgaaatataaaatgggaaacattggacttaacagtaatttggggagaaaaattttagggaattgtgagatagcaatatgatatagttgcaaaaatacagtgccaatataattttagattatacttttaaaggaattatatccagactaagagttgtagcgttgatctcatatattgtccagtccacatctgaattattgtagcagtcctttttgggaaagatgttgacaaaatggggcatttccagagagggataatgaggaattttaatctataaatttctttcgaagcttagattttttattttgctatgtgtaatgcactgtatggaataaaatctaccatactgtgttcccaaggagcatactttgtgtcattccaaccagtgtccatagaaactgaacacttgggtaaaattcactcccctcagtctattgattctgataactgggtttaacagtgacgtattaggccattcttgcattgctgtaaaggaataacagagaccgggtaatttatgaagaaaagaggtttaattggctcatggttctgcaggctgtacaagcatggcactgacatatgcctggctttgggggaggcctcaggaagcttacaatcatggcagaaggcaaagggggagcaggtctcacatggtgagactgagagcaagagagagtggagggtaagctacacatttttaaacaaccaaatctcaccagaactcactgttgtgaggagagcaccaagaggatggttctaaacatgagaaatccgcccccacgatcaaatcacctcccaccaggccccacctccaacactggggactacattttaacatgagatttgtggggggcaaacatccaaactatatcaagtgataaactgtcttttcactgaaaatgtatattgatttctgaatgctaaattaaactttgtattctacattagtaacatattcaagtgtcagcactgtttcttataaattgtaagcatttttccacttccttttatgatgaaaatgagcaaaagaggttttagatgaaagcaggaaaggtcctcaatttattataaaataaaaatggaggccgggcatggtggctcacgactgtaatcccagcactttgggaggctgaggcagatggatcacctgaggtcaggagttcgagaccagcctgaccaacatagccaaaccttgtctctactaaaaatacaaaaaagttagccaggtgtggtggcgcgtacctgtagtcccagctcttcggggggctgaggcacaagaatcacttgaacccgggtggcagaggttgcagtgaggcaagaccatgccactgcactccagctgggtgatagagcgagactctgtctcaataaaaaggaaaaaaaaaaggatagttaaaaaaaatcagtgtttctcaaattgaggatttgtttcctatgcctaaagaatcttcctggttatatttacttcagaattaaggggagagaatcaaaaatgactctttgtcttgagactcctagtgaatggtctaaaagtaagaaacaacctttaagaggagcgagagatgagtaacttccacacaccaaatacacaaaagcatgcacacacacattattgtagattaatgatagtgtatattgagtgcagggactcgcagcctcaaaatgttacgtttttcatagtctgctgaattagatattatttattgatgaagtctaaatataacaaggttttatattaaactacagatgttaaaaacatagctgatacagagaaaatgcaagtgagacatttcatttttatttttgaaatctattttttaagttattggaaaatcactatggaaattcattattctcatattttctgctaatgccaagcacctgacccagatagctaccctgaaaatattctgtaaaattactctaagaataactctaatcattgcaagcctgtaatctgaatgtgagtatatgtgatcagagcagttctacaatgtagctgaaccagtactgtccttggtgttagaggattttaaagctttcttgggaaatgagataccaaagaggagaaattagtcaaaaatatatatcagggcccatccatttaaatgttgtccttcttattagaacttattacaaattctacaccagtaaagtgagaggaatgatgcagaatagggggttttacctcaatacaatgggcatttctttcttactaaatcttaatagcaaggctttgtgtattataaatactacttctgtgtgctctacccagtggcttcatctcacagtgacaaaccagaaaagagctaaactttaagatcctgccttcaggttgacggtggcaaatgaaagcttgtaattgaaggtagctcaatttgtgttgggctgaagctttcatttgggataagtgtccaatccagtcggcccaaaattcagactccctctctgggctgtttctgtgctccagagggtctcttttcctctcttccttttctctctagcatcctggtgacaggaggattgtgcacccttgaggaacatgttttagatggttctggcctgcttacctctgtctctgctgcctcctcctggttctgggtaggtgtgcctgtcttcccgggtatactggcaccctttcatctgctgctgaaggaacccctgctgcagtaacttctattcagttctcttgctgcctttgggaccaacggtcctttcctcaccagacccactatggggacttatctccattttggccctcactggtactgtggatcctctgaagcccgcttgtctacaagagcctgtcgtgtcttaagccttccatcccatagagttgccacatgtcatcctattccttattactgtgacccctggcaggccactggctctcaactcttagctaccatccatgttccccactggaagcatgtggaaacgtctgggctccctggctgcaccctacagccaagggagactgcacagcagatgtggaaagggaagttgtctctaggtctcctgcccaagtacacttcagcatggtttctctttcacatggcaaccaccttctattggatagtctcctccaaagctgggaaatggaggctgcgcacaaatccgttccttcatctgcttttgttaccttctatccccttgttccctccagatttcctacctctccctagtagaagagcttctacttcccttttctgtggaagaggaacatgtcctcctccacagaatgtggagccatgtggacttaacttgttctgttgcagttttgccagtgcaccttaaagtagcggtttctcgttgtctgaacaagtacccggggttctttgtcctgcatccaaaaaaattaaggagcatggacacaagggtgggggtggagtgaaagtttaataagcgaaagaaagcacttcgcagcggagaggggagtccgagtggattgccgagttacagctgactccagaagcttttataagaaactcttctcatctctgtagcagtttgagtaacttctcctatcagtaaagctgtctgtgcaactccccttatcttatgcagctgtgggtatgtctctaggcaagcacaaagcgccacttctcttttctgtataactgtgggtttgttttaggtaagcccccgtcttccctgtgcaagtttctgtggagcccaccatgtatatgcctcaaaaggggaggaaactttttcctgggagcttgctaattatacgaagaacaaacggcttcttttctggacgctgtctgcttctctgtgtgcaggtgcagcctgagtttttgtcccagattgttttgtttttgcccattgctgtgacttttcaggcagaccgcttctacactgtaagtttgccccaactgattttttcttttccctcaccctcattccccacttcagaagtgggaactctaactgctgttagggagattgggcattgatctttctggctatttcttgctggagaggagcattgtgtgaggaacagcagctaggattcctcccgaggctggtttaagggtcctcagaaaaaaggtgcgtttaatgtgtggttccatttactttaccatttggagcttgatggcctctagatgaaaaaaacaatttgggttattagacaacatgtattaaaatgagacaaggaaggaggtaaggatagcttaaaaatcatgaggctgctgacatgccctgataactggtggctatagttaacgtctgttaagattgggtgtatggggcttggctttggttagcttccttggtttgaccttccccaaaaaggaaacctccaggttatgggggcactttatttactcttattacctggcagaatttgtaggataattgcccagaactagaatattgttccagattttgacattacccatccctttctgtctctctgagctgcagccagagatggctggttggtttacaggaataagcagggttagtctaaaatgtaggcaagaacttaaaaatcactaatgagactagaaattaatgaccactgtatgataagttttgaaacataatttccctctctccagtcctcctttttgttaaaaacaaatcatgataggactgagttgtttgcaaaatagactttagttttaaacttggtctgattatttacataagtgcagcaagaatccttatttttacataggccttttagattggctttgatggaactttgttccacaaggaatcttagataggactttctaaagccgatctagacgtggtcatgcctctaatcccagcactttgggagcccaagacaggcagatcacctgaggtcaggagttcaagaccagccagaccaacatggcaaaaccccatctctatggaaaatacaagaattagctgggcgtggtggcaggcacccataatcccggctacttgggaggctgaagcaggagaatcccttgagcctgggaggtggaggttgtgagccaagatcatgccactgcactcggcctgggcgacagagcgaaactctgtctgaaaaaaaaaaaaaaaaaagaaagtgacattctttactcaccacaggttaggaaccctgtacaggggctgtgtagacaaggtatgaggccggttttccaggaggcttttactggctctgcaagtcgaacttgactctttaaagggaaacacaccctttcagtcaaagccttggtaaaacaacgagtttttccaattgtgttttgttgcaaaataaagtagattcttattgcgctgatgcaaacaactatattgttataagtcaagaatacttacaaccagtttctgaattctagagaaaccaggcagagagaaacaaacatgttccaaattttgttcacaggagtataccttacttagttgttaaaagctctagctaatttgaaagaaagtttccttgactctgaaaaacaaaacaagaattagcagtgttcaaagcaaaaatcaaaaagattcgtttagttttctattaggttagtccattccattaactcttgttctgcttaatatttgtaaacatttcagcttttcatgagtcctttacatttttctattatcagaaacctgcattcaagagtacctattaaagttccacagtgattataaaccattttttgaagaagattaaaataagacaacaattgtctgtaaatgacaaaatgtccagggtggttacagtcaagaacatgattgacaaatttggttatttctgtggcatacaataacccaacataacaaccttaattgtgattgatagcaaatattcagacattagaaccttagacatcccatacaattttggacatatgttaatatttttccctaaaacataacctgaagaatattagacctcattttggcaatcccatgtacctaaacatgttaaataatcctgtttacctctcttcagcatgctccagggaccctttgtagcacccaaaagcaaggggccaggaaagacaaccttgagactgaagtttaattttgggaagcctgtgaaatatgttagaggcttaaaacactggatattatgaaataaaattttaccataagtcatttgttttgccaaaacaatgactcaaaaatttgaaaaaaaaaacaacaacaaaaaaaaccttttcattagcccttattactacatgaatagagagccaaatttacccttgcattagtctactattaatgttaaccccagtttttaatgaagccttatagacaatcctattcaatcttaaccagtttgaccatgaggtgagatttttacatacatttttttgtatggttattttataaccctttacaagttttgctgaagagtaggtcagcatcgtaagaaaaccttgttgtgcttttatttcaaagtttaatttacagaaaaaaatatataatacccttttgaatttagtcaatatgttcacacacatagtttcctttgcaagattaatatttacagtcttttcacaatttgcttaaaccttctgctttattttatctaatttaagacaatcctttatctctaggcaaaatggacatttccatgccttcttataatcttttaactaaaaacacattttgctgtttttacacaccttgcatgcaaatccatgttcagtagtctcaattacatgtcataatggtaactcttagcgatttttaactttaatgtaaagcctggtaagttgttttaattatgtgctagatgcagataaagtctgattcctttcagcgtagttaggagcatggtcacttctatttgttcccagaccatactaattgtgaagcaggcaagttgacagtttttaaaaggccaaagaagcagtttgcaaccttaaaacatttagcaaagctagtatctgacctgcataataaattagaccacatttttacaccttgaagacgtttgtattttaccaataattcttgtctgtttttattttaaatattaaagtcatatgaactgaaaggtaccacagcttttacttttactgcaaaatattttatttcagtgcttattattcttaggccaattaattggcctttttatagacttcacatatatatcacatgtatgactacacagacagacagaagaagatccagcagctcagggtggagcccttttacgaacaggggtatgaatatagttttcagggcttaataaacaagcacagccagaagacaaagacagatgttgagaggggcttatccacctctaattccaggggttccatgaggaaaacagggatttctccaaaatgggatttgtggcaccttaatctatttcccagggagtcccaggccaccagaagtcattctagggtctttcacgtatgcatcaagaatgataagacacagtggaaaaaagtaattcagttgactgaaaaaaaacaacaacaacaaaaaaccttttccagaaaaacaagatctatgaagagaaaaacataaaggccttttacatatacccatagctcggatatccactttgaggtaagctgagcattctttaagaaaatcctttctcattaattaaaattttacagagaatgtaaacagtgatcttcatcattccttttactggtttgcaccactaccttttcacaatcatgttcaagttctccagtttcctttgggagaaaatggctcggctctagcaagggcaggttttcctctggaccacagatccctccagtagcaaagcttgatagttaaggaggcgattgtctgttagccagggactttccttagagggcagcactcctgctatattgtatgggttgtaaacagttgtttcccatgggtaacccagtggcctctggcaccaacaaagctgccattgtaactgcttagaggcaggctaaccagcctttagccaccaagttaagttcctcacttaggtaacccactggctgttgagctggacctcaagcttcagccagaattcccagggccatttccttcttttctgaagcatagagactgaatgcttttcctttgggaagactgggggttgatgctttaagtaaggcttgctttagttggttaaaggcaggttcccaagttagtgagtgagttttaactgcttgagtttcgttatgaggtggtataaagggcaagctatttcacggtatccaggtacacacagtctgcaaaatccactaatgcctaagaatcccctcaactgttaaaggaaatgggcatcctttcttcacctgatgctctagtcccttctgataagactagacctaggtactttactgaagtctgacagagccaagctttagattttcagaccctatatcccctttcagctaagaaactgaagagagcctcagtgcctccctgagacttccttggttgggggacagaggagagtgttatttatgtactgcaaagtttcaactcgagggtgagaaaaattagatctttggacagggcctgtttcagcaactttcttcccatattaagggctgtctgagtaataaacctgttctttattgaataaaaaggtttaaagatttttatttagcttttggactatcatggaaagcttggaagagttaataggtttggctctaatcccctgcaagttctccaatatacacatttgaaagagtttccttccccattttctgatgctatcatcatggtcccatttatggtcctccaagggcactggtattttccccacttgcttctccatccctggaacatccaggagagtttaaatacttgggttaaatcttggaaggcctctatacggcagtgaagttggggcttgccccgagtgaactttagggtctgaggactaaaggagatccaggctgcactcaggggtagtgcagacttgaagatggggtgttatccatgtagaaaagaggcaagagaagaggcatccctcagtctccttctcttcagagtgacccaagatggagggaaaggctggaggggcatcccccttcacccccttcctcccgtcctttgggtcccagtgaccatccttcataggtgccgccccatgtttgcaagtatgaccttcatttatggtcctggagaagctagtcagcataactagtcatgctcatctgcttatggccttggcccttcacccttgctggtttcctagacctactttgcccataaggttcccagggtaccctaagggtccaggagagattgtatttgggcaagacaccttaatggaatggaggaagtcttttaatattatctctggcttcccttgctatggccctagtgaaacattgaaatcccagagaatgggaccaattgacttccaaatataaaatcccctttttgtttaaatgccaatgtagttggatgtagaacaggtgcctcagaaaagaacatatgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcctggtagcgggcgcctgtagtcccagctactcgggaggctgaggcaggagaatggcgtgaacccgggaggcggagcttgcagtgagccgagatcgcgccactgcactccagcctgggcgacagagcgagactccatctcaaaaaaaaaaaaaaaaaaaaaaagaaaagaacatatgaattgaatggctgtcctcttgactgttaaagatggagctttgatatttacagatgggtcatggagcctggtccctaatagagggacataggagggaggggaattgaggaactagaggttttcgacaaacagccagcaagactccccatggagaaaaaaatcccatcccactaggtggcgctgtaggatctgagatgttaggtaaaaactctgactccatctatccaggcagaagttagagaggtttggggtttaataggctgtccccagcggaataaaattaacttgtctcataaagaaactgtttaaattcattgggcagtgctgagctttcacgtggagggaagaaataacccaaaaggagaaggaaacaatccaaatggagagggaagaggatattcacttggggtgaaatatccccttatatagtgccatcagtgtctatcattgaggacaaaaagcccttactaggtgaaaatttaaactgatcttgaatttaccctgtctccaggaaatcacaaacacaacaactctttgtcttagtaatcaggaatgtaactcaaagagttgttgtgtttgtcagttggtgtcttagtaatcaggactgactctacccagcaagactctgtctctaggatgcaaaaacacctgtaacattgcatagaaagaagggataagaggcatgatagccctgaaaagaaagaaggaaaatgcagtaggaaaagactggaggtccttgtgccagcaccctgacggctgtcggggactggagataatactgaggggtagccccagccagaaaccttcagttgccctaggacctccttccaatcccatgcaatgtctgggccctttgtgaaaggaaactggattggaatagacaagaaacctcagaaatgaaagtaaaagggtagaggtccgctcttactcacccttctgatgatcccttcttcctgcacctaaatatgttgtagttttgccaatgcaccataatgtagcagtttcttgttctctgaactagtacctggcttctttgtcctgcgtccaagaaaattgagcatggacacaagggtgggggtggagcaaaagtttaataagagagagaagaaatgctccacagcagagaggggagtccgagtggattgccgagttacagctaaatccaaaagcttttgtaagaaactcttctcatctctgtagcagtttgagcaacttctcttatcagtaaagctgtctgtgcaattccccttatcttatgcagctgtgggtatgcctctaggcacgcacaaagtgctgcttctcttgtttaactgtgggtttgttttaggtaagcccccatcctctctgtgccagtttccatggagcccaccatgtatatgcctgaaaaggggaggaaactttttcctgagagctcactaattatggaaagaacaaagggcttctgtactggaccatgtctgcttatctgtgtgtaggtgtagcctgagttttttttttccccaggttgttttaattttacctgttgctgtgacttttcaggcagaccatttctgcagtctgagtttgccccaactgatttttcctttccttctgcctcagttctagagggtatctcaaagtagaaagattgtggggtgaagaatagacattactgagaacaaaatataagaggcatttcaaaaatattatccccaaagcaattcaggaaagaactatggagccgctgttatgtgttatatgctgggaatatggtagtgagcaaaatagctgaggctcctgtctttaatgagcttacagtcttgaaaattttgtagggaagatttctatgcaagggcatagaggtatatacaaaaggatgattattgaaacattattatgaaatcaacagaaatgcccatcaataaggaagtaattcagtagactatggaacagccatactatggaacagccatactatggaatattcaataatgtattgaaacattattataatgttttcattcttattaaaagaattatgtaagtcttatacatgctcacatgggagaaaagtctatacgtactcatctgaacatgtattctatatacataccagacatgtctacatgagtagacaaaatattaaaaactatatacagccaactattaacaatgatttcctctaggagatgagatttgacatctattaggggatatctctcctcctcagaaaagggaagtagaagctcttttagggagaggtggaaaatctggagggaacaagaggattgaatgtgacaaaacctgctgaagagaggcagggagggaactttcacctttatgtcgtaaacttctatgttgtttgaattttgtacaacaaactatgcattactttgtaattcttaagacaaagaatataagtaagaaaaacacataccaatagagttattctggcacacaacctggtttacattttttgaattattatttctaaactatacattggtgaaaggagatggaaacattatacaacacacaacacaaaattatgctctattccagctctgttgtcccctgtcctctgtaagaacgcaaggcctgcagatgttccccaaatggaggtccctaggacagcaaaggtgcccctcaccaccttctgtcaccttcaccccacccttttcctccctccttcagccccttgatgtttctaattccgtcctgtctcccattcaaagtttctatcttgcccttttccccaagttgctatcttctgccttagaagcaagtcccaaatttcctttcatgttttacgtattttcaccaattctggtgtccgttgtaaatcaaaattgctgtctttctcacccagttctgctgttttaagcccagtagttagggtcagaagaagaaaaatgttgcctgagtccccatctgggttatagtttgtttggggggattattatcctcacccatctaaaattaggcataccttgctctgcctgcttcagtttctctccagaaacattacatcttcctacaagatctgcttttccctactactgtgtttttgaacttatcctgaaagagtgtttggtccctcccaactttgggttacactgcaaagtactctttcagaatcaaaatgagtctttaccagtccctgtttggggtttcttctatttaggaagaggcttctggaaactgtactcctgctacagttgtttcaaatagttgtgtagaacaactaagctctttagctaatttaaaagctctaaacaatattatcactttgttcattccacagtaaatttctgaatgcttgctatatgcctcaggtcaacctgtttaatatctttctgaatattttagtaaaacatagcaatatagtgtgtttagctttcaaacgcagtaatataatggtttatttagcaagtgaaataaatctcttgtgccaaaagctcatttcaaaaaggaaaataactaaggtccaggtcatgaaaaaaaaaaaaaaaagccaaccacctgatagctgtaaatactatcttaagtgtcctcagcataaattcacaaattaagtctttttattacagaataagtattggttatgcagtagctttacctaggagtaactttatctcataacagcttctctcttttatcttgcatttctgttaaattttgaaggctatatttcattcacttaccgtagttaagtcgatagtatgtaatccaatcagcaaatatagtcagcttggagccaagcagtatagattacctgtaaataaatatgatgaaattttctctttacagatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaaggtaatggctgtgaaactcacattttgtctataaaataagttaagcatgaataattgcaaaaaggtgatttcaaaataattagctttaaaaaattaatagcatctattgatagcatctgttatcaacaagttgacactgtgccaagcattgtatgtgagttattttgtttaatactaacagtaatcctttcagtggatatcattatgtccattttacacgctcagagatgtacaagtagtacacaaaaatttggttgtacacaaaaattcagtaaagtataccactgattataatgttagaagcgaagataaacataggtagcatgaaaatatcgttcaaaatggctttataaaaaagcttcctccaaaatttaattgagaattcttgcagtctggataaacctttgctggttttgcaaggacatgattagaatcttgaaactgtacacatatgttagcacgaataaatagaaatatggcctatttttcctttcatctctgtgcagctgatccttttattaactaatcatttttaagtatcctagagaatgtatagctttaaaatttttagccatatcaaatgcctttagagtagaggctttaagatactttaaaacttttcttcagttctcatgttaatgtcaaatctaaaagcttttaggcacaacattttatgtatgtccattttgtttatgtccatctttgttgtgaatttctataacaataatgttttcattaaaatactatttctatctcaagacaaatgatactgttggtacaataataattgagatgaacaaaaatctaaatgtataaaataacttttcaaaatcgcccaattttactaattttaagaacctctatattattaataccagtaaaagtttatcatatcctaaaaaaagtgaagatacaccaaaaggtatttagcatcctaaaataactgctttgccaaagaaaagaacacaattttggacctcagagtattctgtatttttttactgttgtcttttttttttatctttacttcttttacaaatctctaatgaagacaatcatgcaggtcccttgagtttagagtaggcagagaagtttgggctacccttgaatgaaagtacagctttaattagttttttcaatttcaaaacaacctgaaaatctcagtcctatccttagtaaaattatatactgtttggttaatcagacttgagtgataatttggtgtgtactttccctaatatattcagaaagtaaaactttaaagatttttcttttaaagactaaatgcatataaaaggagctaactcgtaatagcacttgggtttctgggcatcacagtatcctctataaaggtttggagcttttaactggaacaaattcctcacatacgtgtgcatcagctaactgcgactgagttgggccgaagtaaaagcaaacccacactctcagtggctcgcacaacaaagggttagcttttgctcaaactacacggtccttgtgggtcagcctagctctgcaccccatcctcaccacaggacccaggcgtgcagagcagcctcagctcagacactgcctgcagaggggcagtgggaaagaagacacacacaaccagcctcttaatgcttctatgcgtgtgactgatgtcatttccacccacatcttgttgaccaaggcaagtcacacatgtcctagcctgcagtcagtgggttagggaggataattttcatccgaggaagggcagtgaatattttgagcccttaacacagtgtaccacagtgtgaaatacaaggaagccagaaggtattggatgcaccatttccccctttggtccatggtaaccaagaatcaaaacttgaaacataggccatcaattcatttctgtccataaaaacttaagatgtgtttaacttgtatatgcaaaaaatcctcctaatggaattcaaaaaggctttaaaaaaataatttaggactgcactggactttaaaaaagaggataaaggctttttttttttttaagttgaagggaaaattactcaggttttctgaggggaaaaaacatgattaagcacgagaattttatttataatacttattaaaactgggtaccaaaatagaaagttttttttctcaattccagatacccacgtgtatcttactaataataaatgccctaaaatgagtaaaatattaagtatacagtctgatttgcccatttagccactaactcatctctaaatacagcaattttcctgtgattgcatattcatgggccaaatttttaaacaattttaaaacaattgaggacaatgcttgtgtcctcaagaagcatcttttaaatgatctgcagctcattctgaccgtggtgagctaatttcatgggctcatagtgatacaaacaaaagctgttctcttgtaatgggaagccaaagatggaaattttgccaaatgtgtctggtttttataacacaaaacttcctctactaaattacaaacacatatatacatatatgtatgtataattagaattatatttataatgtataattatacacttgatgcttaagataaagagaaaatgagatttttttcttatttgccaacttggtgggaaccatattcatcataccaaggttacagctttcaacactgattgtggttggggaaagatgtcccagaaaaaaatgttaaataacctataccctgtgtggattccagtgcaattgtatagtattgttagtaggcagtgcatcttcagaaaccctaaccattgcttctgtcaacagcaaacaaaatgttgttcctgaaagcgttcagatttgacattaacatgtgaacaggaacaaaaattttaatatgtcttaaaaccttaactgtcaattcgaataatcattgtttagaagggtgtttgataattctcagactaaccagttctctgtaggcatagtaaactcaaaattaacttaaataatatacttcgccttccttcttgataaaacgtgcaatctggtccatgtaaaattactgtctacccaatgcacctgtattcttgtttcctgagaaaaataataactaattggtttctattcgtctaatttataatatcgattgatttttcttaacagaacacttaaaagaaaaactggatgaatatattaagctgtggaatggcctagtgaaggtatttcgaaatgaaagaagggaaggtttaattcaagcacgaagtattggtgctcagaaggctaaacttggacaggtaggaagcatttgatatctacaatgtcaacattttgggtttggtaactaaatcatacacatttttaatcattcttcagtttttttaattgaaatgagaatgctggcttaaacagataacttatgtgtcagaattgactataatgctaatttttattagcatctaattttaaattgtgtgtaatatatgatgtaacgtatatgaggagtattctttcacctgcctcttttttttaaggttttgatataccttgatgcccactgtgaggtggcagttaactggtatgcaccacttgtagctcccatatctaaggacaggtaacattaccttgctttttttctttcctggttgaaagtaaaccttgtcctagaagggcaaataatattttcatcctttgattccagctccattcagtgcatcgagtgtgctttagtgttatccctcatctatttgtttccttgggtggagctagactgatactgtggactgatttaaatgtaggcagtctggcatttgggagaaacctagggttcctcactcaagaatcattttgtggttgggttattaagacccctctatctccaggcactttctctaagagttatatgaattgctccctctaaactggggtgagagttctaaacacttgaggaaccatgctttgatattatacctgttgatttttgtgccttttaaattagtactttcaatagtaaagaccaggtgttacttgtgtcaaggttttgggttcctatagaaactttaaagtttagaaatagacaactattccatggaattgtgacaatcaccattaaatttccagaaatgtctaaaacaacataaggcaccatcagttttctatctccaaaagccttccttgcttctagtccataattaggaaaataaaacacgtccatgtggcaaatggcaaatggcatgaatcaaaggcagaactttggaggatttaatcatgagaggatttaatgtgaaggccgaacatgaacatttttcacatgctgtctgatttaatcctcacagcaaccctgcaagatagagattattagccccatttgactgaagaggatactgaggcttagagaaattaagtaattttccccaaatcagagagctaataaactgtcagaccaaggcctccctgggaaagtttacactgcaccatgtatttaggaatgtgaaaatcataagtgaggacagttaactgaccaagtgtcaggtaactttctctaggtgaataccagcaggcttctgggcagtgaggaagtggttttccagattccagtggcagattccacaaatctgacaatgaccctccagttcacactctggagagaaggaagcatctttctggactttacttcctccatattaaagttctaagcactgtaggttttcccttttccttggtttttaaacttctgaaaagcagcttgacctggatataaaaagctgtcattttcattttaggaaaatagattttaaaatcctttctgacgagatgaacattgtaacaagcagggtaccagataatctttgtaatgtcactttgacatctaattggttatagagtactagcattttcgtgaagcccaaatataagagattttttgatccaaattctcagaccacttctgaagttcttcagcaagttttgagggattttttttgctttttttttttaaagcaacaataccttttttttttgtttgttttgcaataaaagctgttttctgcagttagaggagtgaggaagatcaagtaaaagtacagaaacacattttcataactgttcccaagaaatagcaacaaagggttgagagaaccgctaagaatgtggcaagtactatctgtgaccccacacacacgcacacgcatgcacacgcacacgtgagctttttcatgggtgatagggaaaataacaggcaagaaaatcttataaataaggtaaaattaccaaaagaaagttgcctttaggaccaaagcgaaaaggagaaaactctattaagctcagtgatatagttctttgtccctgacatttgtctgtaagcctagggggaagtctcctctctcctgcccttacgtaaacaggcttttcggcttttatgggacattcatttactctatttcccattagatattaaagtcccctagtgcacaaacaaatcaacaacaaaaagagataacgtagttaggcatgctgaactagtcttgggttcttaaatgctttttcattttctgtaaatgtttcagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtaaagactattactttattttcttatgttgaatgtttatctaagttcttttttttttcttccccatgaactcgtataaatgtgtgggtccatacatacgcttccatttgatctttgctgccatcaacacaatacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtaatcactaaatcacttacatatttttcttttctccagttgctgctaacctattaacctcttgccaagctaaagattcgttattaaaactgtagatgttgtctcagattctgaaagaacatctttccttacactgtttcagagctttcaatctgctccatttgctccattgtaattgcttttaccctaaatgtgatgtccactactgagacgtacacactttcattggggaaagaaaaataatgtaacatggcatttgttccacgtacaagtgaaaaaaagataaaatcttagttatcctgtcctactggattagacatcaaattttattcttttgatgacagtgtcattctataaatttaaaatacataaattactttaatccaaccaagacttttatttccacgttcatgccgtgggtataatgttaacaatgaagggcactagcaagagatttctgggtttttctccccttttgctgttatgttaactctcaaatactaattttgtactagttaaatctgatgaatcacaatacatgactttaaaaaatgttacatagaatcctttattgcttcattctcagaaaagtgattgattaaaagaaaactctattcaaaaatcagcttttgtcccttcttgtggttctttcagtagaacaacttatgctactctcttcttttgatcttgtaattagaacattttactgtctctgtaaaaagtgaccccaaatgaaatgtttgctcaagtgttagtatagccttctcctgaatgtgtctaatcttatttttctgatcctatggttctgcttttggtctctctctccctgttacactgctggtgatgttagaactctgttttgggaaggtgcttccaatgttatggaaacgctgtgggatttgggcatgtcatgatatcaagatactgaatggcaaacataaagaagttatagcacttaattaatcatagtagcttaattggacatttaccaaattttttttggtaaatttcttattcagaatagtccaggaatcaactgcttacgtgcttaacttaacaaataactgtgggagaaaaaaaataaagggtgctgagcaaatttatatttctgttaattccataggccagtaaagaaaatttttaaagtgacctagaaaaattaaagggaggttatctgttgattaactcactggtgaccatgttaagatgcattttcaagtatatactgagatgaatgggaacatatttgaagaaaaataaacccagctgccgggcaaggtggctcacacctgtaatcccagcactttgggaggccgaggcaggcggatcaccagaggtcaggagttcgagatcaaccttgctaacatggtgaaaccccatttctactaaatatacaaaattagctgggcgtggtggtgtgtgcctgtaatcccagctacttgggaggctgaggcaggagaatcgcttgaacctgggaggtggaggttacagtgagtcaggatcacgccattgcactccagcctgggcaacagagtaagacttggtctcaaaaacaaaaaaaaaaagacacagctataacggaataatcttaaatgacagttaaataaaggtgacatgaaaatatcacctaaaatgtaatagtgttgttactgtgttaggcagcatattttaagaagaaaaagcatgagagaacaacttttttctgatgctattttcttctagtattgaaaatatttcttgattcattatccactcaacaaacgtttattgaatgcttactgtatgccaagcactgttttctggggatacatttttaaagatatgtttcctcattgaatttaaaatacagtgaatcagacagaaattaaacagataactgcataaataaccctaaaattagcctggtgtggtggcacgtgcctgtagtcccagcaactcaggagactgaggcagagggattgcttgagcccaggagttcaaggcttcagtgaacaatgattgtgccactgtactgcagcctgggcaacagagtgagaccctgtctcacaaaacaaacaaaactctggaacagcagctgtgataagtagtatgaagaaaaatcacagagtacatgagtttatggaaagatgaacctaatccagcttgggagatcaggaaaggcccttctgacaaagtgtcatttaggctgagacctgaaggatgagggaccaattctgtggaaaaggagaaggaacatttcaggatcgtgaataacatgaatgaaggccttaagacagaaaggaggctggcacgttcccggtgggagcagagccgtgaaggactcaacgggaagagagtccatggtgagcccagagagccgggagaggctggtatcatgcaggcgcatgtggaggagtctgctctggcccctgtgtgattagccttgagcagggggcagaagacaataaaggacacaagctcgggagatattggaaagtccaagcagtgttggcctggtctaggctggtggcagtgaagttggaaataagtcagcagattcaagatgtattttcaaggctgggtgcagtggctcatgcctataatcctagcacttagggaggcctaggcaggtggaacttttgagcccaggagttctagaccagtctgagcaacatggcgaaaccccatctctacaaaatacataaaaaggtagctggatgtgttggtgtgcgcttgtagtcccagctactcaggaggctgaggtgggaggactgcttgagcccagaaggtcaagactgcagtgagccgcaatcatgccactgtactccaggctgggccatagagtgagactatgtctcaaaaaaaaaagatttttttttcaaggtagaatcaatggaaccttgaaataggttccattgaacctatttgagtagattgaatattatgtatgatgatgaagttaccctaataatactgagtaccctaaaatttaagaatcatgatggattagtaattaattgttcaggggaggggagcagggagcaagataaattctgctgtaatttctcccaatggtgggagtgacttgtccctaagaagctaccaaatcttttttctcttggacctaaaaagtgtccaatttaagatccattcaagaagccccacagatacacaggtcacccttttgcattcctacctcctggcacagtaaatatctatatctaattctcctgtgtcatttctgtgctacatttgcaaactctgaatgaactgtggttgttctacaatgatttacactgttatttggcgagcccctgagctataaaattaaaaaatgacagactacttccatggtgtatggttttgttcacccaagaatgactcataaatcaatgcaggagcagttagcagaccacggctgtatggctcagtgtttttaagagtgaaagagaaaattctattttaactaaaactaaggcttaatttttaaatccacagaggtaccaaggcgccctctaatggtgaactcaaacaatgctctattttgtaatgagctacagtttcagttagaaattgtggtaaattcgttagggaattatgaacagatttttttctttttttgtaaaggctttataatttcttaatgtttggccatcagttttgtctcttctatgcattttcaggctgtattctacaaggcttcttgcctattggtgaagggttattgggggtttgtctgtaatggttattgcagtgtttctttttcttaggtccccagccatggctgggggattatttgccattgaacgagagttcttctttgaattgggtctctatgatccaggtctccagatttggggtggtgaaaactttgagatctcatacaaggtaacattttatttcaacagatggaattctccaagtcgttactaacttctgtggctttcagataaagctagttttttgtgggggaaaaaagcccacaattatatcatgcatttctccaaattgtatagaatgatttaatgaaaatggatgcctttgaggaaaaaataaggcaaaatgcaagctccaaacttaccatatatttacagggctcagctcaaaattgtggctagcaagctttagaaatgaaaatatctacccccacaccccaactttctatatattggagctttttattatagaagcccttggaagaatctgcatgcgttagggccacaattgaccacccactgacacagtcaccctttaccactgtaggacatgattcaagacagaagcagagccccacaatgactgtatcctcaggctgactttggcgctgtcttcctgcagcatccaccctgttgttgaagcagtctgggagcaatactatcttccatgctccagcccccacctcaacccctattcctacccccattttccaaaagaaagagagagagaactatatcagagtgtgagttaaacaggtattcattacctcttgtcttaaatgtcctgtgcgtagcactgtgagggatagaagaggagtaaaccagttgttgctctcaaggaacttgataagaagatattagaattatacttaaattcataatacaagaaggcagaatggcattcagttggtgtgcttaaaaaaccgtcggccaggcgctcatgcctataaacccatcactttgggaggccaacatgggcggatcatgaggtcaagagatcgagaccatcctagccaacatggtgaaaccccatctctactaaaatacaaaaaattagccgggtgtggtggtacacacctgtagtcccagatactcgggaggctgaggcaggggaattgcttgaatctgggaggcggagattgtagtgagccgagatcgcaccactgcactccagcctgggggacagagcgagactccgtctcaaaaaaaaaaaaagaaagagcgagcgttatgctagatgcagaatttgcggcagaagtaggaagatgggtatgatgttagtaagcacagataagggatgggagggggacttctaagcaagtagcatggggaaaagtacaaagaagagaacacaaggaacattcagagaacagcaaggagcaaactttggcagaatcaagcaacatgaataaggaagacatctaagaagataaaatgggaaggtgtattagggccatattgaagagagcctttaaagctgagttaagagatttttatttaatttgataagcagtggagaacgatcaaagatattaagcaagggaataacatgacccaaagctgcccttcacctataataatctcttgctataaataaggatagttgagtagagagaagccgaaggtgaagaagccagttaggagtttattataataatcacccaagtaggaaatatattagcaatggaaatgattaatgagttaggaataaagaatccacatgactttgcaaggttatattgggagaaagttgctaggggctatgagtacacagtaagaggccccttagtagcagtttattattaatactgtattccctgttgccttcttggttgttacatgagcttttaaaagcaaattattttaggatttgtttagtttaagaattctgtgtggacactgtatataatttagattttagatttacacttacaagataaattttcagttatggtttatgtttgtatttgaaacaactttcacaacgtgtttttccttcatagatatggcagtgtggtggcaaattattatttgttccttgttctcgtgttggacatatctaccgtcttgagggctggcaaggaaatcctccgcccatttatgttgggtcttctccaactctgaaggtgagttttttggataaaaggggaggacagggaactaacatttatgtaccacatgctatagtagttacttaacaattgtcagcttattgagtgggctcttcagcagtcatgttgattctcacctttaacttagctagacttattcacgaaatatcttattgttctttaagattattcagctgaagcaggaggattccttgagcccaggagttcaaggctgcagtgagctatgattgcaccactgcactccccgctggatgacagaacgagaccccatctcttaaaaaaaaaaaagattgcaccctatttttttaattgacaagtaaatattgtatgtatcttgtacaatatgatgttttgatatatgtatacattgtggggatggctaaatctggctatttggacatgtattacgtcacctacttgtttttgtgctgagaacacttaaaatttgttctcagcaattttcatatatgtaatatattataaattgtagtcaccatgttgtataatagatctcttaaaactattgttcctaacagaagttttgtgtcctttgaccaaaatcagcccactccccccaatcctcaccttctggtaaccaccattttactatctgtttacttgtttacactccacatgtaagtaatatcatgcagtgtttgtctttctgtgcctggcttatttcatttaacataatattctccatgttgttgcaagtgacaggatttttttattatttaagggtgcatagtattaataccatcatgtatatataccatattttctttacccattcatctgttgatggacacttagcttgattccatatcttgactatcgtgaatactgctgcaatgaacaggagtgtagatacctcttcgatatacagattttatgtcctttggatatatacctagtaatgagattgctagatcagatgatagttctatttttaatattctgaggaacctctgtactgttttcccataatggctgcaccattttgcattcccaccaacaggtgggaagggtatcttgtggtttaatttgcatttctctgataattaatgatgttgagcatttcttcatataactgttggctagttgtatgtcttcttttgagaaatatctattcaggtcctttgcccaatttaatcaggttgtttccttactattgatttgtttgagttccttctatgttacggatattagcccttaccagatgtatggtttgcagatgtagcctcccattccatagattgtctactttgttaattgtttcctttgcttacagaagcttcttagtttgatataattccattagtctatttttatttttgttgcctgttcttttggggttgttacatccaaaaccaatatcatggaattttttcttttagaagtgttacagttttaggacttcacgtaagtttttaatccattttgagttgatttttatatatggtgtgagatgaaggtctagtttcattcttttgcatatggatatctagttttccatttattgaagagactgtgttttccctcatgtgttctcagcatctaccttgaaaatcaattgaccataaatgcgtggattatttctggcctctctgttctgttcttttggtctatgtgtctgtttttatgtgagtaccatactgttttgattactatagcttagtagtagattttgaaatcaggtagtgtgatgcctccagcttcgttctttttgctcaagattgctttagctattcagggttttttgtggatccatatgaattttaggatggatttttttatttctgggaaaaatgtccttggaatttagatagagattatattgaatctgtagtttgcttttataatatggatattttaataatattagttctttgaatccatgatcacagggtatctttccatttattttgtgtattcttcaatttatttcatcagtgttttatagttttcagcatgtagattttttcacctcctaaatattttattgttttgcttagctattgtaaatcggattgttttcttagtttgttttacagatagaccaccgttagcatatagaaacactactgatttttctatgttgattttcctgcaactttattagatttgtttattagttctaacagctttttaatagagtctctttagggttttgaatatataagattatgtcatctgcagagacagtttacttcttttctgatttggatgtcttttctttctcttgtctagttgctctggctaaaacttccagtagtatgttgaatagaagtggggagagtgggcatccttgtcttgttcttaattgtagaggaagagctttcaacttttcatcattgagtataatgtttgctgtggacttgtcatgtatggcctttattgtgttgaggtacaatcctcatgtaatttgttgaagctttttacattgaattttgtcaaatgcctttttcacatctattgagatgattatatggtttttgtccttcattctgttaatgtggagtatcacatttactgatttgtgtatgttgaatcatccttgcatcccagggataaagcccacttggtcattgtaaatgttatttcaattatttctctgtgtttgattgaaggtaactgagcttctgtaaaacaattatttagaattatttatccaggtctactactgggagattattgtgatcttctagtggtattatgtcctcttcatttttcagtttcttattgacttacattaatgcctgtgcattttgtggaccagtcacctcttgcggactttacaggctggtttcagcttcctctatgggggaaggaaggtgtgagggtacttgcttggtgggatatagcagttctgggactactgaggataccaggtatatattccctgtgcagatcagcccaccaaggtcagtgttggcaaagattctagtgctcctcagtggctaatgctgtagatatctatagtggcagtgaggcatgttggggtctttgggtatggctgccaaggtcatcctgatttttctctcattgcagaagttgaatgccccttggcactggttctgactcataggctcacttgcagcggcagtggcccttgtagagtggctggggagctgaggactgaagcacaagcatgagtggagagactatggctacaggatcttggacagtttaaaaaccccaggacttagggcacagatatttcgctactgtattgataacagaatgcgaggtaccagatgtttgtgagacagctgaagtagccaagaatgggagcacagatgtgctcagagttaatccagctctagggacagagtggtgcctaggtctctatggcagctgagctggtgcttgggacataggtacctctgctgccatgttggtagcagtatgtgaggcccagatgcttgtgaagtagcttttagagccaaggaaaggagcagaagcatgcgtagagttagagcagctcctgagttggggtgggttctagctctctgttgcagctgatccagggcctggagatggggcatgcacaataaaggcgtggctctgaggcctggagcatgaacgaactatagcaatggttctagtgtcggggcaggcccagtgcagccacagagcctggggctgcaatgtggacactagcagaacaactgtggcttcaggatcagggctcactgggccatgggagaattggcagagctttgcccaaagtaattcaagagtagctgctgcttggatggtggtgaatgttcagatgcatctccctctctggggttccccagcagaagggctgtcgtttacctcagtggcaagtgatgccagtgtcctctagggagcaggcctctggaaactatggtagttcctgctgcatggccgataccaatagcatctgcctttcttctttgttcctagctatctccttgtgcctcaggtatgtagacctcacaggtgatcctgtcctatgtagatattcttcgtttcttttcctccattgtgttgctgcagattcttcaatgggccctggagctctctctgggctatttgggtttgtgaataggtgtctgtatttgttttttagttgtgggggaataaaggctggtgtctcctactttgccatcttggtgacctcacctcccattatatcccattctgattaagattcctatattgaatgttctccatgaatacatttcaaataaactcaaaaaagtctgacactgtgtagggaaatagttgaagggaaaaatactagcttctgttattcacacatgagtaaaatatggtttggttttttttttaatttagataatcatgttaggagtttgcataataagcaaaatcgaatttttgaacagtgcttacaaaagattaatatctcttgtccctcaaagattgaaaagttaatgtgaatatcctttgtcctgttgtattctgcctccatattctctatctctgtcacataaaatagaggaaaattggccaggcacagtggctcacacctgtaatcccagcactcggggaggccgaggtgggaggatcacgaggtcaggagttcgagaccagcctgaccaacatagtgaaacccagtctgtactaaaaatacaaaaattagctgggtgtggtggtgggcacctgcaatcccagctactcaagaggctgaggcaggagaatcgcttgaaccctggaggcagagtttgcagtgagccgagatctcgctgctgcactccagcctgggcaacagagggagacttcgtctcaaaaaaacaaaaaaatagaggaaaatcccactgactcttttcattgtgacatccaaattgttctattgtaataaatattttgctgtgattatttaataaaaatctcatctcctatgccataaatatagaactaggattgataatctatattttaccaaaactcatgaacctgcagaaaaacaaaacattggtttttaaaacattttggaaatgttaaaaaatattttttgaataaataaaatgtatttaacttaaactgaacgggactgttttagtaggatgagcatcctcccgggcttctttcccagtcacacgtttattaggaaataaatcacagttctagttccttctattgattctccccattccagggagtgtacgtgctctctctcagcttcctcaaatgagatatgtcatagtcgccgtcttccaagagaatgacagtttctagctggggaggacagaattagaagtagtgtagtggtgaatgatgacctggtgattatccagccatgttggggtctcccagttctttgacatttcatcccagactagtgacacttaggggtggcatttatttatgaaacaaaccaaggaagcttcatgcagacatccagatgtcccactgcttggaggacaaagacctctatccctggcaaaacaactttgaggtttatttggttgggctgctttcataagttctaagaggcatgcaactctgatgcccctcattttctggaacgcttaaccaagtcaagtttattgttggctgtagacacaacttgggacagttcataaaatgggaataggtaataagcagacagctaagctttcagagccagaacatccttctcattggccaaatgaagccccagctacaacaggggatgagatttaaatgtctgtgataaaacaaaaatagcaccaaattaacaccaggcatgattgacattgcaggaaattccccttggagttggactcaacaatcacgaagaattgatgaaaagccaaattgactcaaaaaaagtctattctgaaagaaaaactaaaagagctgagaggtggctatttatcctctctaaaaattagctatatataccatacaaactacccagtaagtgtgaatttagcatacacttagtgagtacccagcatgtgccaggcactttcttttctccagttttgacagcatctacttgagccatcagggggccagtggccaggtctgtttctccagctcatttgtctcctctgagcctcaaaccttctagagttatcctctttgatgtcctttagatcttccactcaacagaagtcaaaactgacctttaacttttcctcaaaagtgattccttccactgtgttctctatttgcccgtgaatgaaacttagggaggcatgtagagttgttccctgtccctcccccttaccaagtgctggtgattctgcctcacatatagctcttcaatccatccctttctatacttagtgcagcccctcaaatctctcccatgaatagtaaatagcctcctacttggctctttgccatcaagttcaacccccttcagtctaccctccactcactaccggtgtcattgatctgaaaattaaatctgatgtcacttacctgcttaaaacgtttttatggttgtcatctcaagggtaaaattcaaagttcttttaaaaataataatattaataatagctaacatatggtaagtacttacagtgtaccaggcataaatctaaatcctttatatagattaacttcttaattttcacaacacactatgaggtaaggactatatcctcatctaatttttttatgttgttgttgttgttgttgttttgagacggagtttcactcttgttgcccaggctagagtgcaatggtgcagtctcagctcactgcaacctctgcctcccagattcaagagattctcttgcctcagcattccaagtagctgggattataggtgcgcaccaccacacctggctaatttttgtatttttagtagagacagggtttcaccatgttggccaggctggtctcgaactctgcctcccaaagtgctgggatcagaggtgtgagccaccacgcccagcctatatcctcatcttaaaatgaagaaactgaagcaagttttctcccagtgaatactgcattccagtttttgtaaactacttgctatactgcaatacaccatgatttgtcatactgcatttgcttttctctttgccctgaataccattcccacctaattaaccactccttcgagatggggcaacacagtgccactctggccctgtccatctgagaaaactaattgctccttctttttgttgccataatcttacatgtgtatacataactcttcaggtttgttcatgtctagagtacatgtactgtgtctaatttcgtatggatttgcaaagattcagaatgtttagtggtatattagtctgttttcacactgctataaagatatacttgagactcggtaatttataaagaaaagaggtttaattggctcacagttctgcaggctgtacaggaagcttggcagcttccgcttctaagaaagctcaggaagcttccaattatagtggaatgcaaagggggagcaaggcgtctcacctggtgggagcaggagcaagagagagaagcaggaaggtgctacacacttttcaccaaccagatgtcacaagaactcagagtcacaaggacagtgtgggcatgggggtggggggtggactggtggtaaatcattcatggaggatccaccccatgaaccagtcaccatccaccaggccccgcctccaacattggggattataattggtcctgaaatttgggtagggacacagatccaaaccatatcaagtggtaatatcgtatgttcttttatcatgctgcttataacagctttttttaaacccatgggcttttgtgacaacaatgcatctaggggcatgttcaccctttgatagttatcttgttgcctagaaaacatttaatctgaacactaggtatttcttttttgaatgtaaaacatgggtcggccacatggctgacaggccaaatccaaccctttttagtaaatcaagttgtattagaagatagccacactcatttgtttgtgtattatctacggttactttctcactacaatagcagagtcaaatagttgccacagagactgtatagcccaaaaagcccaagatacttactatctggccctttatagagaatatttgctgatgcatgatgtacaagattaagggattgagtattattttagttcatttagtgttgctacaacagaacacctgaggctgggtaatttatcaagaaaagaggtttatttattcacgattctggtggtttgaaaattcaggcttgggcagctacatctggtgagggccttatgctgcttcagctcatgatgggaagcagaaggggaatgcacatgtgcaaagagatcatcacatggcgagagaggaagcaagagagagaccaaggaagccagactctttaacaaactactcttgtgggaacgaatccacttctgtgagagcaagaactcaccccctcacctccataggaggccattaatgtattaacaacccaaactcctcccagcaggccctgcctcccagcattgccacattgggcatcacatttcaacatgaatgttggcagagacaaatcacatgcaaattatcactcaagtgtgtaccaatttggtcacatatattcatgcaaccattcattcatcaattaaagctttaaaagctagatatttgtcagctatcacagtgtcagcatattttattgctctatagctgctttttcttaaagtgaaccaactggggtcgggggcaatggctcacgcctataatatcaacactttgggaagccaaggcaggcagattgcttgaggtcaagagttcaagaccagtctggccaacatggtgaaaccccatccctactaaaagtacagaaattagccaggtgtggtggcgggcacctgtaataccagctactcaggaggctgaggcaggagaatcgcttgaacctgggaggcagaggttgcagtgagccgagattgcgtcactgcactccatccttggtgacagagtgagactccatctcaaaaatatatattttttttaaattaaagaaaggaaccaactggggaaaatacccagtccatttggggttatagtaaaatagttctattatagttataacaggatcaataaaatcacctgcaaaaatgtgttttattaaacagagcttttgtttctcatgatggtttctgaaatgatatttttttccctacacttatcaacagaacgattctaatagaaagagattgtaggccaggcacagtggctcacacatgtaattccaacactttgggaggctgaggtgggaggatctcttgaggccaggagtttgagaccagcctgggcaacagaatgagactccatctacacaaaaaaataacaaaaattagccaggtatagtggcatgtacctatagtcctagctactcgggaagctgaggtgagaggatcacttaaacccaggaagttgaagctgcaatgagccaagattgcaccactgcaccctagcctgaatgacagagcaagaccccatcacaaaaaaaaaaaaaaaagaaaagaaaagaaagagattattatagggaaagaagtacagtgtccagccaagctctcataaactctctctgagattcaatttattcttctgttagcagaatagaatacattatctcagcatatatgatcttccagctcagggatatcaggttttgtacaatactttttacttaaatacacatgatattttaatccttggcagatgacatattagagtcattaacttgcatttgttgtttaattaaatgccaggtcctgttgaaatgaatttgttatgtgtaggccattttcatgtgtctaatataggctgtttatgatatgacatttgtatttttataacgatatatatatatatattttttttttacagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaagtaagtagtcacatctcaaaatgtatgtgtttgtagactgagtttgggagaaggcagagagaggtggaaatatgtaagagggaagtattcttggggaaaagttggggtaaaaactgtctgataggatctaccacctttccactaaacagctatagctgccagaccagctggccaccatgctgtctcctggcagcctttgctcattggccccctagcctgcaagacatccactcttcactccagctcctggcgcctccatgcctcttactccaactcccttccttaactaatttcaatttatcttactgctctcaacttagagatcaccaatactgaaaagcccttcttactattccccacttcatcaaaaagatgcagttctatgttctttccaggggttctcacaacacccaaaatcacctatctcccaaccagtctgagtgcttcaggaccttgatcacttgtgtccaggtggactgatgcagggacccatatacagtagatactccaacaatgcttttcaaatgaattaaaaataattaaaatcagacaaaagcactttgacaatcagacattgtcatttctttgtttattcaaacttgtcttcagactcacttctgattgctccctgcagccccgctgtatgcctcacaggtacactaaacctgccatgaacgttcaagtctacatccctctgcttaattatgttcagcaaatattggttgagggcctactatgtgccagtcactcttctagacagaaaaccagagaagcaaagtcgtttttctcagggaactggcatgctacctggggagagagaccaaaaaagtctgagaaaacaaaaatgataatgacagatggtgataaatgataatgacacataatactgtcaagaggacttaagggcagggtaaggaaagcctctctgaggaggtgacattcgctctcagatctgaatgataaagagtcagccaatcagagagtggagatgaagggaagctgaccaactgcggaagcatagttcatctgggagtggattccttatgggttggtgtgtgaagggataagggccagaatgacatcgaggttgttttgagtagctgattaggtggctgctgagattgggaagatagtaggggagtgaatggagggggcaaggcttctgttggtgttctgggcatgtgaagtacctgctaggcgtccaggtagagccattaaggcctactgatcatagattgtaggttgtatgatgccaaagtccagaagagaggccactctggagatgtgcatttggggccatcagcaggtaggtcgtttcatgggactgaatgaggtccccgagggagaaaacacagatagagaagagaagactagacccatccgtcagaaacgccagcatttagagttcaggaatagaaggaaaaaccaacagaggacactcatgctgctctctctgtacttcttgctttaatatactttttccctatactcttattttacctgtcctattacagcaaattatgtttaactccaactagaccataagcctttcaacacacagatctctctctgagggcccagacaagtatatccaactgtatgcttaacatcaggacttgaatgtgtaacaggcatttcaaactcgacatagcctaaattgaacttcctatctcctccccccaacccatctttgctgatttcttggtcaaaaactttggagtcttccatgaatcctgtctttgtctcgcacttcatatctagttccagaatctgatcccttgttgcctggtctaagccaccatcatctctcactgagactaacttgttgactctcctacagcctatttcaaatacagcagtcagagtgactgttttaaaataaaggcaaatcatgtccttcttctgctagaaaccctgcaccttcacctatgagtgaagacaaagtcctttctggtagtctccaagatccacaacatctgtccccattcctctctggcctcacctgctactgctctccccactccactccagccccatgtccttactggtcctcagactccctccaggcatgtgcctgcctgtgctgttccctctgccaggaatgcttccttgcagatacacgcatgcatggccagctctcacacctccttcaagtctgctgacctaccacttctcagtgaggtccaccttgttacttcccaacgccctagctcccaccctaacttcctcttcttttcctttttttcaccacacttatcaccttttgccataacagacaaattgtctactatgttttttaacttatattctgtcttttttcccttacattcccagagtgaatggaggcaggggcccacattcactgtggcatgcccattactggggtaggtgtctttattttgttcactagtgtttcagagcctacaacatgcctggcacacatcaggtacttaatatttgatgattgaataaatacatgaatgaataaatggaattttctgtcctccttttactgtctcactcccaagtatatcttcagtttaacctcttcccattctgacatctgcactttatacttcatttctcggcatttccttaacattccagggtaaacccctacctgttttaaaggtgtctcttggggcagtctttggagctcctccaggcagggtgagcagctcttcctctgtacattcacacctctgtcctgactggtccactacccctctgtctctctacaggcggtgaggaccatgacttgcacctcttcatatcctcaaaacctgttatcattataggtgcacagtccatatttgctgactgaatgcaagaataaaacattttatccaaatagtatagcgatttataattcagagaaataaatggcttttccaaaaatagttcttttcatacaaaatgtacattccaaagatggaaacctgtgtttgcttttcatctacgtttatagagaaaagcctcactgcctggtcatgtgccatgcatggcctatgcaccctagacccctacaggcagctaccaaaagtgctgcatagccatttgggagaggtcccttacaaatccagtctgttctagatatctagggccaggccagtgtttattaccactgtggttaggttctctatttgcttctcattcacatgaattactgtgattctgaaattgcaattaatggtaactttttttttctctgtggtattttacggaaatgtatagtcctttgctcttagagaaagaacccattccagtgttgacttcaagaccataagttatttcaaaactatgtaaagattgacaatccagtaataacctgtcactacacatacccagattttccctgtaaactgtaatatttaacatgaaatgttaaattctgatgccagagttcatcaaaaactaaactgttgcctgctttttgcgtctttattcatttttttagatcagaggcttcgaaactgcttactgcattgatagcatgggaaaaacaaatggaggctttgttgaactaggaccctgccacaggatgggagggaatcaggtaaaccaccttacttttgtgtttaagttgttccgtattgagggccatcaggtttattgatcacagagtgatctttgtactttggttttcgatttggtaattttgtttgttttgataaagtaaaacattctgtaaaaaaattgacagtgttaaaacattcacttaaatgatgggaataatagcagtattggttttcacataagcagtcagaatctagaattaatgtctaatataagggattaaaatatattcctgtgggagtatatatttgtcactaccgtaactatgtaagcctagctccctaacaattttttgcaagtattgctcactaatcctcatctttttgcaaatagagtgttactgccagtaatgtatatttcactaatatatattctcttacttatgtgggtatgtttttgctttttcattttttcacattgttggtacttaataaatttgtgttagtgacccatttggtatcttagagactaaagaacttaatgatttcagtgttaataaggatcttcactaacatcaaaataaatataatttgtctgtggacttacagttctaaacaaaattatggaaaaataagttagtcattcaatttaattataggagttaagtttctttcttttcaaatgcacatcagcagggaaggtgcctctgttacttaattctctcttttccttttacagcttttcagaatcaatgaagcaaatcaactcatgcagtatgaccagtgtttgacaaagggagctgatggatcaaaagttatgattacacactgtaatctaaatgaatttaaggaatggcagtacttcaaggtattctgcattttaacttctgaaatattatatgcttttcattttcagtaacatctagcatgtggaatttagataaataaatcttaaaacctgcattcaaattcacttgcattttcctctcatttagtcccttgcataggttttcctgagcactggatgactcattgttctataatgaggcatcacttttgttctctcttacaatattgtcatgtaatgaggccacgatgatgtctataaagagcactgctaattttagtaatacaagaaagtcagtgttctgtgaggcagtcatcaccattgctctcatcaaaatctgatttttgaaatgtaaatgaatcattcattaaagtaaaatatatttaaatatatttatactattaaaaatttggttaatatttgatattgtccagcaggtggagatagagacaaacaaataaaacttgaaatctaggctttcataacgtctttatcattgttgtgtgctaaatacagtgggataaatgtagctagttgcttactttaatggtcaaatttagttattcacgtgacactgctggggtagctttgtgtttcagctgtgagtatttaaagctctgtggcaagttgaggattacaacatattaatagatttatgtatagttttcaaattctagatttggctaacataaatcaatttattattaaacaaaaagtggggaaagctgcctcacactaaaaaaatctgtcaaccctccattttatttactcacccagtatttgttatcatatcccatctgtcatgcaagcaaggacttgtttgctatgtaataatgatatgacctagcttaacattccctgttactgtcatttacagataatttccaggaagtgataagcacgtatcaattgatgattttgtttcttataacaagttaggaaggagaagaatagcataaaccttaaagagtggagcatttattttcacaaaaaaaaaggatatataatagcaataaatagtaggggtcagtgagaacaatattagcaaaatagtaaaagagggctaacacaccagaaactacatcaagaagtaattgaacaaaaaatgacacataacatgttttaggtattttaaagacgcagcactgaatatacatttgtgtgttagatattactgaacattcacttggggaccaataatatgttagactgtaggggagttcaaaaatatagctaaagcacgctattatataatggcagagaagaaagaaatgcaaaaatagagataagcaaaatgccataggacagaaaagagtgattcatgggaggaattactgctgaggagtttcatagaggaagtgtcattgcacaagtcctgaagtgtaaaaaggctttccatggaaagtaaataagaaagcctggatgagcaaagatgtggcatgaaaacatgtagaaaattcaaagaattgtatttcatttggtatccctcaattgtgctttggaggaaagagcaccgaacttcattttttaagttttggagagggatagaccttatttgaggaaggtagtgatggaaaacaatggctacttttaggaaaataattctggaaacgtgaggtatggactgatgaagcaacgagatcagcttgagcagcagttctcaaactttctgtcctctggattccctttacactcttaaaaatttttgagctcccccacccccaaattgcttttgtttatataggttatcactagcaatatttccagaactggaaagtgtctgagaaatttgtaaagtttttatatattaattcatctaaaagtaataataatatacttattaaacattaatgtaaatgacatttttaatgaaaaataactatgtttacccacaaaaaatagtgagaagaatggaattctgtatttttgcaaatctctttaatgtctggtttaatagaagaagacagctggattctcatactcctgcttcatttggtctgatctgaaatgttgttttcgttcaagtatatgagggaaacccagccccacacaagcatacagtttgtaaagggagcgagtactttaatagccgttcatataattgtggctgtttttttattgtacaccacaacttaataattaagtggtagtttcttaaaagttatttccagtgtagactgatatccttgagcattgtacctcattatatggaagtacttgatacgtacttcccacttcatctcatagaattttttttaagtatactgaggggtcaagactgaataaaacgaatgttttgctccttcatcagtgacatccttaagtgaaaccggcatttacttttcaactgtgtgtggccatgagcaatacaactataggtactagcatagtttgattcatgctaaggcaccatcagttttactcaccattgcttttgcactatcggtataaatgttgctaaagtgaaaaggcaatggtgtcttcgtattatgatgaaaatagtttcggccttacagacccaatcctggatagtctgaggaccagactttgagaagctctgagctatattgaagaaacctacagcatatggtgagggccaaaccagggcatctgcagtggcgatgggaaggaatataaaccagagacattgcacatatccatccttagtgactggtatgtgagtgaatgaggaaaagtgcagtatttcctaaggactagagagctgggaatgtcattagccaggataggaacaagagacatagatttggaggggcagataatgaatttaggtttgtatacattgagtgtgagataccagcagtatattgtgacttaacaatgaaagatcttaggacttagaaaactgacaatcaagagaaatccagaaaactgacaatcaagagaaatccaaagtctgaggtgtggttgagaagcttttccatttccttaaactgtctcctcatgaaagtcaagtgatgatttctgatgtcagtgatatcaagggtccaaatttgaaacttttttcttactgtgttttccagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 38346 - DNA, 2995 bp, Homo sapiens
gctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaaggtgagaggcgggggggggggggggggtagtggggacggaaccccgaaggggtcagtccgggatcggcagatggggcgctgtagaggacgttcttaggcagtagaggactgcgcggccggcgaaagcctagaagacttgggaattttgcctaccttgtgttcctcctttgtctctcggtatcttcgttccagggccagaggcaggattggttttattttgcagacagaaatcacacctcaagtggacagcgctcaaaacacgttagaagcagtatagtacaacgataatactaaacaccgatatggcacttgctcgttgccgtctgcattcttttttttttttttatagggacgagatctcgctatgttgcccaggctggtctcgaactcctggctcaagcgatcctctcgcctcggcctcccaaggtgctgggattacaggcatgagccaccgctccgggccccgtctgtgttctaaacacttgacatgcattagctcatcttatactcgaaacaaaccccatttcgaggtgggctctattattatactcatcctacagatgaggaaactgaggcacagagatgttaagtggattgccctagctcacataactgaatacatggtggaggtggaactggtatttgaatttagggctaccaggtctgctgtgctgtattaatagcagacgctgtgaaatcaggcagcactgacggttacccacccgtgtgatcttggtagcataaacccttggtgcctcagtttctttgtctgtaagatgggaacagtaataggacaccttctaaaaaataggacaccccacctgcctcatgtaattaaatgagtaaaaatggtcagaacagcagctggcacttcgtaagtatgtactcagcactagaatgtgtttattattgccatgtttcacctcactgagatattgtgaggtgtttctatgtgaaaagactggcacataataagtacttcatcaatactaacctctggttaaggggcttggatatataggatgcttgttcattctgtaaatatgtattgagggcctgctgtatgccaggctcagttcagggccctggggatacagcagtgtggaaatcagacaaagcccatgctctcatagagcttacatgatagtggggaagacagaaaataaacagtaaaatattagaaaacaataatacaaagtagtataatagataatataacatgagaatgtatgatatacagagaatggggaaagtatgctacttaggtaaacatagactagaaagagacagaaggaagagaggatgtgaagacaaagttaagcaagataagtggatagagaatgacttgggtgtagggggctatttcattagcttgagctataagaaattgccagtattcaaccatttgtgacctataaaaatagcagtttcctatgcttcaactttgaaagacaaggtaactagggagtgcctcctgaaggaagtggtgatgaatctaaaaccttgaatgaggagacagatccagccatgactagagctggaagaaaggctttccaggcagagagagcagcaagtgcagtggccctgcagtgggaaggagcttgacatatcccaagaatggaaacagaggaatttagtgagaggggcacatggagaccaagttatgcagggccagaataaggctttgtggagcagcaggaagccctcattgacctctatttctccacagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggtaagaggcagaggcagggatggaggttgaaggggattctgccaggagttttgttcctgcaccattgggaatggggagctgagatgagggattggtatcagttgaggctccctcacgtctacccctgctatttgcactaccaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctga

SEQ ID NO: 38347 - DNA, 51666 bp, Homo sapiens
gccacttccgggagtcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaaggtagggtcagggaggctgagagtccttaggcggggtgggaggaaggggccatctcctcagatccgggccgtcgtttcccaagttgcagagacccttgggttcaggtttagtgacaccactgctgataatggcgacctccagccctgcaagctttagaggaccactattctgtgttccagatgagcaaataggttgtagggacaacaacttccgtggtcatacagttcctgtcttctctcgcctgcccggcagtgctctgacggtcccactgtttctgctttacgaataaagacactgtggctgaggccaagtggatttgtagagtttacgcagacagaaagtcgagtagaattccttgctcacaatgagtttattacttaaatgtatgaatttatttatttttttgagacggagtctctctagcccaggctggagtgcagtggcgcgatcttggctcactgcaacctctgcctgtcaggttcaagtggttctcctgcctcattctcctgagtagctgggattagcgcaccactacacctggctaattttttgtattttttttttagtagagacggggtttcaccacgttggtcaggctggtctcgaactcctgacctcgtgatccacccgcctcggcctcccaaagtgctgagattacaggcgtgagccaccgcgcccggcctgatacatatttttaaaattaaacaacacccccaggcaaggtggctcatgcctgtaatcccagcactctgggaggctgaggcgggccgatcacttgaggccaggagttcatgaccagcctggctaacatggtgaaaccccatctctactaaaaatacaaaaattagcccagcgtggtggtgtacacctgtagccccaactactccggaggctgaggcaggagaatcgcttgaacccgggaggtggagggaggttgcagtgagccgagataaccccactgtactccagcttgggcgacggagaaagactctgtctcaaaaaaaaaaaaaaaaaaagccgggtgtggtggcttatgcctgtaatcccagcactttgggaggtcaaggcgggcagatcacctgaggtcaggagtttgagaccagactggctaatgtggcgaaaccccatctctactaaatatacaaaaattggctgggcatggtggcgtgtgcctgtagtcccagctactcaggaggctgaggcaggagaatcccttgaacccaggaggtggaggttgctgtgagccaagattgtgccattgtactccatcctgggtgataagagctaaactccggctcaaaagcgcgcgcgcgcgcgcgcgcacacacacacacacacacacacacacacacacacacacacacacacacacacacacacacacacagcagataagctgagacatgctggaagagtaggtgtttctcaatggaacattcaactccagaggagggaaagatcccttgccttggaatcagaattctcaaaggaggggcactagggcctgagcatttaacaatgggaaatgtttagacaggaaaggaggagaaaaaaggccaaataaaatcctagcgggaaaaaataagcataggccagtattcaggggacagtgaatagatcatttattttggagtggggacattagggcaagcagtgtcctttgtttatcttatcactgactgcatcttctggtaattatttactcctctgtcttgtaactgagagcacctcagagccaggtattaagtcttgccaggtactaagtctttcttctgttttttttgtccaacatgcgactgggctgaaagggcctcagtgaatttgtggagagttgagtggttttaggtacagctggaaacagcaggttgggaaaaactagattgtgccggtcccatgaatgttagctgagaagtttgtatttcatttcttgggaagcaagtgtttatcaaaggttgtttatttatttgagatggagcctcacgctgttgcccaggctgcagtgcagtggcgcgatctcggctcactgcaacctccacctccgggttcacgcagttctcctgcctcagcctcccaagtagctgggattacaggtgtgcaccaccacacctggctaatttttgtatttttagcagagacagggatttgtcatgttggccaggctggtctagaactcctaacctcaagtgatctgcccgagtcagcctctcaaagtgctgggattataggcgtgagccactgcacctggccaatcaggcttttgtgacactgccagaactgtgtttgaggaagattagactgaccttgtatgctaagaattcccaggaaaaaaaaaatggagattgtttaggaatctattcagggagattgtttaggaatctattttatggatgacaaaggtctgaattacggtggtggccatagaaatggagtgggtagggccagtgtgggagaagtctcatgggaagaatgggtaacagtctgtgctcatctgggtttgaggagtgaaagaaagaggtgtggaaaatacataaagagggaagtcgggttatacaaaggagaggagaaaaataaaggaggttataccaaaggagaggagaaaaaataaagagttccgttttagatgggcttaattgggagttatgctgagttgtccatatagacctttcagtggtatgggccgtgttcatgcctgtaatcccaacactttgagcagccaaggcggacgatcacttgagctcaggaattcaggaccagcctgggtaacatggcaaaaccccatctctacaaaaagtacgaaaattctctgggcgtgatggtgtgtgcttgtagtcccagctacccaagaggctgacatgaaacaatcgcttgagctcaggcgatcgggggaggtcaaggctgtagtgagccatgattgtgccactgcattctgacatgggtgacagagcaagatatgtctcatttaaggggggaaaaaaggaactgtgggattgaaactcaggccagggcggaagtcacctctgtagagggggagagttgagaccatgagcaataaactggaatcacagattgtcaggctccctcccacatctggaattcagtttcctccacatccctcccaagtcctcatctccacagaagaggaactcgctacctcccaagccttctacttgggccatcccaaacaacttgactgctagaaaagcctcacatttggcccagtgcagtggctcatgcctgtaattccacccctctggaaggccaaggtgggaggatcgcttgagcccaggagttcaataccagcctgggcaacacaggagaccctgtctacaaataataaaaattagccaagcatggtggtatgtgccagtggtcccagttactcaggaagctaaggcaggagaattgagcctgggagtttgaggctgcagtgagctgtgtttgcaccactgcaccccagtctgggtgacagaatgagaccttatctcaaaggaaaaaaacataaaaagcctcacactcagctcctatctgcctctctctaaggaaataccaaggtaattaacaacagtcttattggctgctgtatgaagcactgtgtggtaggcattgattttacttggtgttttgcaagtgaaacttatattaaacaagcagggtttccacagtcaagaagtagaattcaatcatgcagcagctttctgtctttaaatctttgcttgcccttggattgtgtctggttactaggacagacttactgtccagttcatgttaataatcaaaactaggaatttaattcaaaggtaaagctgcttctcttcccctctcaagctttctttgggctcccacatttgaggaggacagtagttgacttctgtttattttgtttcctcttccatcccaccccagcccaggccaactatggcttctgaggcatcctgtgttggtggagggggttataagagagtagagatggggcaagaaaagccccttcgacatctggccttgttactgtctcagcttgatgggaatttgtaactgactctcccatgcagtgcttctgggggtctttcttacctccagttcccatgatcaggtggccatctcagtcttgctgcttcaattcctccctcagcccctggcttctggaatcctccaccacatgccattggtccattttccctctcggtggccctcttgggcaaagttcctttaaaatggcttctcggctgggtgcggtgactcacgcctgtaatcccagcacttcgggaggctgaggtgggtggatcacctgaggtcaggagttttgagaccagcctgcccaacatggtgaaaccccatctctacaaatacaaaaaattagttgggcacggtggcgggcgcctgtaatcccagctactggagaggctgagacaggagaattgcttgaacccaggaggcagaggttgcagtgagccgagatcatgccactgcactccagcctgggcaacagagcgtgactccatctcagaaaagcaatactaataaaataaaaataaatgagtaaaatagctactagttggccttctcccctgcctggtccatatctgatcaacgggaaacacttaggtatcctttgccccaacaaattctgggggtgcaggccatttcaaatgcagctacctcttcttgctttgccaacagctcgccagcctcacgccagcctcagatttccagcccaaggcctattaccagcctctgtgcctgcacaagcttcagagggcacaggccaagctaccctaggggctggcttctggtttcattaattgttccaagaaagcagagacttgtgaatgtttggaatcagaaagatgctaatagggagagctttgagattctgaaaggagaacaagagagattaggtgaaattgtatgagatcagagggtgcttatcccttggactgtggagaaaagcacataagggccggctgcagtggctcatgactgtaaccccagcactttgggaggccgaggcagatggatcacctgaggtcaggagtttgagaccagcctcgccacatggtgaaaccccgtctctactaaaaatacaaaaaattagccgggagaggtggcagtgcgtgcctgtagacctagctacttggaaggctgaggcaggaaaattgcttgaaccctggaggcagggttgcagtgagctgagatcgcgccgctgtactccagcctgggtgacagaatgagactccatcttaaaaaaaaaaaaaaaaaaaaaaaaaaaaaaaagcacataagggcacccagggagcagttggtggaggagggcgactcacagccagtggccttaactttcccaggcaagaatagaaaattagagaagttgctcccaaagaggatttggtttggataacagttgtgatcactgggaaaatgctggtcaaatgtggaaaaacaagagtgggattagctagtggctatgagggccaagctgaagttctgtaatgtgtacttgctgtgtgcccaagtccacatagttttctacagcccagaccccataccaaggtcacagacatatacacagactcacacacatgcgtacatgcacacacatgcacctgcagattcacatcctggaacacttaaacacatcaatctcgacaagggaattatttattgatctacggttttcatacagtgaagtatataggtctcaagtgttcagtttggttttgacaaattccacccttgtaacaaccacccaaaacaaacgataaaacattgccattattccagaaagttctctcatgctcctttccattcatctgccaagacagctatttcctgatttctatgatcgtaaagttgctttgcctatttgtcatcggataggaaaatatacaaatacattgacagcctgtcttagtctcttttctgttgctgtcacagaatgcttgagattgggtaatttatatagcaaagaagtttatttagcttactgttctggaggctaggaagttccagattgggtagctgcatctggtcggcttctggtgagggctgcatctgcatcataacatagtggtggagacagggaattaggcgtggaaaagggaaaatgcaagaggaaaccttgctttataacaacctgctctcaagaactagtccattccctggagaagacattcatccatcttaatagccaaatcacctcttaaaggtaccacctcccaatactaccacattggggaccaagccttagcatgagttttgctggggacaaaccatattcaaaccataacacaccctcctcaccccacccctacacacccacatgtactgatcattttgtaccttacagtgggcttatatcacaatcatgtgctatcagattttggtattaggtgcacacattatatactaacctaccttctcttcaactctaaagtcatagatcaagtgaagtattttactattttaatttagttttttttttttttttggagatggggggaggttctcactatattgctcaggctggtcttgaattcctggcctcaagtgattctcccagctcagcctcccaaagtgctgggattacaagtgtgagccaccacgcctagccaagtgaagtattttaaaccgctccttttggatccctggagctaaaacaaagggttagaaaggtggttatcatcctgccttgcctgggagttttcctcatttttctgtagctgctctaggatattggaagttggggacatgtatttttaaaacagaaccatatttagataaatagctttttttttctttttcttttcattttcttttcttttttcttttttcttttttttttagctgtgttgcccaggctgaagtgcaatggcacgatttcagctcactgcaacctccgtctcccaggttcaagcgattttcctgcctcagcctccggagtagctgggattacaggtatgcgccaccacgcctggctaattttgtatttttagtagagactaggttttaccatgttggtcaggctggtcttgaactcctgacttcacaaacctcctgcctcggtctcccaaagcgctgggattgcaggcgtgagccaccgtgcccagccttagataaatagctttaacttttatttgggcctcctacctgctggaagtcaaaggagttggctttccaggataggtcccagcagaacaaccgggaggtgttggactggccacagcagagccaccaaggggcttccaagagctgagagtcgctgattgtggcagatctgagtctgcagtgaagccttctgtcaggcagaccagcctgaggcctgagaagggagagcaaagccaggtcacagcctggtcagggccattaactcatgtcagagaagtggaaggtggggcctgagcccaatcagggagcagaggaaaagcaggccccagagacagagtcggaggaagtgagccaaaggtggtggtcaccgtctttggagactgtgctgtagtttccagaccccaccaccgcctcctgacagcctagttgccgtatgagcagacctgttacccttacaggaccactagggcacctctcaggggtctagcaggcttaggtttggggacatggaattgatagcaagatctaaggcaaggagcagggatgtggacggctggatctaggcctctgatccatacctgctctccctaaaatatagaggtactagcgatggaggccaggcgccgtggctaatgcctgttatcccagcactttgggaagttgaggcaggtggatcacctgaggtcgggagtttgagactaagctggccaacgtggtgaaaccccgtctctataaaaatacaaaaattagcctgtcatggtggtgcatgcctgtagtccttgctactggggaggctggggcaggagaattgcttgaacttgggaggcgaaggttgcagtgaggtgagatcacgccactgcaccccagcctcagcaacagagacactgtcacaaaaagaaaaaaaggtgatagtagatactagtgatgatcaaggcaaagttaggaggttatgatggccctggtctcctcctcctcttccctctttctttcttctgtgccagtgggacctggtgtccctctgagttaagagacagatttcaggcccacttctgcagcctccacagctctgggggtgttgtgacctgggactgtattacccagctttgtcaaggttcaggccacagagaatgtgtcaagctgggattgaggaaagactgtaccaaatcccttaagatcctgacccttggctgggcgcagtggctcacgcctgtaatcccaccactttgggaggctgaggcgggaagatcacttgagcccaggagttcgaaaccagcctggaaaacatagtggaaccctgactctacagaaactaaaaaaaattagttggccgggtgcggtgactcacgcctgtaatcccagcacttcgggatgccaaggcgggtggatcacgaggtcaggagttcgagaccagcctggccaacatggtgaaaccccgtttctactaaaaatacaaaagttagctgggaatggtggcacatgcctgtagtcccagctacttggtaggagaatcgcttgaacctgggaggcggaggttgtggtgagccgagattgcaccactgcagtacagcctaggcaacagggcaagattccgtctcaaaaaaaaaaaaaaaattaggcatgatggtgcacacttgtagtcccagctactcggaaggctgaggtgggaggctcacttgagcccaggagtttgaggctgcagtgagtgacgatcgcgccactgcactccagcctgggcaacagagtgagacgctgtctctaagagaaaacagcaaaacaaaatgtaacccaaatatgacaagagttagttagctcgccttgaggccattctcaagaatgtcattcaacggtggctcacgcctgtaatcccagcactttgggaggccgaggcaggtggatcatgaggtcaggagatcgagaccatcctggctaacacggtgaaaccccgtctctactaaaaaaaaatacaaaaaagccaggcgtggtggcagacgcctgtagtcccagctactcaggaggctgaggcaggagaatggcgggaacccaggaggcagagctcgcagtgagctgagatcgtgccactgcactccagcctggggtgacagagcaagattccgtctcaggaaaaaaaaaaaaaaaaatgtcattcaattcccaaacataaagcaggtcctgacagcctcgaagtcacataacgagtagggaggtttttctgggacgacagaggagaggctcatgtcatcccacagaaccaaacacccccacattccttcagacctctctgttcttccccattgttctcttccggaagcgagaccctgtctctacaaaaaaataaaaacttagctaggtgtggtggcatgcacctgtagcctcagctactcaggaggctgaggtgggaggatcgcttgaggctgcagtgagccatgattgtgccactgcacgccagcctgggcaacagagtgagcccctgtttcaggaaaagaaactgagagggtaggagtaaaggaatttcctaagctactgccatgtgtcaggcccactgctaggcaatttatatcatttagctcttgaatgatcctatagctttgccagtgtgtattatctcagcttacaggtgagggcattgatgcctgtcactatgtttaagccttggtcatgctggcacagcctgagcttcccaccgcgaaccagaacagcggtggggattggctgtggaccctgacccttacctgggctggtcagcttgagccagagtctcaaagtgaagctcatggtctggcttctccaggatcatcaagtgttgtctcttcaccagaagcaaatgcccatcaattgtgtccacctggactgtcttgggggttagggtggcttggcagttgagcgctgggtcaagcctgcagtatcctcgaactcctacaagaagcctgtggtcaggcccagcctctgacacctccaccgtcagtcaggatggaagtcccctgggtgttgagcagacacagggaggcagggagatgagctggatctggctgggtccctgcttagtcacaggctctggcaacctctaatgaaacatcccttcccagttggctgttttccccaaatatagacacgtgctgtcactagaggggagcttcccagcccaacagcttctggaccatgctgggctgacttggggagagagccacccacgaacccctggtttgaaggccagactaggtggtcatatggaaggtgacagaccttccccctggtgggtgtactgtgtgcagggacaaagcctgtgctagcaccctgctgtcttgacagtaagtgtctttgggctgggcatggtggcttatgcctgtaatcccagcactttgggaggccgaggcggacagatcacctgaggtcgggagttccttctgccttggacacccaaaatgcagagattacaggtgtgagctaccacaccccaccaagggtctcttaagaagagctggccgggtgcggtggctcacgcctgtaatcctagcactttggtaggccgaggcgggcggatcacgaggtcaggagattgagaccatcctggctaacacggtgaaaacccatctctactaaaaatacaaaaaattagccgggtgtggtggcgggcgcctgtagtcccagctactcaggaggctgaggcaggagaatggcatgaacccgggaggcggaggttgcagtgagcagagatcgcaccactgcactccagcctgggcaacagagtgggactccgtctcaaaaaaaaaaaaaaaaaaaagagctatactgtgttgaaagagtcctgtataaaggaggatgtcttaaatttgccattttgactctgttttgaacaggtcaccaggaaaatgagacttggtagcctggcgaggtggctcaaaaaaaaaaaaaaattcacatggaaaagacttgatcttgggataaataaatttaatcaaaattgaaagtgaaaaaaattgaaactggctaattgtgacatacagaaaatcaaggaattaaagtggcttaatggattcacaaaggaaaatacttttggcaaaaactcatctatattactttaatatttttatgtaaatgcacgatacatcagaatatccttgagggctcaaatggtggagctaaggacagctaaactctccagggaccaggcgtggtggctcacgcctgtaatcccagcactttgggaggccaaggcaggcagatcacctgaggtcaggagttcgaggccagcctggccaacatggtgaaaccccgtcactactaaaaatacaaaaattaactggacgtggtggtgggcacctgtaatcctagctactcaggaagctgaggtgagagaatcactcgaacccgggaggtggaggttacagtgagccgagatcatcccactgcactccagcctgggggacagagcaagactctgtctcaagaaaataagtaaataaataaactcttcagggttcagaatagcaccaaatgggatggttacttgtgctcagtcctcaacttacccaaggctagaggtgccctaatttcagttcacagggatgcatcttctcttggaatcatgctgttaggttcagggaccgatctcatccttccagcactttaccagtggatgaggggcagttcctgcttgaccaggtagagtgctttgagaaggagaaggatctgcagaaggagatccttggggctgggtttttatctataggaccagagatgattctttggctagtgagtaaggagatagagttagcaatgggggaaagtaggtagtagctgaggatgggtatgagccatagaccagatgggttaggagccagcttttagttttgcttaatgaggttgtaggactagacacaaagcccacttctctcctctatacttaccactgccaaagtggcctggctttcagaggcagaggatgtggaacctgacttggggggtgggagtgaggagatccttaagaggaatccacacgtggaaaaagtatgatggcaggtccagatggcggtgttgggaaaggccataatggtaactgacaataatgtattcattccacatgtgttcattgactattactttgcagcatgtaaatctggggtattgggtgaggacctagcagtggacaagacaggcaagaccttccctcagaaaccaggagacaataaacaagcaaataagcacaataacttcaggtgatagtgaggtgaagacaaggccctactcagattttaaagatttcccggactattatgtgaagatgaaactggagggaggaaggaggaagcaagaaatccagttgggcactactgcctcatcaggagagagattgtagtgtcctggaccaagatggtacccctggagatggagagaagtggatggacttggaatacatgaaggaggcagagctcagagactggatgtgagggaaaggggaatgaggtcatcgggcccaagcaactgggtggatcatggtgctgttgattgagactgagaaggctaaatgaggagcaggtactggaggtgtgggcacgagagcattgaagttgtatttcggccatgctgtatttacgatgtctaccaggcacccttctagagtctgcagctcagtagacaggtcaaggtgggataaaatttgggaatcattggtatgtgtgtggtattcagggaactggatgaatcactgtgactctaggtcttagagtgttggtcctcagctacgggtgatcttgcccccttcttccaggggacccttagtgatgtctggagatactttctgttactggtgatgggaagaggtacagtttgcttccggcatccactaggcagaggccagggatgccactcaacatagcagtgcacaggccagctccccacacatagagttacctggccccggacgtcagtggtgtcaaggttgagaaaccccctaccctagagtgagtgtagataaagcagaaaaaaaggaaagtaagcccgggggcattcttccatgcagagctggagaggaacagtctgcaaggaagaagggaagcttggagagtgctttttcttgggaggggagagtgtctggggaagaaacaatgctcagccgtgttacatgctcctaagaggctgaggcgtttgagcccagagggaagtgaccaatggcttaggcaagatggacattgttgatgactttgatacagagcagtctttgtggtttggtagggttggaagctccaggggaaccagcctgggcaacatagtgagaccccatctcttaaaaaaaaattagccggccatggtggcatgtgcctgtagttccaattacgtaggagtctgaggtaggaggatcacttgagcccaggaggttgaggctgcagcaagctatgatagtgccactgcactccaacatgggcaacagagcaagaccttgtctcaaaaaaaggcagcagctccaaagaagtaggttatgcccatggccagtactcactgagtatttcctccctgcttagaatgcctgacaaatgtgacttcatgaatccacatacaccaggcaggtactgtcaccctcattatatagaagtggcaatattattctcacccccattttacagaggtggggactgaggcacagagaagctaaccactccttagggccaggcagctgatagtgaatcgcagagccaggattcagacctaaaagagtttgactccagggacagcataattggaggtgaagaagtggaggcggtaaatgaaacaccacgcttttgagagatggtgtttctctttccacgcttctgctggaaagaagaacagataggtacaagaggatgtttgcatgtcaacaggaaggacccatgtggaggctgaaactgatgatgctgtggagggggtgctgagaactgaagtctttgaggaggtgagaaggatctgaggtttaagttgaggtgctggcatttcccaggagcatcgtctggtaactctgaagtggagcctaaccgtttagagcaagattacccctggactcaacttctccccttcgccatcccccactggcctccagaggctccactctgctctccttctagccctcttgctaaaagatagctggccaggtgcagtggctcacacctgtcatgccagcactttgggaggccgaggagggaggatcacttgtggacaggagtttgagaccagactgggcaacatagtgtgagacccccatctccacaaaattcaaaacttagccgggcatgatggcatacgctgtagtcccagctactcaggaggctgaggccagaggattgcttgagcctgggagtttgtggccgcagtcagccatgatcacaccaccgtactcaagcctggatgacagaaaaagaccctgtctcaaaaataaataaaataaaagccttcctacaggaagctcctgcacaggcctgacccttccagaaacaattgggcccaggagccagtgtcccaagagcagctctgccaactggagcccgagcctagctctggacacatcagtgattctccacccaacaatgactgtcgggatccttaacgtagaggccatctgtgttggcctctgcagtgtcatcaaaggagccacaccaggctcctttgaactctcttaggtactgcacttgcccctgctccaagcagaatgttcttatcctttgtttcgtcctctctccccctccctcttcctcttgcccaaccttctgtctcagtttagcagtcacatcctcagacaacccttttcccattcccccaactaggtgagaacctcctgttaggtactcctgtcacaatggatcctacttgtttttgtttgtttgtttgtttttttgagacaaagttactctgtcacccaggctggagtgcagtagtgcagtctcagctcactgcaacctctgcctcccaggttcaagaaattctcctgcctcagcctcccgagtagctgggactacaggcatgcaccaccacacccagctaatttttgtatttttagtagagacggagttttgccatgttggtcttgaactcctgaccaaaggtgatctgcctgcctcagcctcgaaaagtgctgggattacagatgtgagccaccacgcccagctgatcctcctccttctttttttttttttttcaagacagggtctcactctgttgcccagacgggattgtggtggtgtgatcacggcttactgcagccccacctcccagcctcaagtgattctcccacctcagcctcctgagttgctggggccacaggcatgtgccaccacacctggctagtttaagaatttttttttttttttagagatggggtctcactatgttgtccaggctggtcttgaacccccagcctcaagcaatcccccctaccttggcctcctgaatagctgggactataggtgtataccaccatgcccagctaatttgtattacagggtcttgctatgtggtccaggctggtcttgaattcctgggatcaagtgatcctcctgcctaggcctccccaagtgctgagattgcaggcatgagtcactatgcatggccctgagatcttttatagtgctcttgcatcttgcaattctttctgcaagtgtctgcattccatgctagactataaccttcatgaaggcaggttttgtttaccacagttatttccagtgcctgggacatagtaggtgctcagtaattatttgctaaataagcaaatgaactggcagctgttttacagcccatgtggtatgtatatggctcagataacgttgtattcaagattttattctctgcccacatttcactacacatttttttttttttttgagatggagtcttattctgtagcccaggctggagtgcagtggtgcaatcttggctcacttcaacctccgcctcccgggttcaagtgattctcctgcctcagcctcccaagtagctgggattacaggtgcctgccaccattcccaggtaatttttgtatttttagtagagatggggtttcaccatgttggccaggctggtctcaaactcctgacctcaggtgatccacctacctcggcctcccaaagtgttgggattacaggcgtgagctactgcgcccagccaactatacatttttgaagccctcctgatcacttccttggttactctcatctttgtttgaagttcaatatattactttttttttttttttttttttttttttggagacagagtctcactctgtcccccaggctggagtgcaatggcatgattccggctcactgcaacctctgcctcccaggttcaagtgattcttttgcctcagtctcccgagtagctgggattacaggtgtgcaccaccatgcctggctaattattattattattattattttagacagagtctcgctctgtcacccaggctggagtgcaatggcatgatttcagctcactgcagcctccgcctcctgggttcaagcgactctcctacctcagccccctgagtagctgggactatagatgtgcaccaccatgcctgactaatttttgtatttttagcagaaacagggtttcaccatgttggccaggcttctcttgaactcctgaccttaggtgatccacctgcctcggcctcctaaagtgctgggattacaggtgtgagccaccactcttggccaattttttttttttttttttttttttttagtagagatggggtcttgccattgttggccgggctggtcttgaactcctggcctcaagtgatccacccgcctcggcctcccaaagtcctgggattacaggcgtgagccaccacgcctggctagatatgttgtatttaagattttattctcctctgcgcactatatttcactatacagttttgaagcattcctgatcatttacatgattactgtcatctttgcttgaaggtatgttaaaaaagagtttaattcattatattactttgtggtcattcatctaaaatagagttatgttacccttgtgtgttattgattcttcccagcaggatgcctggtttgcttttatgtgaaccaacagagctttacaacatcctgaatcaggccacaaaactctccagattaacagaccccaactatctctgtttattgggtaagtacttggaaaaaagcggaggaggtcaaacacagtgtccttcaaacattatttttgatgagttaacaaacttttggcggggtggggggcagtgaatgactttagaacagggatccctgggctgggtgtggtggcacacgcctgtaatcccagcacttgggaaggccaaggtgggcgaatcacttgaagccaggagatcaagaccagccaggccaacagggcaaaaccccatctctactaaaaatacaaaaaaattagctgcagtggtgcatgcctgtaatcccagctactcaggaggctgaggcatgagaattgcttgaacctggaaggtggaggttggagtgagccgagatttgggccactgcattccagcctgggtgacagagtgagaccctgtctcaaaaaagaaaaaaaaaaataaaaaagaagtccgcaacccccaacccccagtaccagtctgtggtctgttaggaaccaggcagcacagcaggaggtgagcagcaggtgagcaggtgaagcagaagcttcatctgtatttacagccactccccatcgcttgcattaccgcctgagctccacctgctgtcagatcagcagcagcattagattctcacaggagcgcaaaccctactgtgaagtgtgcattcaagggatctaagttgcgctctccttgtgagaatctaatgcctgatgatctgtcactatctcctgtcacccccagaagggaccgtctagtcacaggaaaacaagttcagggtttccactgattctacatgatggtagaattatttcattatatattacaatgtaataataatagaaatgcacaaaaaatgtaatgggcttgagtcatccccaaaccatccccgccccccagcccactgccctgttccgtggaaaaattgtcttccatgaaaccagtccctggtgccaaaaagattggggatcgctgctttagaaagctgttaagaggccaggtgtggtggcttgtgcctgtaatcccagtgttttgggaggccgaggtgggcggatcaactgaggtcaggagtttgagaccagcctggccaacatggtgaaaccccgtctctactaaaaatacaaaaattagccgggtgtggtggcatgtgcctgtggtcccagctactagggaggctgaggcaggaaaatcgcttgaacccaggagacggagattgcagtgagccgagatcatgccactgcactccaacctggatggggatttagtgtgagctcacttcaaatttgatttcttccttccccttaccatttttatttatttatgagacagaatcttgttctgttgcccaggctggagtgcaatggtgtgatcttggcttgctgcaacctcagcctccagatttaagtgattctccttcagcctcgtgagtagctgggactacaggcgctgccaccacgcccggctaatttttgtatttttagtagagatgggatttcgccgtgttggccaggctggtcttgaactcctggctcaagtgatccacctgcctcggccttccaaagtgctggggttacaggtgcatgccaccgcgcccagccccacatctcaagttttaaactgacaatgactatcccttaactgccaaacaaatagacgttgatgacgacgtaggtcctctgagtagtttggtcgtatgttcctttgcaaattcagttcttaaatacgtttcctttccagatgtccgttccaaatgggagtatgacgaaagccatgtgatcactgcccttcgagtgaagaaggtacatgggcagcgtcaggatctggggcaggctggctaccttgcagtggggtggggaagagtgggaagtttcaccctcaatccagcgggcagcagaagcaggactgttttctatgtgcccaccgtggtggtcttccacacctctcaccctcacacattttctcaggtgtcctcccatcccccaagaatggtcaacaactccattagacaaatactgatttaatttttgagaccgggtctcgctctgtcatccaggctggagtgcagtggcacaatcatagctcactgcggccttaaactcctgggcttggctgggcatggtggttcatgcctgcagtcccagcactttgtgaggctgagacgggcagatcacctgaggtcaggagttcaagaccagactggccaacatggtgaaaccccatctctattaaaaatacaaaaattagccaggtgtggtggcttacgcctgagtcccagctactcaggaggctgagacatgagaatcgcttggacctgggaggcggagtttgtagtgagctgagatcacgccactgtactctagcctgggcaacagagtgagtgttggtctaaaaaatatatatatatctcctgggctcgagcaatcctacgccgctcagcctccagagtagctgagactacaatggggaatgccaccaggcctggctaatttttgtattttttatagaaatggggttgcactgtgttgcccaggctgctcttgaactcctggactcaagccatcctcctgccttagcctcccaaagcgctgggattacacatgtgagccgcctaagcctggccaaatattgatttaattccttgatatgccaggtattgttccagaccctggggatacaacagaatacaacagcctgagttcattgtccctgccgttgtggagctttctttttttgttgtttttaattattttttctgtttttatgtgttgtttttatatatttttttcatttttatctttatttttggagctttatgttgtaaatttttagggacagggtcttgctctgtcacccgggcaggggtgcagtggcacaatcatggcttgaactcctgggttcaatcaaccctcctatctcagcctcctgagtagctgggactgcagacttgtgccaacatgctaattttttttttttaaagacaggatcttattatgttgcccaggctgtcatggaccttctcttctatttagcaaacagacaataaaccctagagataattggctataatccaaagatggaagcatctcccttttttccttcccatcccctcccctcttccattcccctcctgtcccctcttcccttccccatcctgaggagtggacagagccctgcacacagtcaccatgtcccctactgcagcgaaaccttttccccacgcctccagggtgtcttctccctcatgattgtgaagcctggcagcctttgcccaggacccgtctctcccctctgcagtcctgatcaaattctctgccctgaacttggaggttctctttgactttcctggtttcttttctttattctttttttttttcttttgagacagaatctctccctgtcacccaggctggagtgcagtggcacaatttcggctcactgcaacctctgcctcccaggttcaaatgattctcctgcctcagcctccagcctgtagctgggattacaggcgtgcgccaccacacctggctaattttttcttatctttttttgtatctttagtagagacagggtttcaccatgttggccaggctggtctggaactcctgacctcgttatctgcctgtcttagccacccaaagtgctgggattgcaggcgtgagcctggcctcctggtttattttctatctctttggttcaccttcattttctccttctgccacctgaatgtaactgctggtctgtccttgatctccacatctgtcagggtactttcttgccagagatttcactggagcttacagctgcaatgacatatccacatgcaattagcattcctggcaagtttacatctaaaattttgggcggggcatggaggcttactcctgtaatcctagcactttggttggccgaagcaggaggattgcttgagtccaggagttcaagaccagcctgggcaacatagcaagacccctgtctctacaaaaaaattgaaaaattaactcagtgtggtggggcacctctgtagtaccagctacttgggaggccgagatgggaggatcacttgagtccaggaggctgattgcaccactgcactccagcctgggcgacagagcaagaccctgtctcaaaagtaataaaataaaactttgtcttctaaaattcccctttcctccccattcccgctgtacttttccacaccctgtctctgctgctttttttttttttttttttttttttttttttttttttggagacagagtcttgctctgtcctccaggctggagtgcagtggtgcaatctcagctcgctgcacgctccacctcccgggttaacgccattatcctgcctcagcctcccgagtagctgggactataggcgcccgccaccatgcctggctaattttttgtattcgtagtagagacggggtttcaccgtgttagccaggatgctctcgatcttctgatctcatgatccgcccacctcagcctcccaaagtgctggaattacaggcgtgagccaccgcgcccggcctctgtgctgctttttctgcacataactcaataactcagcagggagcatgggcaggctgtatttttccaggatatttccccgtacaaatccatcattattgtctttttgtctttttgtgtttttgagacagaatcttgctctgtctgtctgcccggtgcagtggtacaatctcagctcactgcaacctccatctcccaagttcaagggattctcctgcctcagcctccctcgtagctggggttacaggcacccgccaccacacctggctaatttttatatttttagtagagatggagtttcgccatgttggccaggctggtcttgaactcctgacctcaggtgatccacccgccttgaccttccaaagtgctgggattacaggcatgagccaccacaccaggcccataatcttactcttaatccccattgcaggccttttgctgcaaccgattcagagcccctcatgatgtatgggcctctattcccactcagctctcaagtctgtgcatttctttgattctggcagcacctcctgctctgggcctctgcccctcagcgtctccaattcagactgatagctttttttttttaatttttatttttattttttgagacaaagtcttgctcttgtcgcccaggctggagtgcagtggcgcactcttggctcttgccttccctctctagcttcccagttagcagattgaggccttcagggcattcccagccctagcaggacagaaaggctcccagccccacccccctcccgcccgtgttctcagccttcttagatctgaccacctctgtctccagcctcattcccagtacacttccactctcacctgacaccttagcagcactgtgctgccatgtttccttctatgatgcacatgtatcccatactgtaacttttttttgaaaacagaatatgtcgtactgttgaatttttttttttttttttttttgagacagagtctcactctgtcgcccaggctggagtgcagtggtacgatcttggctcactgcaacctccgcttcccaggttcaggcaattcttctgcctcagtctcccaagtagctgggactacaggcgcataccaccacacctggctaatttttgcatttttagtagagatggagtttcaccatattggtcaggctggtctcaaactcctgaccttgtgatccgcctgccttggcctcccaaagtgctgggattacaagtgtgagccaccgcacctggccaatttgtatggcttttttttgttttgttttttttgttttgttgttttgttttgagacagggtctcactctctcgcttaggctggagtgcaatggcaccatcacagctcactgcagccttaaactcccaggatcaagcagtcctcccaccttacccttcccagtagctgggaccataggtgtgcaccaccacacccagctaacttgtattttttgtagagatggggtctcgctatgttacccaggctggtcttgaacgcctgggctcaagcagtcctccctcctcagcctcccatagtgctgggatgacaggcatgagccaccaggcctggcctgatttgtacttttaatatggtagtgtctttttccctaaaagtgggtgtggtgaatatcggttgtttttctgcccaacacctccccctttttgaggggaacgtctcctctctctgctcaaaccatgggtttctagtggtgctctctaaagtaatattctggccaggcacggtggcttaagtctgtaatcccaacactttgggaggccgaggtggggagtttgcttgagctcaagagtttgagacgagcctggacaacacagtgggacctgagaaggcatctgtttactgccttctttttaagtggtggtggtgttcttgttgttttgagacagtttcactctgttgcccaggcttgagtgcagtgacgcgatctcggctcactgcaacctctgcctcccgggttcaagccattctcctgcctcagcctctttggtagctggtactataggcgtgtgccaccacacctggctaatttttgtatttttagtagagatgaggtttcaccatgttggccaggctgatctcgaactgacctcaggtgatccgcccaccttggcctcccaaagtgctgggattacagacatgagcctccgcgcccggccttgttggtttgagacaagtcttgctgtcacccaggctggagcgcagtgatgcaatcatagctcactgcagcctccacctcccagactcaagtgatcctctcacctcagactcccgagtagctgggactacatgtgcaccctcccacacccggctttttttgtctctacaaatatatctatatatatagatataaatatataaattagccaagtatggtggtgcatgcccgtggtcccagctactcaggaggctgaagtgcgaagatcatttgagcccaggaattcaaggctgcagtgagcggtgactgcaccactgcagtccagcctgggcaacagagtgagaccctgtctctaaaataaaataatatccagaacgctggccacagtgattggtcctgggtctgggatgaaagctgagccaatcagaattggaattagaagaaaggtgtctctgtccagcctggtggtggaattgggaagatgggagtctgagcattgctggggttcgtgacttaagcctctggaggaagctgtctgagaaggggaagtcagtgtggaggggtggagtgggaagcagagaggaagagagcccgaaggaagtctgggctttagggtctctgggtcctaaagccagctgctttaggtttggaaaccggctgcatctttgccttaccctggagtgttacctgccagtaagtccctcttttgtgcacactcctggttaaattgttagtacatcttatgatccatgaggttttttgtttgtttgtttgttttgttttgtttttgttttatttttgtttttttgggacatagtctcactctgttacccaggctggagtgcagtggtgcaatcatagctcactgcagctttgaactccagggctcaagcgatcctcccacctcagcctcccaggtagctgggattataggcatgagccaccatggccagccacatttgatcttctagtctatctcattccttctgctcactcatgacttctgcttctacacactgtctacttactgtccttttttggggtgttttttgtcttgttgttgttgttttgggacagggtcttgctctgtcacccagactggagtgcagtgacacaatcgcagctcactgcagcctccgcctcctgggctcaagtgatccgtccacttcagcctcctgagtagtagggactacaggcgcatgccactatgcctggcatttttgtatttttttttttttcatagagtcggggatcttgctgttgtccaggctggtctggaactcctggcctcaagcaatcctcctgccttggcctcctgaagtgctgggattacaggtgcaaaccactgcatccagtctggtatttctggattcaatctccactgccaaacactctccccatgagaaaggatatcactaattcaattgaccatggtttctctgacaccagggtacctaataggctgtggatcagtcagcagaccagctgttctttggtcaggcacttctctctggtccagtcagctgtggtcagcttttctcagaagggaacacagttgtggaggatccttgggatttaacagactctccatccactgtctcagtgcttctgggcctgtgtgtatagtcaggggagagagtgcggtcttagctcctcccagtgctgctatgcagggagtctctgctcaaccgaacctgcccaccaacaggcctctcttgtgtgtgtgtgtttttttttttaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaaggtgggttttatgcaacagcagcaagaataatagttaacggctattgaacaaatttgttataggaccaacaggttcatatgcccatggcacgggaacaggccaatgacactgagacagcagggtttgcgtcagaaaaagagcttcatgatcactggataccgagcaaggagatgggaggaggccctcaaatacatttccccaaggagtttggaatggggtttttaaggggattggggagggtgagggactggaaagttggggtcattgattggttgaggaaagggggatgaaataatcaggacgtggaaactgcgttctttggtgagtcagctcctgtggggcccgtcagaccagctgatgtcagtggtttcatcagtacgcgggacctgaaagaatatctcaaagggaaaacagtgttccatgatgttcaagttgtcacctacagagcagttaaggggaactatattcttggccgggcgcggtggctcatgcctgtaatcccagcactttgggaggccgaggcgggcggatcacaaggtcaggagattgagaccatcttggctaacacggtgaaactccgtctctactaaatacacaaaaaattagccgggcatggtggcaggcgcctgtagtccctgctagctacttgggaggctgaggcaggagaatggcgtgaacccaggaggcagagcttgcagtgagcggagatcacgccactgcactccagcctgggcgacagagcgagactccttctcaaaaaaaaaaaaaaattcttgtaacagggtcttatgtgattctaggacaatacacatcaaacagctgtgagcaagcaggttggagagcaagcaaggtgacttagtgatgaatgctgaatgtgctgcaagcttgctttattttcatttgttcccctcccttctttgctgatttcacaaagtttatggggacagttccatgtgtgccatgcaccaggaaccaagggctttacttggatctgcagaacagcttacaaggacgctaactaacatcaagagctgtgaggaagccaggcccagtgactcatacctgtagtcccagcacttggggaggctgaggcaggaggatcacttgagcccaggagttcaagaccagcctgggtgatatggcaagataaggtacccagctcatttatttactttttgtaaagactgggtcttgctgtgttgcctgagacttaagcttttaaaagtgttgtggacatatttttaaaccaccacacctataagtggtggggccaggattcaaacccaggcctttttggctctgtcctgtcccccagggattgggtagtggcacgagagcatgcagccccaagtcagaacattaaagcgtggtcagttccaatgtgctccatcgaacctctgaggctctgctgtgttcttcattagcccctggttttgggctgaccaccctttgccattggcactgggagctctgcttctaggaatcagaactgcacctgtgggtgccgttccagaagctgggggcactcacaccaactgccacggggtggcgctatgctcccacctttcataaaaccagctgtctggacttttgtcccaggaggtccttggccaggaaattgtcccttcttccctaagctcatcctgttgggctctggtctgcaatcctaggactgtaggctaggccttgaaaccctaggagatggtactcaacatggataatcccctttacattctataactgaccttactttgctatggggcccccattcacaggaaaccacaaccacacaacttgtgcattcaaggcaacttttcttgtttcaaatggcatctttcaggtcaatgaaaagtctttgggggtacaagaccatctcaaggcttctctcaacacccccttctttctttttttttttttttttttgagtcagggtctcgctttgttgcccaggctggtctcgaactcttggcttcaagcaattctcttgcattggcctctcaaagtgcatggattacaggcatgagccaccatgcctggcctgaactctgacttctgagccaggccctgtggggtgagctttggctcctgtcttgagagctgcagattctctctcagcctggctgcagattccagattcttcctgtcaatgccatctctcagataggtcccagccacttatatcctccacagccccttctggaagtgtctttgtctccctgaacaaaaattcaatatggaagcagagttagccaggcacggtgcctcacactcgtaatcccagcactttgtgaggctgaggcaggagggttgcttgaagccaggagtttgagaccaccctgggcaacatagcaaggccccgtctctaccaaaaatacaaaaaaaaaaatttagccaggcatggtggtgcatgcctgtagcaccagctactcaggaggctgaggcaggaggatcacttgagcccaggtggtcaaggctgcagtgagctatgactgtaccactgtattctagcctggctgacagcgtaagaccctgtctctaaaaaaaacgtatttaaaaaaaaaaaaaaaagaaaaaaacagttagagttcatgctgttttctttctccttttatctggctctctgaagtctgccacacactatttctctttctgggccagaacctggcctcaggatatcttggtttaaggatgtcttggcttagccttaattatgcaaacttcctgtcacatatatctaatttacatgcagtctgattgtgattctgcagatcaatgaaggtgtttaagattaaattgatgtcaaaaccacattgagatattattcacgcccactgggatggtaataatcaaagagacagatgataataagtgttggtgagaacatggagaaattggaagcctcatacactgcgaaccagaaagtaaaatggtgcagtcactggaaaacagtgtggtgtttctttagaaggttaagatatagaccccaaagtaatgaaaacacatccacaccaaagcttttacatgaatgttcatagcagtgttattcataatagccaaaaagcacgaacaacctaagtgtctatcagcagctaaacaggtagaacagaatgtggtctgtccacacaatggaatattactcagccataaaaaggaatggggctgggcgctgtggctaataatgcctgtaatcccagcactttggaaggccaaggcgggaggatcacctgaggtcaggagttcaagaccagcctggccaatgtggtgaaaccccatctctattaaaaatacaaaaattagctgggcgtggtggcatgtgcctgtaatcccagctactagggaggctgaggtaggagaatcacttgaacctgggaggcagaggttgcagtgagccgagtttgtgctattgtactctagcctggacaacagagtgaaactcggtctcaaaaaaaaaaaaataaaagtactgacatgtgctataatgtagatgaacactaaagagatcatggtaagtgatagaagttagatgcaaaacatcacatattattccatttatatgaaaagtccagaataggcaaatccatagaaatgagtggttaagtggagctgggagtttggggaaaaacgggtgtggctgattagtggtacagggtcccttgtaggggtgatgaaaatgttctaaaattaggccgggcactgtcgctcacacctgtagtcccagcactttgaggggctgaggtgggaggattgcttgagcccaggagtcgagaccagtctgggcaacatagtgagactctgtctcaaataaatactaaaaatagaagaaaacattctaaaattgattgtgggggatggttgcataactctgaatatactaaaagtcactgaattgtatattgaacccatcacccaggtagtgagcatagaacccaataggtagtaggtagtttttcttttttcttctgtcttgcctttttttttttttttgagatggagttttgctcttgttgcccaggttggagtgcaatggtgtgatcttggctcactgcagtctctgcttcccctcagcttcccaagtagctgggaatacaggtgcgcaccaccccacccggctatttttttgtattttcagtacagacagggtttcgccatcttggccaggctggtctcaaactcctggcctcagatgatgcacccgccttggcctcccaaagtattgggattacaggtgtgagccatcgcgcctggccccagtaggtagtttttcaacccctgtccctctctctctgtcctcctcgtattcttcagggtgtgttgttccgcatctttatttctatatgcttctgatgtttagcttgcacttataaatgagaacatgtggtatctggttttctatatctgtgttagttcgtttaggatgatggcctccagctccatccatggtgctgcagaggacatgattttgttctttttttatagctgtgtagtattctgtggtatatgttaaccacatttaaaaaatccaatctggggccgggcacggtggctcatgcctgtaatcctagcactttggggggccaaggcgggtggatcacttgaggtcagcagtttgagaccagcctggctaacatagtgaaaccccgtctctactaaaaatacaaaaattagctgggcatggtggtgcatgcctgtaatcctagctactcgagaggctgaggcaggagaattgattgaacccagggaggtggaggttgcagtgcgccgagatcgtgccattgcactccagcctgggcgacaagagcgagactccatctaaaaaaaaattaaataaataaataaataaatacaatccgttgttgatgggcccttgagttgattctatgtctttgctgttgtcagtagtgctgcagtgaacatatgggtgcaggtatccttttggtgtaacaatatattttcttttggatgtgtacatagtaatgggattgctgggttgaatggtagttctatttttggttccttgacaaatctcaaactcctttccacaggggctgaactactttacattcccaccaacagtatgtaagtgttccttttctccatagccctgtcaacatctattattttttggctttctaataaaagccattctgactgatgtgagaaggttatctcattgtggttttgatttgcatttctctgatgattagtgatgtcaagcattttttcacgttcgttggctgcttgtatgtcttttgaaaagtgtctgtttatgtcctttgcccactttttaatagagttgtgtattagagttctctagagggacagaactaataggagatatatatatgtgtgtgtgtttttatatatatacgtgtatatatatgcgtatatatgtatatatgtgtatatatgcgtatatatgtatatatgtgtatacgtatagatatacgtatatatacacacatacgtatatacgctatatatgtgcacacatacgtatagatatacgtgtatatatacacacatatgtatagatatacgtgtatatatacacatgtatgtatagatatacatatatacacacatacatatagatatacgtatatctatacacacataattatatatatgtatccctatacatgtacatatgtatagatatacatatatctataaatgtacatatgtatatacttatatctatacatgtacatatgtatagatatatgtgtgtgtatatatatgcgtgtatatgtagatacatgtgtatctatatatatgggagtttgttaaggagtattaactcgtgtgatcacaaggtcccacaataggctgtctgcaagctgaggagcaaggaagccagtgtgagtcccaaagctgaagaacttggagtccaatgtttgaggacaggaagcatccagcaagggagaaagatgtaggctgggaggctaggccagtctagtgttttcatgtatttctggttgctttatgttgtagctgtactggcagctgattagatggtgcccactcagattgagggtgggtctgcctctcccagtccactgactcaaatgttaatctcctttggcaacaccctcacagacacgcccaggatcagtactttgcatccttcaacccaatcaagttgacactcagtattaaccatcagaggttgtttggtttttgcttcttgatttcagttccttatagattttggatattggatctttgttggatgcatagcttgtggatactttctcccattctgcaggctgtttgtttactctggtagtttttcttgctgtgcagaagcactttcgtgtccttaggtcccacttgtcaatttttgttttgttgcaattgctttggaggacttagccaaaaattatttgccaaggccaatgtcaagaagggtattccctagattttcttctaggatttctatagttttcaggtgttacatttaagtctttaatctatcttgagttgatttttgtatatggtgataggggtccagtttcattcttctgcatatggatagccagttatcttagtaccatttattgaccaataagtgggagtcctttcccctttcctgttctttgagacaaggtcttgttctgtctccaaggctgtagtgcagtggcacgaccattgctcactacagcctcaacctccctggctcaggtgatcctcctgcctcagcctctctagtagctggaactgcaggtgcccgccaccacactcaactaattttttgaattttatttgtggaggcggggtctttccatgttgcctaggttggtctcaaactcctgggctcaggcaattctcctgcctctgcctcccaaggttctgggattatagatgtaaaccaccatccccagcctccattgcttatttttgtcaactttgttgaagatcagatggttataggtgtgtggctttatttctgggttatctattttgttccattggtctatatgttttgaattgcacactttaaatgggtgaattgtgtgatacacaacatacagttgacatatatatgtggtataaatataatatatacatgtatataatatgtaaaccatatgtatgcatatgagtggttaacgagctggcagtttctgtaaactctgagatatatgtattgtatgacatcatacaatacatatatctcagagtttgcagaaaagaagattaacttaggctgagcacacctgtaatctcagcactctgggaggctgaggcaggtagattgcttgagctcaggagttcaagacaagcctgggcaaaaaagtgagacactgtctctacaaaacaatacaaaatttagccaggtgtggtggtgcgcacctatagtcccagctactcgggaggctgaggtgggaggatggtgtgagcccaggagctggaggttgcagtgagccgagattgtaccactgcactccagccagatggagtgaagcccagtctcaaaaacaaaaacaaaaaaaacccggtggtaagctacttttaaaattttaatatgatgcatctctatacttgcttcagcttcctaaataattgcatttcaagccgggcatggtggctcacgcctgtaatctcagcactttgggaggccgaggctgaaggatcacctgagctgaggagttcaaaaccaggctggcaaacatggtgaaaccctgtctatactaaaaataaaaaattagccaggcatggtgggcgcctgtagtcccagctacttgggaggctgaggcaggagaatcgcttgaacccaggaggcagaggttgcagtgagccgagatcgcaccactgcactccagcctgggcgacagagtgagactctgtctcagaaaataaataaaataattgcatttcagaagaaagtggtcatctatcccagctctagaccaatggcagatacacaggagacattcatgtctttggtctccactctcagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggtagggccaaatgctgagcacaggcaggcccagacgggaaggatgggcctagaaactgacttgtgggtgactgagtgggagaaacaggaggatgggacagaggatatagagaaagtggaggagattctgtctatactaaaaacacaaaaattagctgggcgtggtggtgcgtgcccatagtcgtagctactagggaagctgaggcagaagaattgcttgaacccaggaggcagaggttgcagtgagccaagatcatgccactgtactccagcctggatgacagagtaagactgtctcaaacaaaaacaaaaacaaaaacaaacaaaaaaaaaactagatctggactcctggcagccctaagttcatgtctgcagcccagtctcccccatctcctccacttttttttttttttttttgagacggagtctcgctctgtcgcccaggctggagtgcagtggtgccatcttggctcactgcaagctctgcctcccaggttcacgccattctcctgcctcggcctcccaagtaggtgggactacaggcgcccaccagcacgcccggctaattttttgtatttttagtagagacagggtttcaccctgttagccaggatggtctcgatctcctgacctcaagtgatccacctgcctcggctttccaaagtgctgggatcacaggcgtgagccatcctgcccggccacagttctttataaggaactgatggctgtcgggttgaaacagtgagcaaaggtggacccattcagagggcaggctggatggtggaccgataccaaggtcagaaaggcaggggcatggcggctcgagaccacctcttttttcttggctgtctgattccacaaatcctagctggatccagaggatacaaaaatacacaaaagtgggaaggattggtcaggcacggtggctcacgcctataagcctagcacttggggaggccaaggcaggaggattgctttagctcagtactttgagaccggcctgagcaatatagtgagaccttgtctctacaaaaaaatcaataaatggagctggctgtggtggctcacgcctataatcccagcacttttggaggccaagctggatggatcacttgagctcaggagtttgagcccagcctaagcaacatggcaaaaccctgactaccaaaaatacagaaattcaccgggcatagtggcccacctgtcttgtagtcccagttactcaggagggtgaggcaggagaattacttgaacccaggaggaggaggttgcagggagccgagatcacaccactgcactccagcctgtgtgacagagtgagaccctggctcaaaaaaataatttagaaaagagatgggtggattgcttgagcccaggaggtcgaggctgcagtgagccgttgccatgccactgtactccagcctggttgacgaagcaagaccctgtctccaaaaaaaacaaaaagaaaatcagccaggtgtggcgactcacacctgtagttttagcactctgggaggccaaggcaggaggattgcttgatctcaggagttcaagaccagcctgggcagtatagtgagacccccatctctattataattcttttttagtagagacagggtttcaccatgttggtcaggctggtctccagctcctgacctcaagtgatccacctgcctcagcctcccaaagtgctgggattagaggcgtgagccactgcactcagcctattttttaatacaaaaagagaatcagatattaaacccctttgtccatcacctagctccaaacattgtcaactcatggtcagttttgtcaaaacaaaacaattttgagattccagtttctgctgatgactggtcctgtctgtaggggaggcagtggctggaagctggactgtgtcaagggacgccccgggtatctggagcccagagaaggggcacttgagcttcccagagccaaatctgacggaggaggagatttcgaggaagagaactgggtggagttgtctaaggctagcaccagactatgcagagatttgcaggcagggcctggtccctggagagtgccgtgtacagatgtctggcttattgaagcgtctgaacacaatggaatgtaaacagaaagtggttttaactttttctaacagttgccttcagctgtgttccccttcctgcccttagcaacatcgtgagcagattccatactttctggccacttttggttacaaaaaacttcaatcgaaatcatagtatagaatgactgggcaaatgtgactattcacaggatgtttgactgtgtttaggaattgttgcttttcgaaggttgtagtgacattgttatggttattataaagtacaagtccttatcttttagaaatacagaacaaaatatttacgggtgaaatgacgtgatgtctggaatttcctttcaaataatctggggtgaggtgagaaggcagtgagggtatagaggaaacaaaattggccaatgagttgttaatgtttgaagttgggcgatatatacgttttagagacagggtctcactctgttgcccaggctggagtgcagtggtgcaatcatagctcactgcagcctccacctcctgggcttggtatcctccagcctcagcctcttgagtaggtgggactacagatgcatgccaccacagtcagctaagttttaaaattttttgcagatacagggtcttgctatgttccccaggctggtccaaaactcctgaccttaagcaatcctcctgccttggcctctcaaagtactggaattataggcatgaaccaccacacctggccaactagtgtatagttttgaaataatgttaaaggaagtaaaaagacagtctagtagaagctagggcggtttaatgttccaacctcaaatctgaatcaagtctcatctcttcccatgccctagagctgggcagcctagggtttgctgggggcactcaaagtagggagggatgggggttagctttaaggacagctgctctcttcccctcttctgggcagagtacctttggcagtagggcccagagtggacctgtctgtgtgcctggctgcgtgttagtggtgggaaagtgcctgctctctggccccgtctggctgtgtgagctgctggtagcctctgctgctgggtttctcgggacccagctcagcctcaccctggctccttctggggctgaggatctcccagagaacgcagccagtggtgactcccttcaacccctgccaggcatctcctccaacttcctccccttaacttggaagcccatgacccgtcccctgccccgcatgcccacattccttcaccggaatcgtagaaggcagggactcatgcctgaggtcagacatgttcccagatccagggtatgcatgcctggctcccaaagacatccctttcttccactgagataacagcactgtgaatttcagctcaacaggtgtacagtcagttaaataaaggaagtaaagacaatcagtctagtataagccagggcagtttaatgttccagcctcaaatctgaatcaagtcttatcttgattggaactcctccttgctcctccttgctcttggaggagcaccctggctttgcagggtgcagagagattaatttcttctctgcaaaccctacgctgctgataactcatcactgccacctcctcatttctgaagctttagtaaggtgtaattgacatgatgaactgcacatatttaaaaggcccggtatggtccgttttgacagttgcatattcctgaaacttgcctttgctcctagtctagtcacattgggaagaaggcgcagggttgtggctagggtagctgtgagggttggattgggttacttgtttgcagctgtctttagaatgtaggtgactggccagctgtggtggcttaagcttggaatcctagcactttgggaggtcaaagaggaggtggaaggatcacttgagtccaggagtttgagactagcctgggcaacatagtaagaccttgtttacacaaaaatttttttaaaaggctgggcttggaggctcacgcctgtaatcccagcattttgggaggccaaggcgggcggatcacgaggtcaagagatcaagaccattctggccaacatggtgaaaccccatctctactaaaaatacaaaaattagctgggtgtggtggcacatgcctgtaatcccagttactcaggaggctgaggcaggaaaatcaattgaacccgggaggcggaggttgcagtgagctgagtcacaccactgcactccagcctgggtgacagagtgagactccatctcaaaaaagaaaaaagaagaaagaaagatttaggaggtagcaccgatcagacatgagggcataggagagagagggggctgggatgatgccctggttttaggcgtgggtgacgggggctgtgatgtggttcattctggggaacactcgggagggggcggggtgggggaagaaggaggtggttttgggggaaggcagtgtgcccagttcgggcatattcatttgagatactggtttcgtttgcattgtgtcactgagcatttacacacattctacagtacagtgtgtttttatccacatcacaccctcttcccagccaaacccacacaaccgcagaaaaggaagctggtttaaaaacagcaggaagaggggttgatagatttgctatgggatttttgtggggttttttttgttttgttttgttttggtttttttttgagatagcatctctgttgcccaggctggagtacagtggtacaatctgggcttactgcaacctccacctcctgggttcaagtgattctcctgcctcagcctccagagtagctgagattacaggcgtgtgccaccacgcctaatttttatatttttagtagagatggggtttcactatgttggccaggctggtcttgaactcctgacctcaggtgatccacctgcctcagcttcccaaagtgctgggattacaagcatcagccaccatgcctggccttttagcgagatttttaagtggaaattgaaagggggatttcatttggcaccagcaagctgagcgtccatccgggttaggggcagcccacatgctggagtaaattgggcctgcccgcaggcagtggggggtcatgcatctccgtgtcacaggctggagaactggctcagcttggtgtctgttctttactaatggctttcgaagctggtagcttgggaaggatgtgggcttgcagagggttcactgccgtggggaagggagtgagatgtgctgagttcaggtggctctgaaggacccacacgcctgaggtccttaaaatgttatttctgagtcagacttagagccaggggacttttggaactgattttgatctttggcaaaggtcagcattttctgtggtgtaataatggagaaagtggtctctaatcagagcctcatggaaacatcaagttatccagttggagtggatttctctactgcagagcttctttgagatttttttttttttttttttttttttttttttgagatggagttttgctcttgttgcccgggctggagtgcaatggcacaatcttggctcactgcaggctccacctcctgggttcaagtgattctcctgccccagcctcccgagtagctgggattacaggcgtgcactgtcacacctggctaatttttgtatttttagtagagacagggtttcaccatgttggtcaggctggtctcaaactcctgacctcaagtgatccacccacctcagcctcccaaagtgctgggattataagcatgaggcactgtgcccggctatttttttttttttttttttgagagacaggctggagtgcagtgatgcggtcataactctctgtaacctcaaactcctgtgggatcctcccacttcagcctcctgagtagccgggagtacagccatgtgccaccatgcctggcgaattttttattttttgtagagacaagggtcttgctgtgttacccaggctggtcttgaactcctgggttcaagcgatcctcccaccttggcctcccaaagtgctgatatcacaggcatgagcagccactgtgcccaacttctttgaacctttgattgctaatgtacgtgttgtttccgagagaggaatcatagatacagctgtccgtttgtacagttgtccagtatccatggaggttggttccagggcccccaatagataccaaatccttggatcttcaactccctgatacaagatggtgtagtatttgcgtctaacctaagcgtatcgtctcgtatactttatttatttgagacagagtctcactctgttgccaggctggggtgcagtggcatgatctcatctcactgcaacctccacgtcccaggatcaagtgattctcctgcctcagcctcccgagtagctgggactacaggcatgcaccatcatgcctggctaatttttgtgtttttcgtggagatggggtttcactcgttggccaggttggtctcaagctcctcacctcaggtgatgcgcctgcctcggcctcccaaagtgatggggttacagatgtgagccacctcacctggcccctcttgtgtatactttaaatcatctctagattatttataatacctaatacaatgtacatgctatgtaaataattgttatactgtatcgtttagggaataatgacaagaaaaaaagtctgtacatgttctgtacagatgcaaccatgaattatttttctggatatttttcatccaaggttgcttgaatatatggatgtggaacacacagattgcatttggttatctgaacccctgaacccttttctcatagtgccttatgggggactagtgtttcttagaacacactttgggaaatgtagagataatccttgtctgtgtttcaaataaacgaaagttttttgttgttgttgttgttgttttgtttttttttttttttttttgagacggagtctcattctgtcgcccaggctggagtgcagtggcacaatctcagctcactgcaagctccgcctcccaggttcatgccattctcctgcctcagcctcccaagtagctgggattacaggtgcccgccaccatgcccggctaattttttgtattttttagaagagacgaggtttcaccgtgttagccaggatggtctcgatctcctgacctcgtgatccgcccacctcagcctcccaaagtgctgggattacaggcttgagccactgcgcccggcaaacgaaagttttaatgataactttggacctggaactcaggaagctcccatttaagtaggtgtcttgttctctctacccctctgcacatacactggcttcatttctgggcatgcagggtggctcacatgtgtatcccaacactttgggaggctgaggcaggaggatcactacaggccaggagttcgaggacagcttgggcaacatagtgagaccccatctctacaaaagataaaagtatcaaaattagctgagtatggtcatgcgcacctgtagtcccagctacctgggaggctgaggtaggagaagcatttgagcccaggaagataagactgcagcgagctatgattgagccacttgcactccagcctgggtgacagagtgagagaccctgtatctttaaaaaaagaaaagaaaagaaaaagatgggttgagcacagtggctcacgcctgtaatcctagcactttgggcagccgaggcaggtggattacttgaggtcaggagttcaagaccagcctggccaacatgatgaaacctcctctctcctcctccacctcctccctcctcctcctcctcctcctctctcctcctcctcctcctctctcctcctctctcttcctcctctctcctcctctctcttcctcctcctctctcttcctcctcctcctccttctctctctctctcgatgcttaaattctggtggtcttaagagagctgtccctctccatcctcctgagcccccagtacatgctgggttgttacagttctgggccacagcgtcctcactgcaacctttgtgcacctggccaagtgtaaacagttgccacggagggaatggacaccagtgctgagacccagcgctctgcacgatgaggctcagtcctttcgtcatgactcgccctgtgccaccccatgcaagttaccgtgtgccaatctctttcaaagtctggatctccgtcacattcactgtcctggaactgcccttttacgctcgtttgctgagctgtgtttcaagagatagacatccctcttccctgaggaatatgctcatagctgcctttctccctccacacttcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttgtaagtaaagagaaactactgatttatatttcattttattttttatataatatttaaatttattttatttattttttttaattttattattattacactttacgttttagggtacatgtgcacaatgggcaggtttgttacatatgtatacatgtgccatgttggtgtgctgcacccattaactcgtcatttagcattaggtatatctcctaatgctatcccttccctttagtttttattttattattattattttttgagacggagtctcactctgtcacccagactggagtgcagtggcacaatctcggctcactgcaagctccgcctcctgggttcacgccattctcctgcctcagcctccccagtagctgggactacaggcgcccgccaccacgcccagctagttttttgtatttttagtagagatggggtttcaccgtgttagccaggatggtctcgatcacctgaccttgtgatcatcccgccttggcctcccaaagtgctgggattacaggcatgagccaccgcgcctggcctattttattattttttgagatggggtcttgctctgtcacccaggctggagtgcagtggcacaatcttggctcactgcaacctccgcctccagggttaagtgattctcctgcctcagcctccccagtagctgggactaaaggtgtgtgccatcatacccggctaatttttgtagtttttagtagagacagggtttcaaaatgttgcctgggctggtctcgaactcctgacctcaagtgatctgcctgccttggcctcccaaagtgctgggtttacaggtgtgagccaccatgcttggccaagataggtacttaaaaaaatttttttggctgggtgtggtggctcacacctgtaatcccagcactttgagaggccaaggcgggtacataagctgaggttgggagtttgatgaccagcctggccaaaatggtgaaaccccatctctactaaaaatataaacattagccggttgtggtggcacatgcctgtaatcccagctacttgggaggctgaagcaggagaatcgcttgaacctgggaggtagaggttgcagtgagccgagatcgtgccactgcactccagcctgggcaacagagcgggaatctgtctcaaacaaacaaaaaaaaagacaagggtctcgctatgtgatcctcccatctctgtttcccaaattactgggcttattcatgagccaccacacccagcctggatgtttttttccaggagaggttgagttacctgtgcacattcccccttacacaagctcagcgtcctccctgtggcccttctgctgtgatgaaaaccccacaatggggatgcctgcattctgcattccacctgatgacctgtgtggtccttccgtgtagttttgcaggcgatgctgacaagcttctgcacatccggatagaagattccccggaagcccagattcttcccttcttacgccacatgtgtcacttcattggtaaggagcgttccttggccgggtagcaactggcctgtgtctgggaagcagaggggcagtggagcctccttcacaggcttattctggaccgtgatttccccatgctctagagagaaagggcccagctcggcatatgctccatctgggtgggacaagctccaggacacgtccaacttctggggagccctcagtgaaacgagcaaccgtggtgtttacctcgggggcagtggggcccaaggctctggccctggctagatggctgtgcccttctgggcttgttgtaaaatgagagtgatggctacccacaagtgcacatgctcatggaggctctgggctgagctctggggaccagtagtaaatctatctctctccatccccgccttcatccttggtctgtgggatgtcggtggaatggaaggaagactacaaagctctttcagttctgacttccaagattttctttgtttttgtttgttggttggttggtggagttggggtcttgctatgttgcctaggcaggtcttgaactcctggcctcaagcgatcttcctacctcagcctctcaaggtgctgggattataggcatgagccaccacacccaagtgatgcccaccagttacttaactcatcaagagtggattttttactcattcctggggctccagattgccagaggagagtaagatctgtagagagagcagggctgagtcaggtcagagtccccaccccatgcctgcctgtctggcaccaacagctcctggcctgagccactgtaccaggggctggagcatggcattttggcccaaccatcccttattttaaattttatttttcgagacggggtctggcttgttcacccaggctggagtgtagtggcacaatcttggctcactgcaatctctacttcctgggctcaagcaatcctcctacctcagcctcccaagtagctgggactacaggcatgcaccaccacgtccaactaatttttgcatttttagtaaagatggggttttgccatgttgcccaaactggtcttgaactcctgagctcaagcaatccacccacctcagcctcccaaagtactgggattacaggcgtgagccaccacacccagccccaaccatcctttatttgcccagtagatgtcaaatgttgctcaaccagggcctgaggctgagacttcccatgtgtcccacctcgagatggcagagccttgtggcccaaggagggaccccatctagcctgcctccctgggtagcactgagccagtcaataaattaaactgcatgctcagttcctttattcagatggtgaggaaggtggccatcgtcatctctgcgtccttcttcagccctggcagtctgtgattttgcacttggtaggcttatcttcagttcctgagggttgccagaccagcctcgggtgccagcttagatttcctctccctgggcaggactcacagcttcaggggtgctgtgattagagctgatatttctgtgccaggcactgggctcagcacagaacaaaaccaaactgtatgaagtaggtagtatactgtgatcccgttttccagatgaggacaccgtggcctcaagtaacttaccctccagcccgggcaacattgtgagaccccatctgtacaaaaaagttagctggatatggtggcacatgcctgtggtcccagctactcagaaggctaaggcggagggttacttgagcccaggagttcaaggttgcagtgagctgtgattacaccactgcgttccagcctgggcaacagagcaagacccagtctctaaaataaaataaataaaaataggctgggcacagtggttcttacctgtcattccagtactttgagaagccaaggtgggcagatcacccgaggtcaggagttcaagaccagcctgaacaacatagtgagactgcatgtctatattgaaaaaaaaaaaaaaaaaaaaaaaatcaggcgcagtggctcatgcctataatcccagcactttgggaggccaaggcaggcagatcacctgaggtctggagttggagaccagcctggccaacatggtgaaaccccatctctattaaaaatacaaaaaattagctgggcgtggtggcaggtgcttgtaatcccaggtactcgggaggttaagccaggagaatcacttgaacccaggaggcagaggttgcagtgaactgagattgtgccactgcactccagcctgggcaacaagagtgaaactctgtctcaacaaagaaagaaggaaaggagagagaggagtagagaggagaagaaaggggaaagaagagaggagatgggggaaggaaaggaaaggaagtaacttgcccaagccccacggccagtgagtggcagtcaggattggcactcaggctacactggctctgtcagctcctgactgtttttgggatgacgatggtcctgtccgccccatactgggaggccagttggtagcagagcttcctgggctagaaacctggagttcaggagaaggtctttgcctggtgatgctggttgcccaggcatgattctctggaacttccagccaggtctgagggatgcccacttgctagacaatgaaatgggctcccagagaaatcatgggacttgccgaggtcacgtgggctggttttgaactcatgcttggaccacgggcccatggaggccagtgtctgacagcaacccaggcccacagggaggagggccaggcatgacccaaccccccacttctttttgcagaaattcaccatcaccttggctctgtcattctgatcttttccacccaaggtatcagccgcagttgtgccgccatcatagcctacctcatgcatagtaacgagcagaccttgcaggtatgcgttccccgggccaggctcgcaccacggccaccccctgggaggtgaggtcagagcgcaacctgggaggagtggggccccagcactgctttgggaggaagaatcccagataactccaagtctagggtgctccccagtccgcgtcacccaagggcaaggccccagtgttgcatgcttgaggcctgaggctggatatgcagggctggcccagggactcaggccaggtcaggctgtcctgcagcccccactgctgtcaggccgtccacctgtgtttgtttggtgttgcccaagggagaactgcttggagtcccagagctgcagcacaggcgcccacccactcccgtctatctccctgtaccttgggcgcagggtccagagaagagagggaagcagggacccatcgcagcaaacccaggcggaactcggagctcctaactcacagcacctttctcgagggcctgccctgcctgtcacagcctgttcgtgatccccagagggcttgataggacctacaaagccccaacatttgcccagggatgtttttgggggaaggagagggacaaagaataaaactcgttggccagtggcttcggttgttgcccccatgtgcactttgggggtgaagttgtaggctagaaagtcctttttttttttttttttttttttttgagatggagtcttgttctgttgcccaggctggagtgcagtggtgcaatctccacctcctgggttcaagcgattcttgaacctccactgcaccctctgcctcctgggttcaagcgattctcctgtctctgcctcccgcgtagctgggattacaggtccgtgtcaccatgcccggctaatttttgtatttttagtagagacagggtttcaccatcttggccaggcgatgtgtggggtggtggtgggggatgggtggtttacgattcttcctccagggcctgttctgacccagcgaggacatagtaagccttttgactgcacagctctgcccctcacaccactttaaaaaaaattgtggttaaaatatacataacaggccgggcgcggtggctcacgcctgtaatcccagcattgtgggaggccgaggcgggcagatcacctgaggtcaggagttcaagaccagcctggccaacatagtgaaaccccctctactaaaaatacaaaaattagctgggcgtggtggtgcgtgcctgtaatcccagctactctggaggctgaggcaggagaatcgctagaagctgggaggcagaggcagcagtgagctgagattgcaccattgtactccagcctgggtgacaagagcgaaactctgtctcaaaaaaaaatatacacacacacacacacacacacacacacacacacacacacatacacacacacacacacacaacaaaaaaattaccatcttaactattttaaaatgtatagcttaggagcattaagtacattcacattattgtacaactaatctcccaaacttttccatcttgcaaacctgaaacagcaactctttactttcccctcttcatcgccccgtgggaaccaccattctactttttgtctctgtgaatttgactactctaggtaccttatataagttccttccttttaaggctgaataatattccattatatgtgtggaattcaccaataaacccatctaggctgggtgctttctgttttggaaggttactaattattgattcaatttattattgttattttatttatttatttttttttgagacggagtctcgctctgtcacccaggctggagtacagtagcacaatctcgactcactgcaagctctgcctcccgggctcatgccattcttctgcctcagcctcccgagtaactgggactacaggcatctgccaccactcaatttctttaatatatgtaggcctattcagattgtctgtttcttcttgtgtgagttttggcagtctgtgtctttcaaggaattgatcaatcacatttgtggatatgaatattcttctattatccttttaatgtctgtgggatctgtagcaatgtcttctctttcacttctgtattagtaatttgtgtcttctgtttaagttagcctggctagcggtgtatcgattttattgatcttttcaaagaaccggcttttggtttttttgattttctctattgatttcctgttttcaatttcattctttgcatggcgtatctagttttcctagcaccatttgttgaaatgactgtccttttcccccatcgaatggtcttggcatactatcaaaaattccttgacaggcccggtgcagtggctcacacctgtaatcccagcaggttgggaggcagaggtgggcagatcacctgaggtcaggagtttgagaccagcctggctgacatggcaaaacctcgtctctgctaaaaatacaaaaatgagccaggcgtggtggcacatgcctgtaatcccagttacttgggaggctgaggcacaaggatcacttgaacccaggaggcggaggttgcagtaagctgagattgcacaattgcactccagcctgggcaacagagtgagactcagtctcaaaaaaaaaaaaaattgcttgaccatataggtaagggtttatttctaggctaggctggctattctattccactagtctctttgtcttcatgtccataccatactgttttgattactgtagttttgttagactaaggtttgaaatcaggaagtgtgagacctacaactttgttcttcttaaatattttttatggggtcctttgagattccatatgaattttaggatggatttttctatttctacaaaaaatgttgttgggattttgatagggattgccttaaacctgtggattactttgagttgtattggcatcttaataatattaagctttccaacccatgaacacaggatgtcttttcatttgtttgtacctttaatttctttcagcactgttttggagttttcagtgtacaagtcttttgcctccttggttaaatattttattctttttgatgctactgtaaatggaattgttttcttaatttcctttttgaattgtttagtatatagacatgcaactaatttttgcatgttggttttgtatcctgcatccttgctgaatttattagctgtgtgtgtgtgttgtgtgtgtgtgtaatctttagggttttctacatatgaaatcatgtcatcttcaaaccagaggtaaggttacttcttcctatccattgtagatgccttttatttctttttcttgcctcattgttctggctaggacttctaggactatgttgaacagaagtgatgaaagcaagcacccttgccttgttcccgatcttagaggaaaaactttatctttcgccattgagtgtgatgttagctgtgggcttctcatatatggcctttatcaggttgacatcacttccttccttttttgtttttgagacagagtcttgctctgtcacccaggctggagtgcagtggtgcaatctcggctcactgcaacctccgcctcccaggttcaagcaattttcctgcctcagccacccaagtagctgggattacaggcatgtgccaccatacttggctaatttttgcatttttttagtagagacagggtttcgccacattggccaggctagtctcgaactcctgacctcaggtgatccacccgtctcggccccccaaagtgccaggattacaggcatgagccactgtgcctggccatttccttctgttcctagttttaggcaccactcttgcctttccctttttcgtttgtcctcaatccagatggagaccaggtgctcaccctccttcatgcagcaacacttcctgtactttaaggtggatgcctgaaggagggcagcttgaattttcttcttcagagaatttgcccacagttctcttcctctttccattaatttgtccagtcacaatgcaaacctttgttgagactgcactaggcttggcatagtgtttgccatccacaggtggtttcatgtatattgtcttaatcttcccagaagctgtttgaaataggaattatttctgtcaccagatttagaagcagaggggcttgcccaaggcagagtcagctcccatgactcccagcactgatgcattcatgccaggctgccctgtttctgcatccagcccttaagccgtgttgctggcactgtgcaagtgcctcctgtctctgaaagctgcctctgatccaagtggaaagggcccaggaccaatcgtgaagttcactttctctctttgtattcatagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctcatgtt

SEQ ID NO: 38348 - DNA, 30818 bp, Homo sapiens
ggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcaga

SEQ ID NO: 38349 - DNA, 11537 bp, Homo sapiens
gggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcaggcaagtggcgccgggttctgggcgcaggcgggaaggagcctgagggcgcccggctcctctgacctcggcctttttcttgccccgcagaaatgcccctccgggctaggagcgacggcgccggcccgctatactcgcaccacctccccacctccccgctgcagaaagggctgttggccgccggctccgcggcgatggcgctctataacccctaccgccacggtaaggccgcccgcgcctcgcccccgtgggggcggcttggagccgtttcctgtgggtaactggaacatagcctaggtcggggtacccaaacctggttgcagctcgtaaccactcggaacgtttatgaaaatgcagattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaacattctagggttctacagtgtttttcttatgcctcctagatttttgagttctgggaagtactgttattcctactaacaaaaacaggctaggcgctattatagtggctcacgcctataatccctatcggggggccgaagcgggcagatggcttgagctgaggagtttgaaaccagcctgggcaacacggtgaatccccatctctacaaaaaaaaatacaagaattaattggggctggttgcatgcggctgtattcccaggctgaggtggaaggaccatttgagccggggagttcgagactgcagtaagttgtgattgcgccattgcactccagcctgggcgacagagcgagaccctgtcttaaacaaaaaatacactatatctccatgtccccagtggttttttgtttgttttgttttgagacacagtattgctctgtggcccacgctggagtgcagtggcgcaatctcagctctatgcaacttccacctcccaggttcaagcgattctcgtgcctcagcctcctgagtagctgggattacaggcctgtgcggcctggctaattgttgtatttttagtagagacgggattttgctatgttgcccaggctggtctcaaactcctgacttcaggtgatcctcccacctcggcctcccaaagtgttgggattacaggcatgagccaccacgcccggccaagaccagcgaattttttaatttttttgtagagacggcgtcttgccacgttgcccaggctgctctggaactcttggcctcaagtgatcctcctgcctcagccccccagtgttgagattacaggtgtcagccgctacacttggccactaagtgttatatatatatgattttcatggtttctcacattaaccagctaagaaaggtgttgtctgcacttcacaaattaagacactgaggctgaaaaatgtgaagcaggccaggcatggtggctcacacctgtaatcccagcaatttgggaatccaaggtgggaggatcacttggggccaaagttcaagaccagcctgggcaacatagcaagacctcatctctacagaaaatttaaaaaactagctgcatgcctgtagtcctagcagtgagctatgatcacaccacttcactccagcctgggcaacagagcaagaccctgtctcaaaaaaacaaaacaaaacagaaatgtgaagcaatttgtactaggtcacctagatagtgaacacacctggactgtagcccagcatctctgatgcctaagcctctaccaatcaatggagacatgatattgtattgtgaaaagtgatttataaaatctttacaacgttgtgctaactagagctgtcccgccccagtagattaagaataagaactatagatatgtatactgatcccttgttgtgtgctgggtaatttgctaagtgtttagcctgaatccttataacaaagagctagacatcatccctaatttatcctgtaggaaacaaaggctcagaccaggtcagctaacttacctaagatgacatcccccatttgtgcccgtttctgtcctttcagacatggtcgcagttctaggggagaccacaggacaccgcaccctgaaggtcctcagggaccagatgaggagggatccagagggtgcccagatcctgcagtaggtcccagctctgcctgggggtctgggggcattctctaggtattctgacctctctagaatcacattgtgtttgttctgttccgctagggagcttttgataccctggctacatatggttgcacaggctgggcactgcccaattccaggggtgtcattcacatacatgtgtatacactgatgacttccgagttgtgcagtgtgatagccttggcccagtttcaaccacagggctctgtgccttcattaagttcccataacatgtgctggctttacccctcccttgcagtaccttttgcaagtactctggtcacattcgaggactgtcttcctgccgagattgtacccctgcccatgtccttggtttggggtagtatcctaagtccctgacactagcctggccagttgtaggtgctccattaaggcttgtggtggccacattgctcctctgtacattctcccgcccctcagctcgctgtagttggatcgttcacctacctttgcccacaccctcccaatgcccaagtcttgcctttcagggagcgtccccggatttcgacatccaccctcgacctgggcaagctccagagcctgccggaaggctccctcggtcgcgagtatctccgtttcctggatgtgaacgtgagttttcagctcctgtgtatctggcagtcaccagacaggacagaggaatagcacaggcatgacaccctgaggaaagaggagccctgagctgccaccattggcaggagtgctcttcaggctcatgccaaggctttgtcattttctatgggataggcaaatgggtgggaacatgcctgcaattgataatactggccagtgttcattaacctcgcactgcatgcctgatgccagcctcatccgtgatcttgctgaatccccccacaactctgtcaagtatgttctattattatcctcttttagcagataaggaaacagaggctcagagcagtgaagcaaacttgctaattccacataactggtattaatggagatagtaatcaatcccagatcatgctcttcactgctgtactgtatccctttattccagggacattgctttccctacggtatggcaggtgtggcactctccagcccctccagccccaggcagggaggacaaggagagggggaaagggggtgtcccgactattggcaaactcattcactaactgaggctctgctatgtgccatccctttttttttttgagtcgctctgtcgcccaggctagagtgcagtggtgcgatctctgctcactgcaagctccgcctcccaggtacacgccattctcctgcctcagcctcccgagtagctgggactacaggcgcccgccacgacgcccggctaattttttgtattttttagtagagacggggtttcaccgtgctagccaggatggtctcgatctcctgaccacgtgatccgcccgcatcagcctcccaaagtgctgggattacaggcgtgagccacagcgcccggcccatcctttttgttttgttttgttttgagacagggtcccgctctgccacccaggctggagtgcagtggcgccgtctcggctcactgcaactcagcttcctgggttcaagcgattctcctgcctcaaccccccacgtagctgggactacaggtgcacaccacaacgcccagctaatttttgtacttttagtagagaggggttttaccatattaaccaggctggtcttgaactcctgacctcaagtgatccacctgcctcagcctcccaaaatgctgggactacaggtgtgagccaccgtgcccagcccaaccattgttttgtgtacaggggatataatggtgaactagacagccaagttccctgccctcatttctattctacttcgagaggtagacaataaaatagtttttaaaaattttcagggaaggcacagtggctcacatctgtaatcccagcactttgggaggctggcgggaggaccacctaaggtcaggagtttgagaccagtctgaccaacatggtggaaacctgtctctactaaaaatacaaaaattagctaggtgtgatggtgtgcgcctgtaatcccagctactcgggaggctgaggcaggagaattgattgaacccgggaggcacaggttgcagtgagctgagatcacaccactgcactccagcctgggcgacagagtgagactctgtctccaacaaaacaaaacaaaaaaattcatataaaaatacaggtaaaatgtttcaagtaattagaatattctggcactggtccatgcgtgttggctcatgcctgtaatcctaatactttggggggctgaagtgggcggatcacttgagcccaggagtttgagaccagcctggacaacatggtgaaaccctgtctctgcaaaaaatgcaaaaattagccaagtgtggtggtgtatacccatagtcccagctacctgggagggagtttgaggtaggaggatcagttgagcccaggaggtcgagggcggtgagccgtaatcacaccactacactccagcttggacaacagagcaagactctgtctcaaaaataaaaaaaagtataccagcactattgtcagcagttgggatacagtggacaaaaccagcaaaaagcctgcctttgtggaacttacattctagcagctatgaagagaacaagttagtgtgatagaagacagctttggtattgggaagggtacagccacttctgactgggtggtcagggccggctcctctgaggagacttggaaggtaaggaggagccaaccctgtggagagctgaggaggagcattctgagtagagggaatggcaagggcaaaggccccttgtgtttaggaaaaggaaggttgaccagtgtggccgcagaggagggagtagcagggagacagtgagtgggctggaaggggagccagggctgcgccctgtaggccaccagaaggaggagtctgtattttgtaataggagcagtaggaaacttgtggaaggttttgagcaggacagtaaagtgacctgatttgtaaaggaccttaggatccagttggcccatcttccctgtccctgtcccatcttccctccctcctgcaacacagatacatcccatcaaggcacccctgccaaatggcgagccagtctggctgatggaggtgaggggtctccaaaggttgccctagaacagtttctcaagccgggcatgttaatgtttaggctggatcactctttgttgtgggggcggtcctgagcctggtaggatgtttagtggcatccctggcttctacccactggatgccaggagcacccccccgtcaagttgtgacaaccacagatgtctccagagattacagatgttccctggtgggcagttgagaaccactgctctgaatggttattgtccccgagacgatgttctgttcctcacagtctcctgcacagctaccttgacggggcgatcacctgcactattttaaaccatctctctcagatttcaccaggatgcaagtcatttcatcagtgggaaactcaccagggtgacctgcctcaagtgctacacagggagggacagtctgaatttcccccagtctttagccctgtcgctgtggaggggagggggtagcagggacaggactgctaggacaccttgctcagccacagccccacttgtaaccgcgctggcgattgtgacacttgtagagcaaggaaatcagcagctcatggaatgtgaaggagcacctttgtccccagagagatttagataaaggttcaaggtgaggctaccctcccctccctgaggctgattttggtgagaggtgtggtcatcttgtagtatcaagactacaggcatgggcttgagaattaggaggagcctgagtgagaatcctggctctcttcccagctttacaagcctggacaaatcctttgacctcgctgagtctcaggttcctcatcagaagtaagaggacctcccatatatcttccagggcacttatcggccttggtaatggatattaaggccactggctttggaatccagcagactttgtttcaaatgctgactcggccactttactagctgtgtgatcttgggcaaattactttatctctctgagccttgttttccttatttttatttatttatttatttttttgagtctcgctctgtcacccaggctggagggcagtggcacaatcttggctcactgcaacctccacctcctggcaattctcctgcctcagcctcctgagtagctgggactacaggcgcacgccaccaggcctggctattttttgtatttttagtataggcgggatttcatcatattggccaggctggtctcaaactcctgacctcaagtgatccgctggccttggcctcccaaagtgttgggattacaggcatgagccaccacgcccggcccttgttttccttatctatatctgcagtaataacagtatttacctccaagattgcaaggatgaaaggataatatatgtaaaagacaccctaggtgccggcacctggtggatactctatgatcaccttcagcttcacacagcaggctaaggccattctttgggaacaggaagaccaggctgttcccactgtgtatgggtgctgctgagtactcagaggcagtgggcagttaagaggagaagagttctgggatcagaaaagtgcccaggactggccttttattcatatgttcaagaggtgttcattcatccaggccctggatcaggctactggaggtaaaagaataagtgaaacagagccagtcctgcccttgtgtagcagacaggctgtctggatactgtccataaaaataaaatgtgatcggctgggcacggtggctcacaactgtaatcccagctctctgggaggcccaggcgggtggatcacgaagtcaggagtttgagaccagcctgaccaacatggtgaaaccctgtctctactaaaaaaaaaaaaaaaaattagccgggtgtagtggcacgtgcctgtaatcctagctactcaggaagctgaggcagaagaattgcttgaatccgggaggaggagattgcagtaagccgagattgcaccacggcactccaacctgggcgacagagtgagactccatctcaaaaaataaaaataaaaataaataaataaaatgtgagcacgtaggtaatttttaattttctgccagctactttaatagcaaaaagaaattaatttttttgctattaaaattaaggtggaatttttttgtttgtttttttgagatagagtctcactctgttgcccaggctggagtgcaatggtgccatctcagctcactgcaacctctgccttctgggatcaagcaattctcttgtctcagcctcccaagtagctgggattacaggcacccgccaccatgcctggctaatttttgaccatattggtcaggctggccttgagctcctcaggtgatccgcccgcctcggcctcccaaagtgctgggattgtaaccatgagtcaccgtgcctggctagaattgattttaaatatgcatcttgtttagcccaatatatccaaagtattatttcaacaagtaatcaattttctttttttttttttttttgagacgaagtctcactctgtagcccaggctggagtgcagtggcgcgatctcggctcgctgcaagctccgcctcccgggcttacgccattctcctgcctcagcctcccgagtagctgggactacaggcgcccgccgccacgcccggagaattttttgtatttttagtagagacggagtttcaccgtgttagccaggatggtcttgatctcctgacctcatgatccacctgcctcagcctcccaaagtgctaggattacaggcgtgagccaccgcgcccggccagtatttttaaatcattgagagttttacatttttttcatactaagcatttgaagtctcgtgtgtattttatatgatcagcacatctcgcttggacaactttcttggccacatgtggcaagcggctgccatactggacagtgtaggtctaggagacattaatactcacatccactaaacatcaaggtacagttattttgagtgccactaagaggtgaatgatgtttccagagaccataacatgaacccacttggtctgtaggttaggggtggcctctctgtggtggggggaagggatgggggacaggggacacttaacccaggtcatgaaggataagtaggagttaccacagtgaagatggaggtagtgggagagaacaccccaagctgggagcaagttatgctaggatcagggtctttggggcttcattatttatttttagagacaatgtcttgcttgagtgcagtggtatagtcatagctccctgtaacctcaaactcctgggctcaagcatcctcctgtcccaagcctcctgagtagctgggactataggcacacaccaccacacctgactaatttttgtattttttttgttctgggttttttttttctttgagacagagtctctgtcacccaggcaggagtgcagtggtgcaatcttggctcactgcaacctccgcctcctgggttcaagtgattctcctgtctcagcctcccgagtagctgggactacaggtgtgcaccaccacacccggctaatttttgtattttttagtagagacagggtttcaccgtattggtcaggctggtgttgaactcctgatctcaggtgatccgcccaccttagcctcccaaagtgctgggatttacaggcatgagcctcggcccctggccagtcgccagagttttctagtaggtatgagttaggtgagagttgtgacggtgtcagagacagactggcaaatcgggccctgggaaccatcaggaagggttctaggggaggctcatggttgtcagagggtctccccagacacccgagcacccacccgcttcgtggatgatgaggagctagcgtatgtgattcagcggtaccgggaggtgcacgacatgcttcacaccctgctggggatgcccaccaacatcctgggtgagtgcccccaaccctgatggcctgtctccctggggtggcttcagggccagggcagggcttgcctatctccaccaccctctgcatcacctggcttggtgcctcaatttctgctttacctgaacatcttagtagcatctttgccacatgtcccccttctttctcccactgcccctcagggctcctgcactaatggagcagcagagcccatcttcaaggctcctggtgtctttttaggctttagctgcctccctgctctgaaacctcagtagctccctaaggcctgcaggaaccatcctggagtgtttagcctggcttatggggtcatggggtcctctgcgccctgaccccaggcttcctttccatcccctactcccttctgttcactcttgggctctctcctgtactccaagccaagtgccccagggcccagcacaggccaggactgggcacagctgaccccgtagagattagggaggaacagtgcctctctttaccctgctgtgagcaccactggcctttccttcagatagcttgttcacctcccaacacatccctcacccacaggggagatcgtggtgaaatggtttgaggctgtccagactggcctgcccatgtgcatcctgggtgcattctttggaccgatccgacttggcgctcagtaagttttcaagtggtagctgggtcggggttgagggtggtatcaggacagaactcagagggaccagggctcttagaagtaggaagagcacacgggcccctgcacagcccgttccagttctccaggaagtaagggtagaaagaatggagcagagatgtgaaactggcctggggcaagggtcttcaagtgagcaaataaagcctgtacatttcacaggactctggggtctcttgggccaggcctaagtgcatggtcagaatgatgagcgtcagtgggaaggcaggttggtgttagattctggagtgagggagccatgatttaaatctgagcttcgacatgttcaagatgtgtggctttgggcttgagattccacctcactgagctctgttgcctcatctaaaaagcagggataataactacctccttccgaggcctttgtgaggatgaactgagaaaatgcacaagtgccgagcagtcgagtgcctggccccagggacttgatgttttctttttcctctgctgccccacaggagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggtcaa

SEQ ID NO: 38350 - DNA, 26793 bp, Homo sapiens
cccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggtaaccgggcgaccgagggccggggaggggcaggacctctgggggcttggctgcgcggggatgtatcctcagccacctccatctgtgtaacgccccaggtacctcccccagttgctttccctgcctacctccggcgctgagctctgcggtccttcggctctgcctgtccgagtcttctggctattcattctgctgcgcttcatgctgtctgtccgtcaccctagctgcctctgactgctcattttcttattcatttttccttctctgactttggtccttccagccgagcatgctgtctagttatctccctgctttcgtggtccgctgggttcctcagcctccagttccttgacttctgcctctgctctctgtatgcacatgtcccagctcacttgggtcagttcattcccggcgcaccactggatccacccccttcccccagtgtatttgatttctctttgaaacatcattttcatcaaggttctatatagaacgaggacccttgggcgtctactccctgttctcttgattattaccgtgtctttggcacagtcttccctgaaccacccccttctcccgtcccccttcctatgtcccatcctttctgcatgataagagtttcgtgcttagggatattgactttctccaactctcggcccaatgctaagtccacctcaatgtcccattctaactcccttcggtaggtctgtgcgcctacccaaccccatgtatgcccacatgctaccttttaagatgaccatggcttagctactctgggggcatctgtggatcagcttctcactgtcttccagtttaatttggaaaattttgatacctggtgctgcccaaactgtttgttgtctccattttttatatttaatcttgtagtcataatgttgatcacaaatgaatacatttatgtgcccgggatccaggaatcctggttttggtggcagtttcccttgattttattgagacttttaagttggtccctttacatttttatttctagttcacaatccaaaaaaaattattaatcagaattcaggtttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtaatatacatgtttgcagtgacatttgctagtcctaaatgaaactaaagactggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaagagaaaaacaaaaaaaaagaatgagtaaaaaccttattgtcatttagtgctgctttggaagaatatttcttcttctcatctcctgcctctttgcttggttcttagcagtgttttcatatgtgtctttttgcaaatgtaagtgtagtccccagtgggtaaattctgacatgttagtagattataaagttgcatcttactttcttgaagattttcattgtgtgtatttctatgtttcatactccggagtcatttcttaaaatgatatattacattcagtatgaagcctcctttgcagtgaggaaacaggtataaggaaggaaagcaacatgcctgaggtgttattagtagcctgagctggaaccaggcagctatttgggctatgtgggctgtaggtgagctcttctgcttcctagttttatgaccttccatgacccactgaatgtgtctgtatcttaaggtcctcctccataaaatgaggataactactcactatcatagtgaatgacactgccttaattacagtttggtttgaagaagcatgtgttagtccaaagacttgatacttactagggcaacttctttaacctcagaaaaccttatgtctcaaattgtagaatgaggataacagtgttgactttacagcactactatgagagagatacagcataggtgaagtgcctagcccagtgaaaggaggcaactagtggctctccagtatatggtgactcatttggatgataacgatgcagatggagacaaaaatgagataaccaaaacttttaagtggaaagattttaaactgttaaaaaatgctatgggaatgtaaggtaactttggtattgtaaggtgccatctcacattctggccgttttatttaatgacagccatgagggaatacgtaaaggttgtttcttttgagactgcatagcttcaaaagatggtagtattgggaagacatggttgcaagagtgtattgaagatttgggagttttaagatgagaaatcatggcttatggaagaggaggaagattcttagatacttatggatttcctgtgtttttgaataataacatgagataacagcttgggatcaagatataaattttaaccttttactgcttccctctaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggtgagactcagctctgaggggccatggtctgtgagtcttggcttgtggtaggcagtgatgctggaaaataattgtactcagttctttttcaacaaactggggagagttgggttagatgatgactaagctgtcttccagctctgagaatcttaggagtttacaaatgtttaggcaagcaaacagtgaaatctggtctttcaaataaggatttaaaaaacacattcagtccatctagctagattctaactaaccctttctcatactggattgccaggtttttaatctttggccattcttgtaaatccccttgagtaatagaagtatcatggaactctttagagatttatttttaaacaaacagcaaattccatgtttttattaattctgttaggaaatgaggtcttttagcaaatattttggttactagaataactatacatatcataaaaatagttctaattattaaagaataagaatacagtaaagtccagttagcactaaaaccaaactactattttcatttcataaatctgtattagcatactgatatgtaaaaatgccaattagttgaattcgttgaaaattttacgtgaaggaatctttagaagccactatttattttttcattatttccaacccattagggctgtattacctttactgtatacctaaaatatacttttacattttcttcttttttttttgagacaaggtctagctctgttgccctggctggagtgcagtggtgcgatcagtgctcactgcagcctcagactcccagttctcctatcttatcctcctgactagctgggactataggcacactccaccatgcccagctttttttcttattttctttacattaatcggcattttgtttattttcacccgatctagtctttgctatggcatgtatttccagctcccaattggagaaacaagtttgtataaattgcactgctttacttttcttaacatcctatggagaataaaccatagaattacattcacgcgtcacttaatgacaggaacgcgttttgagaaatgtattgttggacgattttgtaattgcgtgactgtcatagagcgcacttacacacacccagattatgtagcctactccgtacctaggttatacagtataggctgttactctgaccactcctgtgtatgtagtctgccattgaccaaacagtggatatgtggtgcatggctgtaattgtttcttccggtttttaaaggactatatagacttactgaggcagaaggatctctctgtttttttgagatggagtttcgctcctgttgcccaggctgcagtgcaatggcgcaatctcatctcactgcaacctctgcctcccaggttcaagcaattctcctacctcagcctccctagtagttgggattacaggcgcccaccaccacgcccagctaattttttgtatttttagtagaggcggagtttcaccatgttggccaggctggtcttgaactcccgacctcaggtgatctgccctcctaggcctcccaaagtgctgggattacaggcaggagccaccacgcctggctcagaaagatctcttgaggccaggagttcaagaccagcctgggtaacatagcaagaccccatctctaaaaataaaaaaaattagctggacatggtggtgcatacctatagtcctagctacttgggaggttgaggcagtcaggaggattatttgagcctaggagtttgaggttacagtaaactatgatcacgccactgtgctccagcctggtgatagagcaggttgactttgctctaaaaaaatgaaggaaaatcagccgttgacgatttagcccaaactcccatctcctctggtttctgtccttcccatggccccctttcacacaaatacagtgatttacatagaataggagctaggagtggtccattctaaatgttttatcctctcttttcctaggctctgcaagcactgcagcggcagcccaatgcagctcagtatttccaccagttcatgctccagcagcagctcagtaatgcccagctgcatagcctggctgccgtccagcaggtgagaggtcagcagccagctggcccgagagggaggggacaggcactacaggtgggtaggggagattttttgggcatatagcatcctatactaagccaggctgcagacagcctcctccgcctcctgtccttctgtgggaggatggatgcatcttagcttctggggttgcagtaagaaccgtaaaatcactttttaggtatagagtggctgtgttatagacctgcattgtctaataacgtagtcactagccacatatcgctattgagtgcttgaaatgtggctagtctaaatggagacgtcctataagattttagagttagactacttagtacaaaaaaaggtaaaatatcagtaatttaaaaatattaattacatgtgaagtgatattttatattgggctaaataaaataaattatgaaagttaacttttcctgttttactttttaaaactttgcatagtagaaaattataaatgtggttcatattatatttatattggatacctctggactagacttttactgactcatgatatgacctgaccaaaagatctttttctagctgggcgtggtggcttacgcctgtaatgccagcactttgggaggctgaggcaggtggatcacttgaggtcaggagttcaagaccagcctggcctatatggtgaaactcattctttactaaaaatacaaaaattagctgggcgtggtggtgtgcacctgtgatcctagctactctggaggctgaggcaggagaatcgctcaaacctgggaggcggaggttgcagtgagcggagatcatgccactgcactccagcctgggtgaaagagcgagactccttctcaaaaaaaataccatctttttccacctaaaagagagtgggagctggaggacaagttgcctctctgccccaggagggttatgtggggctaattggttagcatatgtggtaatgtgaggatcactggactagtgaatatacttttctttaccctaaagtggaatctccctgtttataatgtgaaatctctatgttttgtgcttgtgatttattactagaagactgagagctttttccttcactgtctttgctatttcttgtttcccttcccctttaataggccacaattgctgccagtcggcaggccagctccccaaacaccagcactacacagcagcagactaccaccacccaggcctcggtgagtacgccctctcccactgagaggcttctctacctgggtctttgtctctgggttaaattactttgtgccgctgatctgagagtgtttattgagccgtcagtggatagttactgcttttaagtagagaatagtagtacaaggggaaagtaaccaacattaatctatattggagtctctaaagaggaagtctaaggaagagaggaaagaaaatcctggggaagaagaggagataacaaagaaggggactaatccctggactcttcaatgagaagtaaaatctgttctgtttcaatcttttgtcttctcaactgttaacactagtggttagagactgttggttttttttcactttggtaataccctaaagtagccaggatgacagttttggatatgaagacattatttatttcccccggctccatgaaagtgaaatactctgttcttgactgtgtgactctgaatttgtcagtcacgtacctttccttttacttctcccaaatccttagtcctggttcctttctgtaccacacagatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacgggtaagccacagatgcagtcaccattgccccagaggcataattgtctggccctggcaaagacttgagtgaaagcttttttttgagacagaatctcgctatgtcacccaggctggagtgcagtggcacaataatggctcactgcagcctctgcctcccaggttccagcgattctcctgcctcagcctcccaggtagctgggattacaggcatgcaccactatacctggctaatttttgtatttttagtagagacggggtttcaccatgttggccaggctggtctggaactcctgacctcaggtgatccacccgcctcggcctcccaaagtgctaggattacaggcgtgaaccaccgcgcccggccaaaagccatttttttaaaccatggtaaccctgatgttttgagagaagctgggacctacttcccatactttacttaacctggaagtgatgttctgtgttcacaggtagcctatagattaaattgagatattatgctagaaaatactggcttaacatttgactaaattagtgttagatatagtcgacctttaaacctgtggctcaagtatacaaattctgtgttatcgctcagcctacctactttctatatataagtacttgttctaaaatcctaattttctctatttctttgacgtgtgactcttggacatcaatctgtagttttctatgcattctaggttttcttctggatggttcattacatgtggagaatatgaggctcctgggttggtgtggaagaggcagggctcagctgtttaatatcttctgtttattttgtcttgtggtccttcctttccatctcttctgtctcttctttccctcttgtcctctttgctcttcctcttcctctccttgccagccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttagtggcgatgactttacctgtgggtgggcactgggcaggatgaagggaatgaccacggacctgggtccacccttctgccccattacacttttcagaattcttactttttgtgttttgtttttccttcccttaatcaccatagaacttgaatcccatataacctttgagttaatctgagttagaaagacaaggagatttgcctgaaaatagtcttgtggatctgggaagtcttattttcaagatagggtaaatttcctcaccatccttctagtcctctgtgggtttgttttattcggagagtcttaattctctcatagtactgtcagaagagaagagattgttgagagaattcttctgttagttagatgtaaagctgacctggctgagttactggaggaatgtttggttgcttctgtttgtgagttactctagttctcaactttcagtcttctcttcctgttcactgttttttcccagtaaaggtcttcctcaccattacttctcatgacttattcccaaaatacatgtatttttgagcctggaattttagcttcttatagatgggacacaacctaggatcttacgataattatttcatccttttagtttatttatcagtaagctggtaaatgttgagttcttccttcatgtacttttggccctccctgtttatgggtttcatacctgtaggttctgcatctctggcttccacatctgcagatacaaccaactgcagattgaaaatatttgggaaaggccgggcgcggtggctcacgcctgtaatcccagcactttgggaggccgaggcgggtggatcacgaggtcaggagatcgagaccatcctggctaacatggtgaaaccccgtctctactaaaaaaatacaaaaaattagccaggcgtggtggtgggtgcttgtagtcccaactacctgggaggctgaggcccgagaatggcatgaacccgggaggcggagcttgcagtaagccgagatcatgccactgtgccccagcctgggcgacagagcgagactccgtctcaaaaaaaaaaaaaaaaagaaaatatttgggcaaaaaaacaattaaaaataacaatacaagaacaaaaaataatacaaaaatacagcatcgtgtaaccatttacatagtacttacattgtattagatattataagtaatagaggtgatttaaagtgtatgggaagatgtgctatgtgcacagatgatgtgcaaacactgctctgttttataaaagggacttgagtgtctgcagactttgatgtccatgagcctggaactaatcccctgtggataccaaggaacaattgtattagaaattttgcaggattaaaaaataaatgtgagtcaggtcttcaaagagcttagacaatgaaagtgctaaattaggctgggcatggtggctcactcttgtaatctcagcactttgggaggctgaggagggtggatcacctgaggtcaggagttcaagaccagcctgaccaatatggtgaaaccctgtctctactaaaaatacaaaaattagccgggcatggtggtgtgtgcctgtagttccacctacagggaggttgagacagaagaattgcttgaatctgggaggtggaggttgcagtgagctgagatcgtgccactacactccagcctgggcgacagagtgagactccgtctccaaaacaaaaagaaagtgctaaactaaatggtgctaactttgagtgacacatgagtttggaaaagaattggttacattactttgcaatgccttattgggatacttgagcagagtcttggacgagtggatttgatttggagtgagaagaaaactagagagagaacagcaagcgtaagagtatagtcatatatttaaatacgagtatgtgtggtaggcgttggagatgaggggataaataaaatagaatcaacaggcatgatgatagaagaggtcattgctggggtagagcatataaaggaggttgtagttaacttcataggtcacagggatcattgctagctattgaacagcagattaacaagatgaggaaagtacttaggaagaactatagggagaataactgttctaacagttcctggagaagagaagttagggaacttgctaagaaactcttgtggtcatctagctgtaaggcaagtctttgttttagactctggtgatagcaatgggagccacgagtgaggttggttccatttccatatccagttctttgatttatccgctcattcattcatcagatatttgagtgtcaatatgtggaggaacagagggcagtagttaaaaatacgcatctgatgggtcagattccagctccactacttactgtgtgaccctgtgcaaatgatctgacatctttctgttatcgtttttttcatctgtaaaataggtattgtaatatacctacctcaggatgtgttgtgaggactaagtgagttgctgcgtttgactgcttgaagaatgcctggacgtagtgagtgtttaggagaaactactgctattaatatatcaaacattccttagcgttggatgcccaagaaagtcacgatcactgcatttgtggagctcacagaccattgaaacaccagacattaaactgatagtcacctgaatggggaaataattgagaaagtaccgagtgttctgagaatttagaaagggacctaacttagctttggcatggggtgtaaaagtcaaggaggtgacatttaacttggggtgtgtagaagttagccagataagaatgtggaaggagagtgttggaggcaggagaacagtgtgtccaaaggtcctgaggagggcaggaacttgatttgttagaggaattaaaagtcttgtattcttggagtttggcatagtggggctagacgggtaggaggaaccttatctttcagggctttgggggctgtgtttaggattttgggctttttataaaaagcaattggaagctatagaaggattttaaatatggaagtgtcatagagagatttggatgtatttttgttttgttttgctttttaaataccatgttgatttcctctttggagactaaacggatatggtgtgagtgtgactgtagggagaataactgttctaacagtttaagggacagacgatgttcatactgggggtagcaatggagatggacagaaatgcatagatttgaggataacttagaagaatcattgaagagggtgaactaatttagtagatgggggaattaaaggagatgccagataggaaatctgtggggtggctggtggtgctgtttatgagacgaagaatgtaggagtgtatttagagtgacgttcagttttggacatgcagacctaattagaagtgtttgtgagccatccatgaggagatactgagactgcagttttattatgtggttcttgagctcagaggagaggtctgggttggagataaacatttgagagtagtaggcatatagatgataattgaagtcccccatctactaaattagtttactctcctcagtctttaaaattgcctggagaggccgggcacagtggctcatgcctataatcccagcactttgggaggccgaggcgggcggatcacctgagatcaggagtttgagaccaacctgggcagcgtagtcaaactctgtctctactaaacatacaaaaaaaattagccgggtgtggtggtgcatgcccatagccccagttaacttgggaggctgaggaaggagaatcacttgaacctgggaggtggaggttgcagtgagccaagatcgtgccactgcactccagcctggtcaacagaggagactccatcttaaaaaaaaaggccagcgctgtggctcatgcctgtaatcccagcactttgggaggctgaggcgggtggatcacccgaggtcaggagttcgagaccatccagcctgatcaacatggtgaaaccccgtctctactaaaaataacaaacattagctgggcgtggtggcacatccctgtaatcccagttacttgggaggctgaggcaggagaatcacttgaacctgggaggcggaggttgcagtgagccgagatcgcgccgttgtactccagcctgggcaacgagggcgaaactccatcttaaaaaaaaaaatgtttggggagatagtacaggttgaggagaggaacgtttaatatggggccctgaggtaggatgaacccccactttggaaaagcagttcaaggtcgacagagggtcgtgggctgacagaggcgaatgggaaagagcagcagataggaaaatctggactgtagtgtcacgaaggcaagggaaccaaatgttacaagatgtgcatgtgtgcatgcgcgcatgcgtgggcagggggcatctctttctaatgtagagagagaaagaaagatggttttattaacagggagggagagttgtttcagttgtttggggggtggtgaatccaaagtagtatgagtttgaggggtgtgaatggctggtgggaatgaatacagtgactgtaaacagctattaagagtttagcagcaccaggaaaggaaggtggaactggggaggggaatgtgcagttcctacatggtgatgagggagccagtggagaagaagtggaagaggaggcagtggatattatatgctgcttgagatggcaggaggaggtggaatatagagtgcagagaaggactgattgccttttgataggaagaggagagaagggggaaatgatgggtgtgtatgcagataaatgtatagattcggtggtggaactgatgaagcaatgctcatataatggtttttgttttctctgaagaggtgaagagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgtactagatttctacatggtcttcttcacttcagtcttaacctacttgtagttcttttccacattactatcaggaaacttttactatgtttttttaaataagaaaatatatgttgttactactaattttttaatcgtacttctggtacacagaatttgataaaattgtaatccttggatcatgacactctctcactgttggtctcgtcataacctgttaaaatttatttactctgtaatttttaataatgtaataagcagtgtgcagttccgtctactgccttccattacccacagtaacgagccttctgatttctaagtccattcttccctcgggtccttttttatatggttttattgcatctctctatgtttctaaaatgccctttttattatagaaaattttaaaggtacacaaaaacagaaaaagtatgaattcctgtgtacttaccatccagcttcaacaattatcgacacatgaccaatgcattcaggcccttctctgcctgtggaatattttgaagcaaaccccagacaccatgtatatattttaattgtattgaaatgtgtaaggtactcgtgctgtatgtacacttttggagagtgctttcttaataacattgtcacgatccatttgttttgttgcagtcattggagtttattaattgtagtttctatatactattccattgtatgaatatactatagtttattcatcttctcttctgtagatggccctttgagttgattccaggtcgtggttgctaatgaataatgccaccatgaacattcctacacatgcctcctgtggtacatggcaagagtttgtcttgtggaattcctgggttagagggtgtgtgaatgttcaactttaggatatgataacaaatattttctaaaataggaagtgtattgatttatacttcaatcagaaatgtataaatgtataagtgaatgtttattttgattaataagctttattggcttcctataatcagttaagcagacatcattctttccctttatccatattttggagtactgactatgtgccggaactgtgaaggtgctagcaatataacaatgaataagacagataaacttgctgttcccaaactaaagttcagattccttgtttcaatacaccaggcccttactggcccagcaccttcctacctccttatccacagcctgccttccttgctttatttctttccattccttgtaactctccccaaacataatgaaatatttataatttctaaaaatacagtctttttagaaattatacattttttttaataatattttaaaataatgtctttttttttttttctggacagggtctcactctgttacccaggctggagtgcagtggcgtgatctcagctcactgcagtctctgcctcccaggctcaagtgatcctttcaccttggcctcctgagtagctgggactacaggtgtttgccaccatacctggctaattttctgtatttttttgtagaggcagtgttgcccaggctgttctcgaactcctgaactcaagcagtctgtccgtcttggcctcccaaagtgttgggattacaggcatgagtcatagcgcccagcctaaataataatccttttttggttctggccttgcaaatgctgttatcaatatctttaaacccccaccttcaccattacctactgagtgtcacatcagtatcacttgttttaggaagcccttccttgatctccctagtcttagttgatattccttctctgtactcctatggtactgggtgcatatctatacatcttattatgtcataagtgataattttcttgtcttctgtagtagaaagtaatcattaagagcagagactgtgtctttcctctgcatttccagtatccagtgtagtacctgaagcatagtaggtttttgggaggtgctgaatgattgaatggcgaggaaagggataattgaagagatattttgaaggaataaaagaccacacttgatgataaacttgctagtgagtgaagatggctgaagaatcagatacagagccagagttcctccttaggaggtaggaaggccttaaagtatatggtaaaggcagagatacgagctgaggtattctgtggaatacgacacaatagcagtcctggctgcttttgaatctttaaccttaatgcctccagtcctccttttctcaatctgttttttcgtatctttcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcaggtaaattgtcattcctcatgtcattattctctcagaattcatgtgaaattttcctttttttctttttttgcctttttttctttgcctttttgttttttccccgcttctgttggtccttgaatagtggaaggaatgggaataatatcagccttgaacatattagttcagggtcaggaggacaagtgacagatacagattttatctgtttctaccaggcagtagtcagcttacaagttcccctgtccgctttcttaggctgtgagttcttcagttttatcactctgtctattcattcatcacatcttactgaattgcttactgttttctaggaattactggggatacatttttgaaaagtagattccctgtcttcatgtaacttagcatttactataagggatgaattctcacctcactgtttaatgtggttacttgatccagtgtatagcagatacagtacaatgccttagagcacttaagactaatggagaggcggggtgcggtggctcagtcctgtaatcccagcactttggaaggccaaggcaggtggatcacttgaggtcagagtttgagactagcctggccatcatggtgaaaccccgtctctactaaaaatacaaaaattagccgggcgtagtggtttacacctgtagtcccagctgctcgggaggctgaagcaggagagtagcttgaacccggttggcagaggttgcagtgagctgggatcacaccactgcactccagcctgggtgacagggcaagactctgatagtttatacttgctttcagactgcgggtaagatgtagttagatgtgtgtatcttatttggtcatgttgatttttgcctttttttgtttctagtaccttagttgttgatgtatttagataatttactcacaaaaaaattaagagttagttattactatacttggtatttatatactctagcagttctatttctaaattgctttatcatcacatgctttgatctctggacaatctggtacaatatggagaagtagagtttgtcactcccagtttacagtggaggaaactgagttaggtcagagctgacaggtgctgactctcaagactcagatggtggtctaagctgatgatttgtaaaatccaagtcatttgtgggaagacgttgacatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaagggagttctttctctgagatctttaagactagtagtagttggtaatgtctgattgagtgggaagagtatggacgaagtgatgtccaagtttcatactgactagatttcttttcaccgcataattccaaaactaggttataccttggaaaaatgaatttacttttaatttagaatgattattattctctgctcttttttctctctgttgtattctgggattgttcctatagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccggtgagtgatgtctgatggttttgagggcactattatgcatgagagtggacctgggctaagtggaaatagagcttaattgaataggggaataaagagttaagagggttaatattggtatttatctgcttcttctgtaagagagtgacacattatataatatctgaactttatactcctaaatttgttgctgatactattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggaggtgagtaactgacttctaatgctgttggagagcacacagagtagaggaatgttctgagtgagctaaaagataaaactggttgagtagaaaatgggccagaagttggtggacaaatgaatagatccaaaaacagggaatccaggtgaattgtcaagggtggacatagattattatggaagatcatgctggctcaactaatagatggatcaatatgtcatctcatgtctgttgcttaatctgtgtttgttttccagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgagggcagggccataaggtgggactttgaagtggggacttggtctgattgttgtcttttcaaactccagtaaaagtaaaaggcacagaactatttaatgaaagaatggttcaattacgctatttatttaattataaagaaggaaagggaaaagagtgtgtggaccataaaatgaaaatgttaggaagaggagaaaaaaaggaagaaagtaacctttaaaactgtaatgtttagttagataaactagtttgttttataatgaataaaattatagtaatgaagttaaggagctttcctagggtttgcagaaccaggactagaactgaggtgtcttgactcctagtgcattctcagcaccataggaaggaagaggacaaaatagggagccagcgtaggaacctgttctccaatggcttatctggaaaaaaagccagttactattttttttttctcatttccaaacattgtatagagaccagttactactcttgattaccgtattgaaagtgattctctctgaaccagacttggtcattaactcagagatccaagcagagacataattgatggggaaatgttggggaaagctatagagaagcagaaggggatcaggctaacttaactctcaatgttttctgggacaggtgggttgttctcagttactgaaggagtctgagaagccactacagactggccttccgacagggctgactgagaatcagtcaggtggccctttgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcaggagtttgagaccagtctggccaacatagtgaaaccctgtctctactacaaatacaaaaattagcctggtgtggcagcatgcgtctatagtcccagctactcgggaggctgaggcgggagaaccacttgaacctgggaggcggaggttgcagtgaagtgagctgcacgccaccgcactccagcctgggcgacagagcgagactctgtctcaaaaaaaagtaggaataaaatgaagtctgtctacatatagaaaccatattatatatcagagtatgtagaatcacggaaaaggaattacataaggtgaggggaatttatccagctaaagtaatcttttgaattattattattatttttttttgagacggagtttcgctcttgttgcccaggctggagtgcaatggtgggatcttggctcaccgcaaccagtgcctcctgggttcaagcgattctcctgcctcagcctcccgagtaactgggattacaggcatgcgccaccacgcctggctaatttttgtatttttagtagagacggggtttctgcatgttggtcaggctagtagtcgccaactcccgacctcaggtgatccgcccgccttggcctcccaaagtgctgggattacaggcgtgagccaccacgcctggcccttgaattattctttactctatagatgtattttttggccgagtgtgatgactctcacctataattccagtactttgggaggccaaggccggtggatttcttgagctcaggagtttgagaccagcctgagcaacatagtgaaaccttgtctctacaaaaaaatataaaaattaactgggcattgtggcacatgcttgtagtcccagctacttgggaggccaaagtgggaggatcgcttgagcccgggaggtggaggttgcagcgatccaagatagcaccacggcactccagcccgggtgacagagtgagactgtctcaaaaaaatttttttttccaaaagatgatctaaaataggacatttatatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcaagggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggcaccctcctccttgccctcagcactggtatctccatctaatgttacaccccttccccaggatcgtctcatagctgatattttatgtctccctccttgcttttattcccttccccaaatcagctcataagcagaaattcacatttagagcagggtggtcttctgtggcactattgacatcctatatatgccctgtcctgtaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccgggtgagctgcttgttgtagagccagatgcctttaaactgggtctttttttctttccctgcagggcaattcatttgcccaggtaagagggtgtgagatgagaactctggtttcacattgattgcattactacaaattccaagagatcctgaccccctttgtctccggacctcttacccaactactggttcatgtttccattaatccttacactgtacttgagtacaattgttaattgtactcaattgtactcaatttctctcaattgtacttgagagaaaatctagatcaattgttaggtcatggggagaatcaaggaagtgatacagtttctatttgaaagactttgagagtagattttgggaatttgcaaataaagtgctgcttatttcacatatgataagatgagtttttcttctacgcccaacccagggtggtttgggaagaaagagagaggaataaacctttgacactgacctcattggtttgctcttttcccctatagggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggtactgaccctctcttcaacagaacccaggttgttttccttaacatcatcccacaggggccttgataagagggaaagtaattgacttttaagcagtaggagcttgaatgctaatatagaggctctactcctaatattcaagttgacttcctaatttttttctgggttgacattatcttctgtaatgtcagcaattttacagtgtttgattctcatcttatgatgtagctgcatttctcactaaatttttggataaaatgtttttgtgtaattaactatgatacctcccatggggaaaaaattttttttttcagtggagcagggtattagaaactaagtggccattgttgccccactcttcaaagagggcttgtttgctagtcttctttttttttttttttaaacagagacagggattccctatgttgcccaggctggtcttggagtcctgggctcaagagatccttctgccttggcttcccaaagtgctgggattataggtgtgagccactgcactcagcctatatgcaattttgacaaagagtttttttcggaaatgaaaatcaccctacccttcttgctatttgtctgaattctgggcccttaaacaaaaatatcacaaagaatctttttgccagtataaaagaaaacatgcttttatttctgttctctccctttcccctgtctctaagctatttgaatgaagttatttctgtggttgaacaatttagttgcttttcctttcttggtcttggactttggttttgttgttgttgttgttttgagacagagtcttactctgttgcccaggctggagtgctgtggcatgaattttggcacactgcaacctccgcatcctgggctcaaatgatcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctc

SEQ ID NO: 38351 - DNA, 3856 bp, Homo sapiens
gctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggtgcgtgccctaggagtaccccttttgcctggaagcacagcctttctttccagccacttatccccttacctcctgcttacccacggatctcagctggggaacccgagttgagaaggagctgatcctatatcgtacctcgccgatttgttaacaccttgtgtttctctttgcaggcccttctgcgatgttttacctggctgcggctgtgtcagatttctatgttcctgtctctgaaatgcctgaacacaagatccagtcatctgggggcccactgcaggtgatgggcgcttctcttccagagatctaatcccatataaccaatcttgggttaatttcctcttgatctggagatggcctttctgcatctgtattcgctaggcacaggggatacagagatgaataagacaccgccctccctcatggacctcacaatctagtgagggagctggacacagacataattacaatacagagtgataaatgctctagtggaggtatgtacaaagtgcagtcagatcatggggcgagtgaatcctgggggagtcgatgaagcttcttggaggagatgaattgaactgggttttaaaagatgagcagaaccgagcgcggtggctcacgcctgtaatcccagcactttgggaggccaaggagggcagatcgcctgaggtcaggagttcgagaccagcctggccaacatggtgaaaccccgtctctactaaaaaaatacaaaaattagccgggcgtggtggcaggcgcctgtaatcccagctactcgggaggctgaggcagaagaatcgcttgaaaccaggaggcggaggttgcagtgagctgagatctcgccattgcactccagcccgggcgacgagagcgatactccgtcgcaaaaaaaaaaaaaaacaccaaaaatcaaaacaaaatgagcagagggtgtacgaagtgggaaaggtcattccaggtggagtatggcagtaggaatttgaaagtgggcagtgggctgtgaaccgaagtgctttggtaaggctggagagctgactgaagagatggcttgctttgtagaagactttattttccttttttaaggagcttggactttttcttgtggagctaagggacacataagtaggagaatgagataaagtttttgtttgagaacaacattctggcatcagtatgaaagacgaagtagagaaggagaaagtggagtgggtagattagttgggggctattgtaggttaaggaagaaatatggataaggtaggtgtggttgtgattttagatttttggaaccttcaggagttcttagtcatttattgggtgatacaggtaggattttattaggagaaactcttatctgtggggcatttgccgactttgtagaatagtttattgaggtcctacactgctgtaggacttagagatgaaagcagtgaaaagaaacataccctgcctttgtgttgcttcctctgcagaggagacaataaataagtcaaatacataactcgtttagtagtgataaatgctaaggagaaaaataaagtataaataaactggtatatgatccctatcacactaacagcttttttttagggcaaagtctgatgattagcttagtgatttcacgctttttaatctctgggatctttagtttatcccacagtttttagttctatcttgaaagtaacaaagcaactgaacattaccctgagaagggattggggatgaggtactaggagttttggtcaagtgaaaataaaatcagtttcctcactgctaagttgtgttacatgtgacaatttaaaaatggaatctaatagccattctaccaatgcaagaaatattttaggctgagaggtttaaaaacccaactttatttaggcttctgccaaatatttgtatgaacagattatttgtatctgtttatttgagggtttggttcaaaaataaagggacatgcttgagaaaatattaatggtggtaaggttggcagagcatggcagggcttattcagaaggcatggtttgccccagaatatgtatggagccttgaatttaggcatcgctgtgaactctacagagccaaggctttttttttttttttttttttttgtgagacaaggtgtcgctctgttgcccaggctgaagtgcagtggcatgaacacagctcactgcagcctcaaccttccaggctcaagtgatcttcccatctcagcctcctgagtagctgggactacaggtgggtgccaccatgcttggctaatttttgtatttttttgtagagacatggttttgccatgttgcccaggctggtcttgaactgggctcaagcgatccacccatcctggccttccaaagtgctgggattacaggccaagccactgtgttcccctaagactttttaaactaaacatttaactgaaaagtttgatggttgagaaatcccacttaaatttaattccttagtttcccatgagattgacctggtaggtaatgaccattgtttgcttattaagcttttctttttccaatacagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaagg

SEQ ID NO: 38352 - DNA, 56722 bp, Homo sapiens
ctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacggtggtagcctcgaactcctccccgccagcccgcctgcccccctccctcttcccctcccccagccccctcccctcgccgctctcccgccctccctcccctcagagcctgggcgctgcggtagcctcgaactcccggtgcagtgcagcagcacccccgcgaccccccgtccctccgccctcgaccaatcctccgcctttgcccccccccgctccccgcccccaatccgctgccatctcccggagtgccccgagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtagatatatttgcttaagcaaaatctcatatcccctttcctgggcttggtttggggtggacgggctaggagtccgggcatggggccgggaggggatgcggggttgggctgggcaggcatccgtggcggggaggctgtcaggcttggccgggctgtgacactgggcgtgtgggcagatgtgtgcactgcaaggttaacatggttcccttcggaggccacttgcccgctgggggcatcgccttcctagcccttgagcctggggcagggtcggggtgagcagagggagacggcccttggcggagtccagggtccgaggccgcgggctggaggagcaggcgtgcggactgtatggacgaaccgtgcaaatgtcaattgccacctcgctcgccccggcgccgagggccgcgctctgtcgggcgggtggcagaggccagggcggctgtcaccggccggggaagccaagggcgagccctgccgacctgtgcgcagccgggattgtctcttttctttctttttggctaggtggtgtagctttggtcgcggcagctctgcggagtgcaggagccgcggagagaaaggggtgggggaagggggtggggagacgccagcggcaggcacacctcgctcgccagccagctctgggaagttagaccacaggacagtggctgcagctgccaaggagacattttctccccgaccagccaggttccagcgtcctctgccaacccagcttgcgggctccctgtctacttttctccaaacaggctccccggcggtcacgagatttcagcctgtgcagggattgggcgagagttccgcatatggaggcgcccttgctggagcctctcggagtggagcgcgtttccttctccccaccctgcctgagacccttctcagttaaggctttggacagactttgaaagggacccacctttttttttcctccttacagtttgtcaatttttgcccagtgcccataatattgcgtttgtgtcagacattggatttctatgttagatattaaagagcttacttgtattttcttggagagaaacaatgtttaattattaggatacagaggcgtgtttttttgttcctcctctccccattaagacaatgcaaaatgatatttaccaaccatttggatttcagatagcagctcttcctcctgtcccaagtgaggaggatgaaaagtaatgagtcgggacagtctcatttttaataggtgaaaacagtgatgcaagagtgttcactagatttgggttgccttctaaatgactggctgggaatacattttattcaaagactatcagtgtgtatactgatgggcttcaaataattttaaatgttttatgaaactaattttctttattgatgttgctagtaggtgaatggcactttcacaccactctgctccctttgggtttacttgacatttggaaagagcacattttggctttaagagactgaattcacgccaggcgcggtggctcacgcctgtaatcccagcactttgggaggctgaggcgggtggatcacgaggtcgggagatcaagaccatcctggctaacacggtgaaaccccgtctctactaaaaatacaaaaaattagccgatcgtggtggcacgcacctgtaaacccagctactcgggaggctgaggcaggagaatcattgcttgaacccgggaggcggaggttgcagtgagccgagatcacgccattgcactccagcctgggcaacagagtgagactccatctcaaaaaaaaaaaaaaaaaactgaattcaattcctaactcccaactcttctttttgtggtctgagcaagccacaggctttccctgagcctcagtattcctagctataaaaacttttttttttttttttttttttgaggtgaagtcttactctgtcgcccaggctggagtgcagtggcgtaatctcggctcactgcaacctctgcctcccgggttcaagcgattgtcctgcctcagcctcctgagtagctgggactacaggcacacgccaccatgcctggctaatttttgtatttttagtagagatggggtttcactgtgttggccaggctgctctcgaactcctgacctcgtgatctgctgcctcgacctcccaaagtgttgggattacaggtatgagccatcgcgcccagcctataaaaactaatggaattcttgccaggattaaatgatgggcatatggcaattattctataaacattaaaatttgtaattatgaagaattattctggatatattcacacctttctgatttggagctttcattgggagtctgtgtggttttttttggtagtgatagttatttccaaattatacctcagcagctacaattattttttaagttaataaacatacctatatttttgccccagtgggtagatttctgagtcaatatttatttcatagacaactatatacagttcgattaggggtcttgtgtttaagagccagacttaatgctggaacaaacttgtacatgccatagcattacattggaaagcattgatctgatcattggaaagcatcttttttgtttcaggataaacactggaacaaatttcaaaattttgagaataatcacttaaacagaataatattaatgtgattttgcatggccactggtttttttttttttgaagaagctatttttatctttattttttaaacaactttttttttttattattatactttaagttttagggtatatgtgcacaatgtgcaggttagttacatatgtatacatgtgccatgctggtgtgctgcacccattaactcgtcatttagcattaggtatatctcctaatgttatccctcccccctgcccccaccccacaacagtccccagagtgtgatgttccccttcctgtgtccgtgtgttctcattgttcagttcccatctatgagtgagaacatgcggtgtttggttttttgtccttgcgatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtcttagctattgttaaccaacttaattgacgataatattttgcctattttgaaacctaaatagaatatttgaggaggaaaaaaatcactgaaatgttactttttttaaagtcattgaagtcatattttcaatttatttactcagactaattgaattttattattagaataaggataaacatcactttctgtaagttcacttactcattttctgcttaatagtcttctacagaagcatgctaaacctaaggacacaattaaaactagctaccatttaaacttaggagggcttttcttatctggtaaaagctaatcttatcaatcaaatgtagattattagttattgggcattttttacagggaaatactgggcctctgtcattcaacattatactgctgatctattttattcttatttataagtgttgtgctgttgtgtgaagtttttcacatcagtataattaggtgagaatataaacattaccttgggaaaaataatagatgaaaagttttttttgttttgttttttttttgttttttttaggcagagtcttgctctgtcccccaggctggagtgcagtggtgcgatcttggctcactgcaacctccacctcctgggttcaagcaattctgcctcagcctcccaagtagctgggactacaggcacatgccaccatacccggctaattttgttttttgtatttttgtagagaaaaggtttcaccatgttggccgggctagtcttgaactcctggtctcaggtcatccgcgtgccttggcctcccaaagtgttgggattacacggttgagccaccacaccctgccaaaaagatatttattaattatggaaattgagaaatggttagctcctctctcttctctttctcattatctttgtttcctaagccactcaatccatctttatggagattgttgacccatagctctagaagtcatttggaagaaaaattccttgggtgctgagactgtaaaatctgctatgtagaatgtagaaaaattgagaggattttttacagagactaattttattggaaaaggtgatactgatgatgataagagttaagcaggtaaagaatgaattggccaggggtcatagctcatgagtataatcccagctctttgggaggctgaggtgagaggatcgcttgagcccaggagtttgagaccagcctgggcaacatagtgggaccctgtctccacaaaaaattcaaaaattagccaagtgttgtggcataccacatctgtacttccagctacttagaagactgaggtgggagatcacttgagtccaggaagttgaggctgcagtaagctatgatggcgccactgtactataccctgggtgacaaaataagacttggtctcaaaaaaagaaagaattattaaagtgattattttaggaaatatgagaagaattgagatttatattggaattactgaagttaagagattaggaacagtttaccttaattatggaaccattgataataatgtctttactaactagatttctgattattttctttccgttgttcactagatcttcccaacgtttatttagtgcctactaactgtacttacatcatgaggaacaatttttgtgtgtagaggctaattttttatcatatgcctttaatctaatatggcataataaccttggatgaactacctgacttctctaggccttagttttctcgtttgtaaaaggttgatgatgttaagtatatcacaagattaagtgaaaattaatgtgtgtaaagtagtggttttcaaaatactttacttacatatccatgaaataattttgaaaaaagattcacgtatttttagtcgacatctgttatttgtcactgagtttaaatagttgaaaaatataatctgtagtgtattgaaaatattaagtttgataataaagtctttatctgtattttaaatgtatccaattaaatataaatactacagtgatgtgatagtactagtttgtaaaatatgtagacaagcttctaacattctcaaagtttacattgttcctttttgtctttgaagtcatttccatgcattttctccacagaattttatcatatataattttttttgtgctttgaagtgctttattgggcccggcgcggtggctcacgcctgtaatcctggcactttgggaagccaaggcaggtggatcccttgaggtcaggagttcaagaccagcctggccaacatggcaaaaccccatctctactaaaaatacaaaaaatcagctgggcgtggtagtgggcacctgtaatcccagctacttgggaggctgaggcaggagaattgcttgaacctgggaggcggaggttggagtgagccgagattgcaccattgcactccagcctggcgacagagcgagactctgtctcaaataaataaataaaataaaataaaagtgctttattgatcacctgtgagtaaggttctgagtgttaaatctcttctggcttgagttattacaattagtgcataattgattaaaactctagtagttatggtgccttgagtaaaggagggttttcctgacaccctgtttgaaaccctggagggtttaaaattttgggccatgtactcttgtaagatttggaatacatgagagatggtgcccttttattttttttaagtgagagaagggtatttgtgaagagagatgatggaagtagaatgaatctaacctcttatcatttgaccgcaggtgagttttcaggcagattgtcttgggaaagagaaaatagggaagttaaagttgtgaaaattgattctcttaaaattttctcatgctcatgtaccctgggaaagtctttgtttacccaagtttgaagttagtacatattaagtatataatttagaacctagtatatataaatagtaaaatgttaaaatatgtttagtacagcttaatattctcaatatttaagttctttatatagtatatttgttccatgatcttcgtcaaagtccttatttttaatgtctagatttttatttttattgatgtagaaatcctagtttatcgaattatattttcctttcctagttgttggttttctccagtagtcttataaatgcaagactccagttaaaagatctaataatttcaaagggattaacctttaaatgtttttacttaaaactgaagacaactgattgttcaacaatttcattttcagaactgataacgctactatagtcttttaaaattatggtagcttgctatctaggttttggtttgttttttaatctattcagaagataaggtacttctaaggcatggttgttttgttggtgagtcaggtttgagtctcagtactgtttctaaatatcagatagttttgaggtataatcttaaatattgttactgttaaagacaaaataaacatggggttaatgtctgttcaatgttttagttcattctgacttttacaatgaaaaaggtaaaacttattggacacaaagtgtcccaagaggtagataagttatttttaatagcacatgttactttctcctgttttataggaaaggaatcacgtctgaattgtgagaaaaacataatgggtcatttacagctattcaatttcattttcaaggggttggtgagagaggacatcagccgtttttgagatacagccccttgaggatttattcatttattttgtagttgataaggtgagaagaagcctttttaggataaagaaggaaggaacttaagaaagaactgtcttcaataagcatatactagtaataattaagtcttaggtaatgcttaccatatgccacgtacttacattaattcatttaatttttgagcaactctgtcaggtaggtactttcatcatccatatttttagagagaaggaaaactgaggcacagacagattaaatagatttatccaaggtgacacagctaccaagtagcagagctggtattcagactctgggagttgggcttcgtagttcatattcttaaccattgcactgaaatatcccttacttcctgtatcagtcatctcttgggcctagttgacacatatataattgaaaatagtagagtccagttcagagttagggaaggaaaattgcgaaatgcttaattaggcattctctgctatcaggattgctctatgtatgctgctcctctatctacctgctcaccgatattggaagagctgttagttcccacaacttggataccagtttctgtcagatggggcccttaattacaatgctaataatgtttttgaaacttatttatttatttattgagacagggtcttgctctgttgcccaggctggagtgcagtagtgtggtcatggctcactgcagccttgaactcctgggctcaggcgatcctcccacctcagcctcttgagtagttgggactacaggtgcacacgatcacatccagctaattttttgtgtttttagtagagacaaggtcttgctatgtttcccaggctggtctcaaactccggggctcaagccatccgccctccttggcctcccaaagtgctgggattataggtaagagccactgcacccagcctgtagctgttaccttttatggggaaaaatttaaaaaaagtttaatatctctttgagaagggacatttaatgaagatattttaattcagactttctgtaaggcaagaatgagatgcagggaaattatgtttaaatatttagcatgatatgccgttaagacttgggacttaatggaaaactttctttgttgcatttcgtgttctattaagtaggatttaaatgatcttattgtcatgaccattgtgcagaataatcagttccatgttaaaggattgaagtttaggatattcactttatataacattagattttatgaattaagtaaaggcttctgaccaacttaaataggatttttgttttattaccattgagtgggttggctattttgtgtttatatttttattttacagggttaaaacttaaatatgtatcttaatattgaagttttaaaaagatatatcaaagtttcttttctttctttttttttttttttttttttttttttgagatggagtttcgctcttgttgcccaggctggagtgcaatggtgtgatctcggctcaccgcaacctccgcctcccaggttcaagtgattatcctgcctcagcctcttgagtagctgggattacaggcatgcgccaccacacccggctaattgtatttttaatagagatgaggtttctccatgttggtcatgctggtctcgaactcccgacctcaggtgatccgtccacctcggcctctcaaagtgctgggattatagacttgagccacagggcctggccagtttattttcattgaatataaattttttcataatgaaccttaatttggcattttcctaaattctcagctcatgcttttgtgtccttttttattaaagatatgacaaaatacaaaaggctttcgaatactttggtagtgtttcttctttcagttctcttttcttcttaattttccttataacatacatagaattttaagataaatttatattttatagcaatgtatgattttttaactaaaatttgttgatcagtaatgatatatgatgcttctctaaaaataaaaatatttaatgatattatattattgcctgatagataacttctctagctggagattatagtagtagttctctgacccctagaaatgaatgttcttcattccaagtatcttataactttataaaggattacagtttaacctcggaattattttaatatgtcagtaattttggaattctggctattaatggtaattatcggtaccacataaaagtcatttatgagccgggtgcagtggctaacacctgtcatcccagcactttgggaggctgaggcgggtggatcatctgaggttgggagttcgagactagcctgaccaacatggagaaaccttgtctctactaaaaatacaaagttagccaagcatggtggcgtgttcctgtaatcccagcactttgggaggctgaggcaggcggatcacgaggtcaggagttcaagaccagcctggccaacatgatgaaaccctgtctctactaaaaataacaaaaattagctgggtgtggttgtgcatgcctgtaatcccagctacttaggaggctgaggcaggagaatcgcttgaacctgagaggcagaggttgcagtgagctgaggtcacgccattgcactccagcctgggcaacaagagtgaaacttcatctcaaaaaaaaaagtggcagcaatgcttcatttgttggtagttttaatgaattaaatgcaactaagaattaggtagaccagaaaaatatcactgaatgattaaaataatagaatctacaggcacgtaacttggctctggcatagctatctcaggccttcattcatgctattgtttcttaatttatatgaagttttaatagggcttgatttttctgactttctaggctataaaatattagaaataaattagaggctaggtgtggtggcatgcagctgtgatcccaactacttgggaggctgaggcagtaggattgctcgaggccagtagttcaagaccagcctaggcagcatagcaagacttcacatgtttaaaaagaaagaaagaaattagaaaatgttactattcttccaggttagaagtagactttcagattatattaagaagaagttgcgttaacttttttatcttgacttttttttttttttgagatggagcctggctctgttacccaggctggagtgcagctgtgtgacctcggctcactggcaacctctgcctcctgggttcaagcagttctcctgcgtcagcctcccaagtagctggattacaggtgcgcgccaccacacctggctaatttttgtatttttagtagagacgggatttcactatgtaggccaggctagtcttgaactcgtgacctcaggtgatccgcctgccttagcctcccaaagtgctgggattacaggcatgagccaccacacccagacttttatctttttatcttgacttttcttctaatgtagatcacaaacttttataaatataagatgtaataaatgaacttaatttaaaagtgaatagctggcagacccttagcaagaaataaaattaaataaaaagcagacaaaagtgtttaaaaattacagcaatcttggcccatttagacatggggcaaaaaaaaaaaatacctgaggcattctctctcgtttaaaagtcttgaatttttaatgatgatctctaagtaatgtatggaagtttaaatcagatttattaccttctgtcaagtagagatatgtaatgtactgaagaaagtcttttttagtttaaaagggataaaccggcatttgcaaaatttccttagtttttataagcaaaatatttactatatgtaatgtaaatctgttttccttctgttttcctatattttctttacttgtcctcctttgctgcaggtactgtactaaaacagaaataaagcttacttttttttttttttttgagacggagtctcgctctttcacccaggctggagtgcagtggcgcatctcagctcactgcaagctccgcctcccgggttcacgccattctcttgcctcagcctccctggtagctgggactacaggtgcctgccaccagcctggctaattttgtttttgtatttttagtagagacggggtttcaccatgttagccaggatggtctcgatctcctgaccttgtgatccgcctgcctcggcctcccaaagtactgggattacaggcatgagccaccgtgcctgggcagcttactttgtttctacttattttcagtgtaaataaaatccatcatattcaaagtaattatctttttcccccaggtgctacaaagtacacagataaagacaatggagggatgcttgtatggtctccatatcacagtatcccagatgccaaatgtaagttttctgaagttgaatgttaatgtcagcaggagtttatcagccaattcaaaatatgacttacgtttgtttttgggtcttatagattctcataagaaaacagttttgtctttgttttattttttatttttttattttttttttaatggaggttgttatattagaatgtttttccttttggaagatagtgggttgatcattccaatttgtgtcaggcccatgaagaatgaaaaaacctaggatctgatggcattgctgcttaaatcctcaagcaggggagggagttactatgtagacatctgcccaggcttttcctcagtatatggagcggtaaagacatgccttcaaacttcaaagagcccactatcattaccattttaaagaggaaaggggaaagaactgacttcagcagccatcaggtcatctttgtgctctccatttctggacggagaccttctggatcattgaccatgcacttcttgaatcatggtgtggctttagacttcaatgtgatgtagcggacctgatcctttgcggcacatcagatataggaaacgtgcaggtaacaacactaagatacccacccctccattcagttatcatttagtttattaaataacatcaacaacaacaacgacactgaacagttaattctagcagctgtaagataaacttgtctttttagaatatttactaacatcttaaaggtgtctgatttatttagtaccatgaaaattaatgatatcctatcatgaatagtaagttgaatcatgcttattgatgcaatagagctaaaaattgaaaactgagtatgtttctgcttacctgataaatctttctatttaagagctataaaacaccagctaaaggtctagctggtaatctagaaattgtgtgcccttgaagcattcctaacagaaaacatgaaattattcatctggcctgagactgtttaatgagaacctgaaagagactattggtttcccaggttcaatcctcattacagacaaaggttttcattcacaaactgagcatcagggtatcattgaattttgctggcttagttctgttttacacaatggttcatttcttagcaaagtggaaaacaaaattcagccagagtgtgctggtagtgtagtgttcatgcggaatatttaaatgaaggtgtagtgcaatggttttcaaccctgggtgtgcattggaatcacttggggaatttttttttttaagtacttatgtctagtctctttctcagaccaattaagttagaggcttcaagggtggatcctggatgtcttactttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcctggatgtcttactttttaaaagctcccacactgattgtaatgcatagccaggtttggaaaccacaggtcagttggtattgttcagcatatatttagacctgtcatgtatttaagtgctttgggctgtaaacaaaatataatatttgggttttctacacaaaaagcttaccctttggggggagatttgatagcatacatttaacaattttattctaatagcattattataagagtgtattcatatatgaagactatactgactaataatcacagcaaatacttaaaaaattcttaaaatggaccaggtgctgttctgggcattttccatttattaactcatttaatcataggaggaaggtactgtttttaacaactatttagagtgaggaaactaaggtacagaaaggtcaaaagttacttggccaaagtcaaaaaaatagcaataagccgataatcaaacccaggtagactagctgttccagaatcaggattcttaaccactgcttctcaaaaatatttccaaaaaagttaatttatacatacatacacatatataaattaattagaatcaaggcagagtgattgattatatggagttcacataaaactgagttctggtgaatgtgtcagacttctcagcaatgaggccttgaaataatagccagtttatcatcattgaaactgcttatctaaataattctgttggcttaattacgtatggaagataaatgaaagtggaatactcaaacatgctttgtgtaacaagcaggaagagctgaagaaaatttagagtactgaagcatacataaatgtgtcgttattatgtatagctggcaaaactataaactatcctttatacatcaatcaaaaatggaatggtaaaggctttggatcaactcgaaatatgtgaaagtgtcttaaacagctaagtctccaaataaagactattaaaaaaggaattatcttaatattttatacaacaattagatctattggctacccatagattggtctttttctgcatacaaaaatacagtaatgtcattgaatttagtaagtataatgtgtagtcgtagagataagttatactaaataaaattttaaaccaggtgagcatctgatcttgctatgataagtctctttttgtaacatttcatgggaggtgcctttggcttttttttttaccctggaatataaattgttttaatttgctatgttaagaacaaaagtagacctaggtaaatgaagtaaatgagaataattaattatataacattatttcattgcagtggatgaatacattgcaattgcaaaggaaaagcatggctacaatgtggaacaggtatgtagagaaacacttcagtagtaaggcttgtcccaatatttaccaaatctagattatctcatgatagtttctgtcctaacagcgtgcataagcttgaccagctattttatagataccacaaaagtcctagcaaagagtgacctttcaatattaaggagtttgcttttataaacattattcatctcaagggcttaaatgtttttctttcaatatatctgtttcttattctactttgagttctgaaagtttctggaagccttcagtattcctctggcaaatgcttaccaaaatgaaaagttaaggttttggtgtaatttggagtaagtgtacatagatagaactttaaaacaaatcttttctttataaaaaattttaatgatacaggtaattctcttttgactttttgttctacaggatctaaaagttaaactttacatttaaaggaatatttaagacttttaaattttgaatgaaatcacaaaaggctttttttgttaggtaacttcaaaaggatatatctatatataatatatgtctgtatgtagagttaagtctcttcaaataaaaattgtaacaaaatcaagaaattatctcaatattttacactataattagatctattggctacccacagattggtctttctctgcatacaaaatatagtaatgtcattgaatttagtaagtataacatacatagttatggagataagttatattaaatagactataatgtatttatatgatgtttattatgtaatacactctattatatataatatactatatatagagagacaaatatatggtacattacccttagtaatgagggaatggaaattacagaataatgaaatgaaagagatcttaaatctcatttcaactaagtattatttcaacctttatcagaattaatagtaaaataggtagatttgttttaagataagtaagaaaggtaaattatctgtaacctgggttatcaagagctaactttatagtccagttacatggtaaaggaatgtttttgtgaaattgagatgtttattttatatctatctaaaggtagttaacttttttgtggattttgaagcctttgattgcctattttgtttttaagccttgtctttctgtttaatgtttgagaaagttaatcctttaaaataggactataccttaatatgtttgttttcctgtgtattttaaaggactgttatcagagtacagaaattaacaaactcactatttataaagttcctatatctcttggaaaataaaagtttgtgccctaaatgatgcttaataccttataataaagagaaaggcctactaaaaatagaaggggaagttatggaatttttggaaattgtccatttcagtctttgttatgatttggtaatcaagtcattgaagttatttatatgcctcctaataattctatttatatgttctgataataagtaaatgtggtttaaaaaattgttaaagttgcagtggaggtacttttacttcttggacatggttagcctgtgatacacttgtaaaagattaaaacttaaatgtctctctactaaaccccaactgagcatttctggctttgtggcatctgatcatttcattcaagtatggatttattggaaattttccttttagcaaattttttcctacatattgacaaattttaaaatgtgggttaaactcttggtgtgaacctacaaatctgctttgtagtcactctcctcagctcactgtttttcctagattctgcagcaaatatggtatgtaagaacattcactgttctgaggccctgatttaaaagaaataaataaatgaggtctgctacctgagcgcccctgatttaaagtcccaaactgtgagtctatcttcagtcgaagtcataggcttaagattttaatctaatttgtgtttaactttcttaagtgtgatggaacataagtccattaaaaccaaaggggaatgatttctcttcaaaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatggtatggtaattttaatcttactgtggttcatatgtgaatgatatcttaagctactattaaacacttcctaattattaaatacaaaaacattcttcaatttaattttaaaaactatttgtaagtaggtatatttatatacaatcctgttttctgcaaccactcttacatgacagttatgtgctattgcattatagtaaattagcttttattttgacttaaataacatgtaataatatacatgtaataagagttatttcgtatgtttattgttccaggaaaaaaaataatttcaactttatttttaaatgtttcactctttgacacgaggattttttccaatttatatatttttggatatggaagccctttttaaaaaatcccatattaggccgggcgcggtggctcacgcctgtaatccagcactttgggaggccgaggcgggcagatcatgaggtcaggagatcgagaccatcctggctaacacagtgaaaccccgtctctactaaaaatacaaaaaattagctgggtgtggtggcatgcgcctgtagccccagctacttgggaggctgaggcagaagaatagcttgaacccgggaggcagaggttgcagtgaaccgagattgcactactgcattccagcctgggcaacagcgcgagactctgtctcaaaaaaaaaaacaaaaaaaacaaaaaaacaaaaaaaatattatttcaatattgtccagatggtgctgctttttttctttctttcttttttttttaatggagagaaactgctctgtatttctagttcctacatttttagtattgtgtcaaaataatgtaaatctgagaagttcctgcattaaacgattttaacctgagtagatgaaaattagataatatttgcaaatatatctaggtgtcttccataatggaagagaacatttttggtggggaagttgcatccttgtttgttactctgacagatcagtgcatgatcattagtcattttaatactcagagacttcatttgatggccaaagcctgtttgcattatttaccattttaagacctggatttaaaacaaagttattcagaaaaatttgttaagaattgaatagcttttctttaaaacatcttgctaattgaaagaagcaagacacaaaaggtcacatattgtatgattccctttatgtaaaatgtccagaataggcaaatccatagagacagaaagtagattagtggttgccagggactggtggaaggggagaatagggaatgattgctaatgggtaccggatttctttttgagattatgaaaatgttctggaattagatagaggtggtgattgtacaagttagtgaattcaccaaaaccactaatatgtacacttaaaatagagaattttattttatgtgaattacatatattgaatactaacatggctgcgctgggaacttctggggacattctcaccagattagtttgtgacctcttcccctcctctcccagaacaaataggaatattcattcagaaatgtcagtgaaattgatatgggatactgactgtagtagtactttttagctctataattcataaaggtacccatgaaatatttttttattatgcctttactaaatagtaaagatatcatcaaaattattcattttgtttatgaattaaacttgctgatattaacatgattttttttaagcttccagataagacaattgcaagccttgtaaaatattactattcttggaaaaaaactcgctctaggacaagtttgatggatcgccaggctcgtaaactagctaatagacataatcagggtgacaggtaggttggttaccttcatatagttacattgttagggacactgcattgtattgcttacatttcctaaggcagaaaagttatcacaacacattgtaaatattccttattcttacatttatgtttctactctgacaagaagagccaagtggttagaagttttaatattaagagctctttcacctcttttaattttaatcacaaatgcttccttttagtattgatatatttaatacacatatttagaatatattaaagaatatgttctatgaaaaaggtctttttataattacctgagtaactgaaacccttattattgaggctaaatcttttgatagtataaaatcattttgtttcatttttgtctgtctttattctccaatgaaatttaagtattatgtcaatttgtatgtgttcccatttcccaaatgatatttctttttaaatccctttcccactgggtctctgtttttgagctagaagtgtttgctaaaagaattctgtatacccaatgagataaatgtttctgaacactacagaaatctgaattaaaagctcatcttcccaagtacaactcttattctgttaaataatatttagtaaaattatttagatatatatattacagtttgataagagcactagaatacaataaaaagaagggaattggttgggcacagtggctcatgcctgtaatcccagcactttgggaggctgaggcgggcagatcacttgaagtcaggtttaagaccagcctggccaacatggtgaaaccccgtctctactaaaaatataaaaattagccaggcgtggtgctgggcacctgtaatcccagctacttgggagactgaggtgagagaatcgcttgaacccaggaggcagaggttgcagtgagccaagatcatgccattgcactccagcctgggcaataagagtgaaacgctgtcttaaaaaaaaaaaaaaagggaattaagtgtactaatttttgtttcttctcagtgatgatgatgtagaagaaacacatccaatggatgggaatgatagtgattatgatcccaaaaaagaagccaaaaaagaggtaatgatgatcactagaagtacttgtgattgttctacaaatctgctgaaaaagaatgaacagtacttcgtattaagaaaaactttttaatgtaatgctttatgagatagtaaatttcagtgttaattagcaatacagtcatacctagaaccccagttaaccaagttgttgaaagttgaaaataccattgaaactggaaaaagatctgagtttgtttaaacttagcatttgctagttatgtgacctcattcagtttagtgactctcattcttctgaagaaacccaatgccatgggccattcatcaccttaagctctttcatcaatgttatttaaaaaattctcttctactgtaattttgtgttttactgattttctttctactgctaaatattctcaaattccttaattccttcattttctcccccaagtctgccttacctttgtttcccagaaacgtggtcccaatgatcaactattcgaatctccttctttcccatttccccattcctttaactccccacttcccttatccttctgctataccatccctaaccctgtaacctcatgatgctggattcgttgctattcacggtctaagagatgcagcaggagaaaatgatacaattatgtaaattgttgctactatgaaaaacagtttccagtctcactgtagtccttaagtgcctcagtttttaatctctaagttccaggtttttttcttagtaaaatgaaaataataggattgttttgagaatcaaagaggtaatatgtataaaagcactttttatagtacccaggacatagaaatcttggatacaagttgctgttgttttatctgggcagctgttttgaacattcttcccttcctacacattgcctaatacccctccacccctaaaaacacttggcagataacttcatccatgtcacagagaaagtgtcagacagaagctcccttaaattccagcccttcctctaacctctgtgctaccatactggcctttccaccgtggtatattagtacttagaacatattacagttactgtattttgcccactaagctgctaactctttgaagtcagggactgagttattcatttgtatcccctaacactttgcacagtacctggtatatggcaaatattcaataaatgttgattcaataaatcattgttgaatgaacagtcttgggccttaatatccctctctcacagtaagaaggatcttctttcttttcctatacaatttcattgcttgtgtgatcctatccatcccttcgtatctactctttctccaccagttatcctttgtctttcgcatattttcaacctttcagtgcagccaaaaagtatgttcaagtcttccatttaaaagcgtttctctggccgggctcagtggctcacgcctgtaatcctggcacttcgggaggccaaggcaggcagatcacctgaggtcaggagttcaagaccagcctgaccaacatggagaaaccccgtctctactaaaaatacaaaattagccggggcgtggtggcacatgcctgtaatcccagctactcgggaggtcgaggcaggagaattgcttgaacccaggaggcggaggttgcagtgagctgagattccaacattgcactccagcctgggtaacaagagcgaaactccatctcaaaaaaaaaaaaaaaaaggcatatgtcttaaccactctagaaaacaaatcatccttcttagcactacgtcacttttgagtttgctttagtcaggcagcttctgtcccaccacttcactgaaactgctgacaggttaccagtaatttcctaaatgccacatccagtgatcagttgtattctgcttgtgctttctgtatcaaattactgactgctcccttcctgaaaagctgtctttgactttcgtaatgccattctgattcccatctacctttttaaccattgtgtctcaattttagtggcatctttttcttactctattccttttatcattattctttttaattctgtctctcaaaaaactgtgagatttgatctctctgttcttctctgtgtgactgccttcttcttaggttctcgtctcctctgaattatcctaacagttttctctccgattatctccgtgcctccctttccaggttctccacaccaccctttccagtccattgactgccctgttgccaaagcaatcctttgtaaagttgctgattcactgcttgcaatccttacatggtgtcgtctgtaggataaaacacaaactctccagttaggcattccttacccttccccatttatttcagattactaacagtgttttagatatgtcgtttagttccctggcttttgtcctatgattatgttggtccctttttttctggaattcctttcttcccaaatctgcctaggaaattcctcacaactctacaagatgtagcttctctatgaaatcttgtgccttatcttgaattgacaacctccttatttctccttaaatctgttgcagtactaattctactgagtggtacttgtttactcatagtttcccctccctgccttcctgcgtggtgagctctttaagagcaagaatatattttaactattttccactcccagggactgatgcatagtaagcatttagtaaaattttaatgaatgagaatacatgctatatgctcttaattgtgatataaacctgaaaacttaagaatttgctacctagaaaatatatgtatgtatatatgtatgtgtatatatgtatgtatatatatggaatatatagttttgcccaactatgcaagatgatgcatactcatttggtcttttgtttgcttatgatctcatcttaccagaaaataatatgaggggagtataagttaaaaagttttaagaggatactgcagaggtgtggtccaagactagcactatgtgtcagcagcttcattcatttctctgctcattccaaacaataaggataccaggcagggaaagaaactacattattgcttttaatatagatctttgtagctgcttctgcatgttgttaacatattacatagaaagttttaattttaacttttaaaagttgtgaactatttaaagaaaaataatagataccagtgtatctaccactgagctgaagaaacagaagtcctgtttgtgtttcctcaattggatattcttgttttttttttttttttgagagggagtctcactctgtcgcccaggctggagtgcagtggcacgatctcggctcactgcaacctccacctgggctcaagcaattctcctgcctcagcctcccgagtagctgggactacaggcatgcgtcaccatgcctggctaatttttgtatttttagtagaaatggggtttcgccatgttggctaggctggtctagaactcctgacctcaggtgatccacctgcctcagcttcccagagtgctgggattacaggcgtgagccaccgtgcccggcctcaattgcatagtctcaccttctctctagagggaaccactataatgaaatttctaaattattcacttctttctttatagttttatcacatatatataatcacatatgatgatatgattatcatttagtttcatttatttcatactttatttaattggaatcatattgtatgtattcttcagtacttgccttttgttattatttttgcgattcatttttattgctatattatagtgttccattgtatacatatactgcaacttattcactctccaattaataaacttaatttccagctttttattacggacactgctgatatgaacatgttctggatacacatgtctgagagttcctttggtacaatagttctcagctaggtttagcactgaccccataggggacatttagaaattatggaggtgttttcattgttaacagtgattgtggggcatttcagttgtcgagtgggcaggagaaaggggtgacaactatactgaagtgcaaagcacagattgtttcaccaaaatgccaacagtgatttactgagtaacagggtcccaggattctttggaatggagtcactctattttagggaatagccacattaaactttcctaggtaatggcataattgttttctatagctgatatacctccactagactgtgagaatacccattgtatacttccttgccaatgcttgatcagacttttaaaatgttccaaatctggcaatatgagaaggcatttcattgtgtcctcagtttcattcatcaggtaactactgaggctgaatgtttttctatctgtttattagctgttgttatatgtttcgttcgtggaggtttttgttttgtttttttagagacagaatcttgcttattgcccaagctagtgtgcagttgtgtgatcatagccactgcagcctcaaacttctgggctcaaatgatccgcctgcttcatgctcccaagtagctgggattgcagacgtgagccagcatgcctggcttgtattttttttttttttcacccatttttccactgcgtatttgtctttttcttaaagactgaatataaaaagttttttcttattgaattctttgtatattctggatacgagtcctttggttaacagcaaatatcttttgccagtttgtggtttgtgtttttactctctacagggaagtaaacagctatttcatcaaaagcatataaattttaaatttattatttatttattttattttattttatttatttatttatttttttgagatggagtctcgctctgtcgcccaggctggagtgcagtggcgggatctcggctcgctgcaagccctacctgccgtgttcacgccattctcctacctcagcctcctgagtaactgggactacaagcgcctgccaccacgcctggctaattgtttttttgtttgtttgtttgtttgttttttgtatttttagtagagacggtgtttcactgtgttagtcaggatggtctcgatctcctgaccttgtgatgcatccgcctcagcctcccaaagtgctgggattacaggcgtgagccactgtgcccggccaattttaaatttaaattccagtattcttttacattttcttttgaaaattttaaactttttctctttttacattgaagtccttgctgtagcagtaaataagttcatgttgtgaggtagagatcctttatttatttatttatttatttatgtatttatttaacagttgggggtcttgttttgtcacccaggctagtgtgccagtgacacaatcatagctcacttctggcacaaattcctgggctcaagccatcctcttgcctcctaagtagctgggactacaggcatgcaccaccacacccagctaattttttaaaaaactttttgtagagatggggtcttgctacattgtccagactggtcttgagcttctgggctcaagtgatcctcccaccttggcctcccaaagtgctgggataacaggtgtgagccctaccatgcctggctatttattttttaatacggaattgaatatctttttcaactggtctgcaataccagctttattttatatgaggcttacgcatatgcctggctctctattctgcttctgttgtcagttaaatattccttgctaatcccacattttttcaattacttataataagcctcataagtcttgatagttgctagggtaagttctgctatttggtggttcttcttaaggagtgtgtaccttggttattcttggacctttgctcttcataacttatttgtattacttttgatttcctatatagtgatttatattacctgaaaataatagctattttgtttctttttagtccttgtatcttatttcttctcttgctgaactggttagtatcaccaatataatttgaatagaagatatgatagggaacatttttctgatcgtaaagagaatcgtttttgtttcaacatcaagtaggttgttattaaaggtttttgactcattcacattgctggtagttgatgctagctgtaggttggagcaattccatttggcctctccaatttggtggtctctgagtaatctaacttcttgccataatggctggtttcctccaacgtaatcaatcccggaagcactaagtggaaactactcagctgtttctggcctagccttgaaagttactcagagtcacttctcttgcattcagtggttataagtgagttactaaagttggttcagaatcaaggggaaggaatatagacccctgcttccccatggcaggaatgttgaggaatttgttgacatgttttaaacctccaagcccagagtatggaattttcataaatgttttcccatgtgtgcttagggatattatcttggtaacaaggttttatatatgtccattaatttaggtttgtcagttctgtagttgaaatccatattcttactgcttgcctacttgatagcttggtttttgttgtctgcttatgtgatcaattattctgatcactcaattactgagaagtagttttttatatgttgaagttagtgttattaggtgcatacaaattgttttatcttgctgctgaattgagccttttatcaatatgtagggtctcttttattggcttctgccttgaagattattttatctgttatgttgatagctccaccatttttcttctgttaagtatttgcctggtttatctttatcattttactttcaacatttctgtgtcctcacatgttaagtatgtgtcttataaggagcatacagctgggcgtatgtattaatattttatctgaagagttaagcccatttatattgatcacatttagctgatgtatttttgttctttcttatttttaccttctattcaacttgcttttcctagtcttctttcccttcattcgtgtcctatttttggggattaagaatccatctcttactcaattttctttccctctgtgtttgtttgggatgtttctatatttcttttctttttttttttttttgagacagtctcgctttgtcacccaggctggagtgcagtggcgtgatctcggctcactgcaacctccgcttcccaggttcaagtgattctcctgcctcagcctcctgagtagctgggactacaggcgcatgccaccatgctcagcttatttttcgtatttttaatagagatggggtttcaccgggttagccagtatggtctcgatctcctgacctcgtgatccgcccccctcggcctcccaaaatgctgggattacaggcgtgagccactgtgcccagccgggatgtttctatatttctattcttattgtatactctgaaaattttatcctgcatatttaacttaaaatctaatattgatgtctttattgactttctgattaatagaaggcccttagaatgctttgactgcatccactaccatcctgatttatatactagttttgtgcacggtttgttacatcttggttttttaaatctcacaaatcaaacatatagtccgttttgtttagatttacccacatttttaacttctattttgcccacccttctttcctgaatctaagggctttctttgaaaataatttcctttttcctgcagtatatcctttagaagcccatttagtgaagacctgttggtcataaacagattttttgagacctgggtttaaagtgcattgttctagagaggatttgcatttgcttctgttatttgtctctaggcactaccaatctaagacactttaaaatcttgatttggggtttttcaggcaaacagatcatataaatttaggccctaaacctgcctgaatggaggactgtggttggggcactcttgggagacttttttttggtttctttccacccagccaagagtgagatggacatggctcccattaatcaccccctccctctgcagagcaggagtgtttttttcctacttcacaaagtgatggagttccccttttagcattttggcttgtctcctgtgccctgcacctgttgtccattgaagcctggctttaggcaaatgacaactactgcatacttgattctccctctggattcttgctttctcatcatttctggcctcggaagaatttcctcacttccctgccagctcagaagtgaatgttaaaagactttaaaaaatgtttgatcagcaattttagtagtgccctactgggaggagtttctctgaacatcagatccgccatgtgttgcttggaggtagcttcgagcaattaagtggattatgcttcataataaatttttagtgggtgcagtggcttacacttgtaatcccagcactttaggtagccgaggcagtggatcacctgatgtcaggagttgaagaccagcctgcctatcatggtgaaaccccatctctactaaaaatacaaaaattagctgggcatggtggcgggtgcctgtaatcccagctactccagaggctgaggcaggagaattgcttgagcccaggtggagattacagtgagccgagatcgtgccactgcactccagcctgggggaccaaaaaaaaaatttttttttgttaacgaattttactaagagttccttttctaagaaattggagtattaggccgggcgtgttggctcatgcctataatcctagcactttgagagcccaaggtaggcagatcacttgagtctaggagtttgagaccagcctgggcaacatggtgagactcccgtctctacaaaaaaagaaaaattagccaggcataatggcacacaactgtagtcctggctactcaggaggctgaggtgggaggatcatttgagcccaggaggtcaaaaggctacagtaagcagtgctcatgccactgcacttagcctgggtgacagagtgagaccctgtctcaaaaaaaaaaaaaattggattattaaatatattcattgaaataatcttcaacctaaaatatatagtttctagattattctttcagaataacgtgtttttatatcatactttaagaacaacttataatgaaataatgcctaaaacttcacagtcatcattgttatacttttaactcttccgagacataaatttacttttatcatatatattattttttattttatttatatttttattatatttattttattacattttatttataaataaatttataaatatttataaattattttataaatatatttataataaatttataaattataaaattatttataaatattttatttatattttattatatttattttatttattatatttattatttattttatttaatcatagatttggaagttagaaatattttcagggttaagataattgtgtcccttttaacctttagaggcgtagttttctttcagcaactgtaaagtaaaaatgaaatgttatctctctttaaccagctgtctaatctgctattgtcataatttctaaattgcccccttttttctttctaatttttatttttagaggaactttgcatttaataaggtggcttttccccccctttattgctgagggaaaatatatcacatcttgaagtacataggaaagtttagagtcttaacttattttttcacttattcctagtcctctgggcctaaaaatcaaacatttgattgagtggattaagcaaggatatattatgttgtatgcttttcctcccagttggtgagtgttatgtgtgtgtgtgtatggacttgtacataatatataattggttagaagtgtttttttatgtgtacttattgcagcagatacttctaatattaatagactgttttcactttatacatttgtgaaaaccaagtgacctgttattctgcttttattctcttagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggtattttataaaaataatatttttaatgattctgtgcattttggctatccgcttttaccttttacctaggttgagctcagttgtttgcagatttttctcagccatccacttatgcaggtttcattttttaaagtttatcttaagtccaacttagaagatacctctgcctgttctagatttgaatcccagcattgctgcctgttagctctgtggtcttgggcaaattaacctctgtaagcttcaatgttctatctataaaatcggggataataatcattcttctcttgcaggttattgggaattatttgcagtgatacatgtagattgtttagtagtgcttggcacattttgagtgctcagtgagtgatggttgttgtcttcatcatcatcatcatcattatcagtagtagtactagtagtattgtaagggcagcatcatcataatcagatagtagttaaaaatcagcatctagagtcagtgaacctgttaagttctaaccctggctataccatctcttcctgtgtaaccttagaggagctctttaacttctttcagcctcagttttctcatctggaaatgtggataatagtatagtggttgagaggaattaaacaagataatatatggtaagtgcttaaaacagtgcctggcgcatattaagctcagttattcgttgctattagatctctggcctttcttagttgtcttttcctattttttgtctgttttgttatttttttcttatcccttaaatctagatattcttctaaatctgtactttcttggtctatatcaaccaaccctatacctatgccagtgacttctgaatcttatttctcaagctgtggcttttctcaagctccttagctatagttccagctgcctgctaggtcttccccaaaagatttttttctctgtttcctgtctgttgaaacatcagaatcatcttttattcatcccctgctgttatccctttcccaacacatgtaaaccaaagtggtaaccaagttatgtgagttttgtctctgaaatttcctttaaatcaattccctcttttttatctcatcactactgcccatttaggctcttgctatcgcttgcctgacaataactatcttgtggattctttttttctcctcattttttttattttaattttttgtagagaaacgttcttgctatgttacccaggcttgtctcaaactcctgggctcaagcaatcttcctgcctgcccctcaaagtgctgggattataggcatgagccaccacgctcggcctcttgttgattctttctattacttctctttagctggaggttacacattgttgccagtgttatctttttaaagcactggtctgatcactgtcactcatcttaaagctctttgttagtttctacttgcctttagcaggttacagtagaggtagacagggatttataagaaaatcatgttaagaaatttgaaattcatcctgagttaggaaactgctgaaggactttaaggaaaggtggaccatggtcatatttacattttccagctatatcttttgcattttcttgtttgtttgtttggttttttttttgcttttatagttgctttagtgattacaatattcatccttagcttatcactgcatatttagttaatattacagtagtcctcccttaatccgtagtttcactttccatggtttcagttacttgcagtacagtacaataagatattttgagaaacagactatattcacatagcttttattacagtatattgttataatttttctatttttaattagctattgttattctctattgtgcctaatttataaactaaactttatcacaggtatgtatatatagggaaaaacagtacaggttgagcatccctaatctgaaaatctgaaatgctccaaaatttgaaactttttgagcactgacataatgctcaaaggaaatggtcattggagcattttggattttgggttttcggattagggatgtacaactggtatatattatgcaaatatcccaaaatcccctgaaatttgaaacacttctggttccaagcattttggataagggaatactcaacctggatatgttttgatttggtactatccacagtttcaggcatccactgggagttttggactgtatcccctgcggatatgggaggactactatattctgcttacaaaatgtaagaaccttgcaacagtatagtgtgggatcaagattctctatcttaaacatgttcagatttttctattccttggtcctggttattcacccaaactgcttttctggttctctaacataggccacatttgcttcctctgctttcttaccaaaacttattctccaaccctttctaatctagcttctgccccgtatggtattccagttctactgaaacacctctccgaagatcatttatgggctgacatggtggctcatgcctgtaatcccaacactttgggaggccaagacaggaacatcacttgaggccaggagtttgacaccagcctgagcaacatagtgagacttcatctctataaaaaaaattttaaaaatagccaaacgtggttgtgtgtatctgtagtgtagtcctagcaacacaagagagtctgaggagagaggatcgcctgagcctaggagttcaaggtttacagtagaaaaaaaaaatcacttatgaacaagtggccaacatctaatgctgccttcctggtttttagctcctttgactactcagtaatgtttgacactgtcagccatgtctttctttttggaatttctttcacttgactttgtgactctctggagtatgtgtgtttatagtacatatttagaaggcagctatcctcaccactataccaccaacgcatctcatatttggttaaatgcttagcctttagtcaaactatgaatgcaagatgcctaacttccaaaccacagcaatcctctttagaaaacttctaaatcatttgctgtaatactttaaatgcactaaaaacataaaggaataaagtgtactcagtcacctgtattcatacttcattctcagtactactactcctacacttagggactatttttattgatttttttagaaggcactttaagctttaacttcctaacttggttattcatttgatgtgtgacacagtaaaggtttgcactcatgggtttacaaatcctgttaaccactgctacttttatgtcacaaacatctcatatgcagtgttcaaactgagttcttccacactcaccatagttatctgttccacgttttgtattttctgtctcagtgagtagtgccacatactctcaattactgaagccagtgaccagttagcctcaattccccctaattctccacaatcaggtatttacaaagatgtcttggccgggtgcagtggctcatgcctgtaatcccagcactttggaaggccgaggcaggtgaatcgcgaggttaggagttgaagaccagcctggccaacatggtgaaaccccgtctctactaaaactacaaaaattagccaggcatggtggcaggctcctgtaatcccagctactcaggaggctgaggcaggagaatagcttgaatccgggctgcagaggttgcagtgagccgagatcgcgccactgcactctagcctgggcgacagagtgagactctgtctccaaaaataaataaataaataaataaataaataaataagtcttaattttgtttccaaggtatttctttaatctctgcataccactaccatccttccttcattcctacagttttaatgaaagttttcttaattatttattatttctcacctggattgttaaattaatttccatcctctttaccctattttcttcttcacattactaccagaagtgtctttctaaaaggcatatatggtcattttgttcccttgcttaaaaatcctttaggtttccttcaatctttaggcaaaattaaaattcctcggtctggccccagtctaacttcttgccttttcaccttagggcttttctgtcttcctaagcgttattctgcctggaatgcagtccctcctcccaagcttgtctgccagtttaattctttaaaactcagtttagctgtccttttctttggaacactttccctaatcttccccaccacctgttcatcaacatatatagaagcacatttactctctcattctctctctttctctctccaagtctatgttaggtgttttagcgtttatcataggtttatgtttacttatctccccactagtctatgaaatcctcgagaattcagactttacattttatctctgtatgtctatctaacatggccagctgactacccttgaaccatcctagattttatgcattttagctgtggttttaagatctctagtgaaaatagttcataaattataagtatttcgttgtccacactaggggggaaaaacagaggaaaaaagtaaacaatcctaacccttaacagtctaaatggagactaataatattgctagtagagtaaaagttaaaaacttggtatagtttaaattcaggttgtatctcctagccttaggaaggtttcttaacttctctgtgccttatattcctcatctgtaaaactgttataatataagtagagtctgttctgctataactttttttgaaaatgtggatttgtcctaatgcagttaatatactctggaaaaatttgagcataacatgaattttttgtttgtttatgtatgatttttgtcagcaaaacaaaatgtacccagctgaactgagcgcacacacatctcaaacatgtagcagctacctcaattcactgtatgttatgaaccatacatatatggtgttaaaacttttcatctgatttcaagtaaccctcctaccacttgcataataattcacaaactacaaccattttgactcccacttccataagcaaccttcaggttttttttcaaggtaaagtactgtctttgttgtagcatttatggattaaaaacaaatcatttagattgtgtaaaactgtgttgccatttttattaggttcctgtcttatgtgtcattgaagttttttaatgttgtgtcccaacctcttttaccctacaagccctgtggtttttattatgaattttgcatagcacacactgacttttctttctttctttctttttttttttttttttttttgagacggagtctcgctgtgtcgcccaggctggagtgcagcggcgcgatctcagctcactgcaagctccacctcctgggttcacgccattctgctgcctcagcctcctgagtagctgggactacaggcgtccgccaccacgcccggctaattttttgtatttttagtagagacggggtttcaccatgttagccaggatggtcttgatctcctgacctcgtgatccgcctgccttggcctccgaaagtgctgggattacaggcgtgagccaccgcacccagcctttttttaagacagggtcttgctttgtcgcctaggctagagtgcattggcataatcacagctcactgtaaccttgaactcctgggcttgagcaatcctcccacctcagcctcctgaataactaggactacaggttcatgccaccatgaccagctaatttttttttttttttttttttttcatagagacaggttctcactatattaccagggtggtctcagactcctggcctccaaaaacactaggattttaggcatgagctactgtacctggctagttcagtgacttttaatgtatttatcatgttatagcagaactgattgtacttacctcacagagtggttttgagaattaagtgatttattacatataaaggactgagaatgatgttttatatataataaatatctaataaatgttagctaccatcatcattactattggaaaaattcttatttagtcaaaacactatggtaatgagaaaaattggtggaatttaattcctatgtatgccagttgtctttggttataaaagttgttgctaaaagatattcaaaaccatgatattcaaagatattcagagtgttttagtctgttagatgtttaattagttcatacatgtataagttgaattagtggcatgtcataccccaagtgtgattagtatgactattctcctaaaataaaatttaagaggggtttggaatatattcttttcacttaattgagtactcacaaatttacctaagtacgcgatctgattcacatttggggttattttgttgaaggttcagaatgctaagcaagtaaacagtgcacttaaacagaaaatggaaggtggaattgaagaattcaaacctcctgaggtatgttattgaaggatacatgtgattaagtatagtgaaaacttgttttttcagttatctagtgcccaagtactattttggtcacatgcatcattaatactttgaaggtttcataatatggataatttattatgtctctttttatttagatgatcttatgaggcttggttaatcattttgtatttaagttaaattatttatttcctgcccttagaaattcatagcaagccaacaattagggaaaatagtagtaggaacagtgtatgtgaaactagaagctcattgacgagcaagctagtgtatttctgggtctacagcaatgtttgctgaaagccctttcctgcttgtgtgaattggtaacacggcaagaaaaatatcatgaaaacaagctagattattttaacgaatttttattttaatttaagataattgtctttggctcagcttccacttatgattttagtatgtggacttacattcttgtacttacaaaaacaaggtatagattgaccattttctcaagtcttctatttcagttgaaacctaaatatgtttttgatacctgtggtaattataggggtacttaacattcccttaaggtccaatcaggtctttttctaggagcttctattatatcttttttctctctttaacatttccttattatgcttcatatcctggatttgcctttctgtgtttgtgataatcaaataatcttatttgttcttattgggactttttttccccagaaggggaaaagaacttggttgactgaaacatctacagatgaaatttatgtgaggggctatggggaggcagaacagtagtacttcagaaattatgtaccatatgccatcttagtcatcagtgtctttcagaaaggaagacttatgaaaaaagttgtttttcactgttttgaataatctctttcaagaaggttaggttatggaaaagagtgaaaaataatacaaagactgatatctcattccttgaccacaggtagactgacaaacattctagtaacaattatttaaggataatataataccaaaaattactattttattttgttatattattgcaacaaaaattattttaattttgtattatgcactaaaatgcatgaaagcaaacaattttaactgtctataattttgtaatctaaaatgtaaataaaataccgcagatattaaaaacattatgggaatagcaggaagaacttgatactagtaagtgtgaaaaataaaacattgaaattcctaggaaaatgtgtcttatcaaaattgcctgaaaaagaaagaaaagctgaataattagtaatcattaaataaaacgaaagaataattaacatttttctctcacaagaaaactccaggcccagacagttttacagaaaacatttactaagttttcaagaaaaggataattctaatctcatattttccataaaattataggacagtctcactcattaactttatataaagaaagatgttaaagtccagtagcattttatagcttccctatgtgctatctcatttgatttttatgtaaatccatacagataggtgaaccagatactattattttacatgaggaaactggaaatcagggaggttaaccaacttgttcaaggtgacagaactagtaaataatgaaactctggctatagctcatcttttcagagtcctgattggacttctatattagtatatgtcatgttgcctcttacatttggaagtttttatgtaatagcaaaattgtatattacatttccacattttaatgcagctattgggtgagaagttatcagatatttattgtaatttttgatttattataaaaataatgatcaaaataaaataaccaaaatgttaacactccaccatccatatactgaagtttggatattactttgggttgatttattgaacttatatgatatgaaaaatgtatatatgttgtatcatctagagagtcctcaggatatacttatatttgtcatattgttcttactgctttggagaggaaggcaacttgaatagatgtgtttcagattaacaagtacagtaaagaacttgaagaatcaggtaatctatctccttacctttagtttaaaccatatctaatcaaagaatgttaataagctttggaataattacaataagccatcaagtgaagtaactctactaaaagtaagctgttagtaaagtgctttacttattaatttggttgtatttcttattttcatttagggaaaaatgggttgaagaaagtccattcacttccacaagtatttattgattaactgtttcatatgaggcactgtgttaggcccggtgagaagtgtgtgggaagggggaacacaaagatgtggacaagatgatgtgatttttccacctgctttttaaaaaaaaagaacttgcagtctagatgttataagacaaactgatcaaagttgtatgatagatttataagcaaagtatacagggaaacaagtgggcattattcattctggcaaggacagttagagaagacttcttagagggggaatactgcagctgaggtttgaaggataagagggatttttttgcacatacagaaaggaccatagaggtcattccaggcagagggaataatagcaatggtttagtgttgaacagtacattcaaaaatataaatctagtaggggaaaattaaaagcacttttaaaaatgagtcaacaggtattccctgagcacttattatgtgctcattattgtgctaattaatagctattgaggattccatggaaatgtaaaacagtcttttctcaaaaagcatattgtctacttaggaaggcaaacttggatgcagagaaggaatgaacatggtatatgagagatgttagcagggttgagtaggggcatctttgtgatagacatcagtgggcagggtcagagtataaagtccttgtgaaagccagaaagagggccaggcgtggtggctcatgcctgtaatcccagtattttgggaggccgaggcgggcggatcacgaggtcaggagatcgagaccatcctggctaacacagtgaaaccctgtctctactaaaaatacaaaaaaattagccaggcgtggtggcgggcacctgtagtcccagctactcgggaggctgaggcaggagagtggcgtgaacccgggaagtggagcttgcagtgagctgagatcgcgccactgcactccagcctgggtgacagagtgagactccgtctcaaaaaaaaaaagaaaagaaagccagaaagagaagtttgtcttttaaattaagtcaaatggaaagaccctttagtttctttagtacagaaggatgtaaagaaaatttttaattttagaaaagttatgacattattatacaggataaattagaacagggaaacttgatagctgctaaaatattaagcatgtaagtcgtcaatgataaaggggtatcagtagggttgggtattagttataggaatggaagcaagtagtaaacccaaagaacattgcaaggtagaaaattaatatgtctccttgaaagtatgtgagagtgttgagggtgtcgctggcatgtcttctgctttgatttgttttggatggaggtaaatgggtaggtggaggaaagattgatgaatccagaaggaagaataagtgtaactgaaaaaagagtgctttttgaagctgtaaattccccatctatagttgttttcctgcaaaggtagacgacatcctttcattatggatgttgggtggaattttcagcatcgagtagaagatttaatttggtgacattttccatctctttcaactcagagatagtatgaatctaccactcacgaaaatgggaaagatgtgaaaacaatttagcggggaaaggatggagtgaaaatgccgaattcactaagcgtgtcatagatcgttctagaaggctttttggtacctttcatattattatatattagattgtcttattttatattattatgttatttttaaatcaacagcatttcagataggtgtttttgtagaagaatatactctgtgataccatgtagctaactacagctaccacgcagttttagattcctagatatattctagttctttctttaatctttaccaaagtttctcaggtttaaaagacaatattaaaatcaataacttatgtgagtcctgtatatttaaaatttttgaccctattttttcttcactcttccccctcttctgcttccacttgtcacacactgtttaatcctatacagtttcaaccgtcccctctgcatttttctttttctttctttcttttttttttttttttttgagacactctcactcccatcacccatgctggagtgcagtggcatgatctcggctctctgcaacctccatctcctgggctcaggtgactctcccacctcagcctcctgagtagctgggaccacaggcacaccaccacacctggcaaattttttgtaattttagtagagacgggatcttgctatgttgcccaggctggtctcaaactcctgggctcaagtgatccacctgcctcggcctcccaaagtgctaggattacaggtgtgagccaccacgttcagccccttctgcatttttccacggagctgcctcttataaaggttagcattggcactgatgaccacattccacaacttttaacttctgattccccttgcctttttctgaacccttgatatagatgactacccttctttttcttcctttaacttttgagaggttatgttctcttttataactcttcttctgttccctggtttgtcttctatacatgtaggcattctccaagttgttctcaaaattcatttcccctgtcttggatgcacaatctcattattttactgtgttaaagtcatatcatatgttcatttaaattacacaaatttatccagacattcagtcaaataaaagagagaaagaatatttagcaatagcaagtgcagtagtgctggcaattctgcttacactccgtttattgaatgtatgccccacaatgagcagtagtgagctgagaattgagaatccactatttctttagtcagtcttagtttctgcatgccttctgtgtgtctctttgaactgagggagactctagtgtgtatgcgtgcgtgcgtgtgtgtgtgtgtaaaacactaccctaaattcaagccaacagcttcatctgtggtttaaccgaaaaactagtggtccactccaatgctggaggaatacctggctgtgtgggtgtgttgacagactgtgtgcctgtctctggctacctttttaaagacatttcaagagtaatcttgaaaaaaaaatttaaaaaataattataggccaattttagacctgagtaagatatgactccattgttttttcttataaaaattttccagagtcttcaaaattgtgtttaaataaatgaatctgattttagcctcaagtggaacctgaactccacctgaatgtcgaatacctcattctcattgtatcccaaattaaattaaatcttaacctcaccttcccacatctcccacatcagcatttcttgatttctcaggttcttaacagcattgtccctctcccagctttccaggattaaagtcttattttagttatgatcacacctctgaccccttgccccccaaaacaaaacacaactattgcttattaaattttgtgtgaacttatcaaccttgatttttactacccttccaaaagtggatggcccttatcgtattttaatttagttaaatatcaccaactttccaggctatcacttcttactgacacaaatcccgttttcccttacatgtggattgccttcccattatttgcctttcagaagcttttcctattctaaaaccatctcagtctccaacctttccttgttctgtttccccacttaaatcattgtgactttttctcccgtcttgaaattcccctgtatactctgtactttttaactttaaagttatttgtattcattcatcttctgatttgtaagctttctgaagtttagatgaaaaaaaattttcataatgcatgttttctttcattttgttaccttttcattaatgatacctttccctccagtttctttcagatttaataaacatgaattgatcaacttttatttgcttaggcagtgtgccagatgcctttttagatatagtctaaatatatcctcatatttagttatatttaatccttagagcaacctacaacatagttactgcaagttgtgtgtacagaagatcctcgatatccaactggtcattaatccatgtaatgcatggagaagcaaaaattgccaaacaagaacactgactaataaaccaatcatttataaaattaggctctactcaccaactcttcctaattagctgtagctgttatctgtcccattcactacatcattatccttctctgtcactctcttgctaatacaatgcaaatacaacacaaaccaaaatgaaattgcgtactttgcaaaagatgagaaacttcatgaagtctgttaaactgcaagagaatgacattagtcacctacagaattgacagatgagtatccagcagaattaaccattaaagaaaaaagtgatcactcacaggcaagcacttcacaaaagaataatttgagaacaaagtattaagagaggcccttgagaaaattatttcaataagcctttaaaacaaaaaatgacccattttatgatcatgtaaatttcaaagccaaaggatgttgcaccattgtatagtcagaaaagatacgccaaaaaataaagtgtattaaacacgtcattaactatttttaaaaaaactaatttctacaggttttagtttcacatttcagattgaactgcaatcaaccttttattttcttaccatttactataaaatattttgacctgttttaaattgatttcagtaccagttatccttgggtaccaagggccttttttatccaccttccacagccaaggtagcatcagattgcctgtgcatgaactcagtgtgaacttccttagtgtaaagttagggtctcaattaacaatatatatcccttctgaatagagttcctcctccattcttgttacttcccttttgggggaacatatgtttacctaatttttcctatctcctttttcttttttaacttttttagatttgttgtgctcttttattactgtttctttatgtctctcatagtttttgtcctattctcccctttctcttttcctttttactgtttttcctttgccttatcaccaggttcctaaccttgaggcgtatccactgtctactaccttgcctgccctgctgtccctttttaatctcctcatctggaatacagtggttcgttttaggtttttctctccttaattctaactccgtttttttactttttcatttctcctctaacaaattttttttaactttgggtttttgtttcattcttcattctgagtacttgcacctccttacttttggtgagaaagctggtgttacctagaacctctgtgtgctatagaaactcttattgctaagaccataagtgaggtaagacctaaacgccccttctcaaaggaagccctctttctgttttgcccaacatgcctcggtattacaccaagccactttatcttggcagttccttctgcaaacccctgcatgctggtgtagttatttctgtccatctactgtcaaaggtccttgatttaccactcagtgggtatacactaatgaagtctgattagatatttgctgttgtaatattaccatactgaaaatcctaaatttaggatttttgtggggagaaatattgggggtgtctggagaaaaaaatattcttaccaggatcactttctgcttcagaaattttaagaaatattttggctgggcgcggtggctcacgcctgtaatcccagcactttgggaggccgagacaggcagatcacaaggtcaggagatggagaccatcctggctaacacagtgaaaccccgttgggaaatgggaaactaatagactttctcatgttttgatatctctaattagagcataaatgcgaatgttgttccttcttgcaaattggtacatttccctttcattatctttctgcatgggtaaaaggtaactcagaatatatatttttaatctttctaaaaatggaatcttcatgaatcagagttgtagtaatctcatgtctgtgatttgatgaaaatttaaaaaaataagcgctttggaaaatgtctgtcttcatatcctcattaggaaacttctctttaattttgtagtcaaatcagaaaattaatgcccgttggaccacagaggagcagcttctagcagtgcaaggtatattaaagataagcagttattgttgttaataattatttaatttgtcatgaaaggtgactactctagttcttcccttcctttagaaattgatcaagaaagggctcttgtgtttatcacaaagtcctggtgaccaggaattctgtgttgtatttgtggatgtgacatactcaagtctatgtgcattttgagtcctgaacagcacgtaatgcattctcagcactaaataattgatggtgataattaagcatgaaaaagtcacatgggctctctgtgcttctcctttggtattcctgcagttgggttcgttcttactatatatcattcattaataactcatagttaaaagcatcaataaactatagatgtttctgatttctctactctgcaaaatagtgtttatctgataaatgtcaggattgaaaatattaactatatgtttaactttcagtgtttcatacttcccttaagagatgtaccactgaatgcttagaaacctgattttaaataggtatattttttaaaggagacttaagagcgatatcaaaaaatcacattcagcattttcaatgcactatttctaagaatgttttgttgaattatatggtagaagactttttgtattatgaatacccatgggcaaattggaagcataaacttggattttctcatgtttaaatgacttaaagacaagttgtatatttttattcattgttacagatttgtttcctcttcatgataaatttatgtgcaggtctgattgtacagtttaaagtttggtctacattttgtttcttcctggctgagcacctctgtgttgagtgctaatagcttttttttttaatctaggttaactactgtgagatagtggggccccaatgaaacatataagcataccttttaaaatgttgccaaatagtcttcagagaacatacttaatacaaaaatgctgtgcagacatcattccgattgatcgactgatggatgactccgcagtttggattagagagagtaagaattagccagccagcatgatttgaaaatgtcacaggagggtgccagcaggatgatgtcagcccttgctttggcctatgcagcatagcacagtcatttcataaagaattgatactatgacacagggtgctggatgtgcattgggcacatctgtaattatagaactgagtttctgaatgagtcaaaacaaggtttagttagttcataatgttcaaaaatagctgtttttaaattagactctgctaatttaaattattgtttaaaaaattagcattttcagtggctgctttatattcctttagagcaatggcctacatgtttaatatagtcattttgaataggcattgctttttattcatgtaaagtctgtatttccctctatcttagtagcctggtaaaaactgaaccctgatttccagtattcagttgtttaaagattagtatattaactctgtatttttaagaaattttcccagtgaaagaattttctgaaaagaatgtcataggaaaatctaggctaatacttctctacacagcactcagtatttgttattgctctacagagtaatttaagttatagagtccattgaatcttgtggctgggttggatattacccaaagctgcattcaaaggaagagcagtggtaatatctaaatatatagtttgaactatatatgtggacataacttacaaatattaaaataaaaggagtagtcatatatataaccaaacatttcctctgtactgaggtatattcagtattatactatgtacatttaaaaagtaaccctgtaagttacactaatgcaggagtttgtatggaagtattgcatgttcgcaggatttcagaggcactttcttaataatgtgttaatggtgttaatgtctgttttatttattctttggatttttttgttttcatttttgggtttttgttgttgttacataaaataaaactatataaggctatttgtgccctatataaaatagctattttaaagagaattttaaagtgtcatattgtcttatgtgcccatgcatttatatagtggtcagaagtgtgtcttataaatagtataatcatgtagtaacgtcccctgtacctgagtttcagtgcagttaaggggcgtaattgcagggtcttttaatacacagtttactatctacaagtacttaccttagcaggcaattgtttttgttttttctttttttaaaaaaaaaagtatggtaaaccttcatactttagttttacaaagtaataataaactgttttgatattaacatgttttaatttgtatagcactttatattcaagacattttacacatatatttctgatttgacacttatttgttaaatgctttattttatctggctcatagtagaagactattacagtgacctgcagaaaaaaatattgactctgggcaactagtgagatttacaactttactattaaataagcttttttattacaactcttttgaaaccaaacatattgagatcatttcctttcgtagggcttaaatatgtatttcccaccttattttcctgttccatctactcatattgttgttaactaaatgttaaccatttaaataagtttcccttctttctctcttaatcagaagagaggggaaccatgctcagatcaaataggaatgtctgtttacacttttgtaatcagtcactttattatgttaattctagttctacctatgttgtaattttaatagaattcttcaagactctccaggtagggtatcattaatactgctaatttaatcctcttaaaatatttgccaggaaaggtatttctacagtttttatcatgtgttccaaccctaagtatctaaatttttattatgaccaaattttattatgaccaataatgatctttccatatttgtgttaatgataaaatattcctgtttgtagcttatacatatatacatattttttctaacctataatgcttttagaagttatcctaaaatccaacttgatattcatatgataaacagaattcagaaattaagaatttttaaaggggctgggtgtggtggctcacgcctgtaatcctagcactttgggaggctgaggtaggtggatcacttgaggccaggagttcaagaccagcctggcaacatggtgaaaccccatcttcactgaaaatacaaaaaattagccaggtatggtggtgcacacgtgtagtcccagctgcttgggaggctgaggcaggagaattgcttgaacctgggaggtggaggttgcagtgagccaagatggcactccagcctgggcagcagagcgagactctgactcaaaaaaaaaagaatttaaaagaatttaaaaaggaatttaaaagaatttaaaaaggaattagattattctaggtgtatcttttttccttgtaaaatggaatgatggttagctgttttcaaaaaacaagacatttaaattatagtacaaaacacctttttaaagtgtgtagaggctagaagcatggtatacagtatttgcattttaattataagccacctcttaaatatattcatttcctagtcattactgcttaaaaaaaaatgcttcccaactaaaatttatgctactttaggataaacaaaattttttccgattgtataaagatgtcaactttagttattttttatataattattttttatatttagttattttttataattactaccttttaatataaaacagaaaatgacagaactatgttcaggtggcttatgcttatagtaaaagttaccttttcttgtagttcattcacctttttaagataaatgaagttgcaagtctagaaattgtcttctctcttgtactaacaaaaagatagaagggtttgtaaaggagaaaaagtagatttggcagttgattaaaaataaaaggatggtaacatagtacatgaatgatcaaaaggaagtggaacaaggagatgcatatcttttcatctgaaaagcacccttttgctttagggattatttttctattataacagacaccataagaacggaggttcaaaagtataattgtcagccctctgatacacttacattaaataattaatgattcaaaatttccagcatttttgtaatggaatgtaacttataatgtgattttgacttttagccccttccatgtatacatcagtcactgttctgctgctattgctaccttttctacctcttaatatggaattcttgaagagatttacaggaagtggaaagaaatacacgctcccaaatggcttgagtttaaaacatatgtcttaatgatagaaaagaatcatatccctggagtttctagatgttattgtattcctattatttcaaaaatatatttttgaaaaattaatgtttcccagttaaactaagtacatgttcactttaagaaattttgctgtgaaagccagaaaaaaaatcctctgaaatttcactacccataagcagcttaccatgtttcgtcttttggatgtgtttttttttttgttttttttttgtttttttttttttttgtgtagtccaaaatcaatttttttttttttgagacagagtctcactttgtcaccaaggctggagcacagtgtcagtatctcggctcactgcaacctccacctcctgggtttaagtgattcttgtgcctcatcctcctgaatagctgggactacaggcattcaccaccacacccagctaatttttgtatttttagtagaaactgggttttaccattttggccaggctggtctcgaactcctgacttcaagtggtctgtctgccttggccttctaaagtgttgggattacaggcatgagccaccatgcctggccccaaaatcaaattttaaaaaattgttttaaacataccaaaggtagctatccatgctatcctttctagctaaacataaaaaaaaaaaaaaaaaaaagattcagattccattttcacagttgggaaataccacataaattctcctgaagttaccacaatcttactagccaaagattaaaacaaaaaaattgtatggacagactccactaattcagaatgtctgataattcagataatggctatgctaaagtctctactgctaataaaaatatctttagcaagttaaaagtgttaacaagaaatgtttaaaaaagatgtttttgtgttgggtaatatagattcctggttggaatatgtgggctttcataaaatgtaatgataacagaatatcctaatgacttatatttttatgttaattcccaaataaaactttacatattaaagattataagatatcatctgccagcatagaaagccaagttgtttcattgtaactttcaaatgaaatttagaaatttgactgaaaacaatttttttcttcctgggaaacttactatttgcctgtttattccaccaacctttgaaaacgacctcttttcctagaagtgagactttaacaactatggttcaagcataccttttacatcttcaggaagagagattgacttaatcatatttaactcccttcctgagaaagtaatcagattttatcaactatgaaaaaataatggagtgcccttcccccagggacagactgaaactcgggtagctctgatgccgtaagttgttaaagttagttgctgcttatcactaccacctgctagttgtttcagacgcctcactggagattcttttaaaggagcagtctcattgagtcagttggggtttcactagagtttgcttagatgctagcaacagtatagagcttaagagttccatcttctaaccaaagtgctcttgagccatgctgttctgagtgtgaaggtgatgaagaattcagccatatatatctaatacctcctgtggtttagggaagaacaatagaatgaggctttatagggaagaaaaatcatatttccttatttcctaagcacttcctgtgtactcagcattgtagtaatgctagtgctgctttgtattttctaggacagtactttccaacctttttcacatcatggtacacagagaaaattatgaaatttgtcacaacacactagggcaagcagatgaagctgctcttgtccaaatgagactgccaaggagctctagctattccagaccctgtccagccatccttcaggatgaggggattagaacaaatgtggatgagaacaggatgagaacaaatgtgcctagatatttgttggaatatctaggttggaatatctgaggttggaatcctcagccaaactacagaagtctacagtgtggtctgagctttaagagtttagactggcatacatgagttaattataagcatattatagttaattataagcatacctgggtgagttagaaaaagttgttgacattgaacatctctagaaacactaaagctcttacaggaagtagttttgagtttaaggtgtataattttacaaatgtaacaatattgatgacaaggtaaagtccattgaacaagggaaaattaagaagtggaagatcaaaaggagtatagtcagaagaaggggcacttatttaatggaatcagacttggggacaacttagagttttggaatatattttgcaaaataagtgttctgaggtttataatatctttagacttggagtcagagttagttttaatgtgacttcttcctaggaatacagtctaatcctagacttatttaaggttttcacttctaaactcgtgtattcagtaggtttggccattgctagaatgtaaattaagcgtcccttatgaaaattagtaactgatagaacactatatttggtttctaattagtagttattcttcactgcagcaaactcaaatttagaatttagaaatggcacagagactcacccttataagagttgctattttctaaaatgtaaaagtagtagagaagtacttgaatatataacagtaactcctgtgaaataaccttggatttttattaccaaataaactctcagtggaatctagtcactattagaatttatacttaactgtgaagttcaaactggaaatcaacctcatgggtttaaagggagtataaattcatttatgctgataaaacattataaacgatgtctatcattgttactttattgtcatgtacatgtattttcctttgagaacacagcaaatgagcatagcttacaaacccaaaactctaccttaaaaatgggatataattagaggataataatgtcagacctcctgtccagaatgctcttaaaggaattccccttagagtcaagcccagctagtttaatgtagtcagaaatgcttatttccaaattctcaatttaaaataaagcagaatttaaaagtgggattgttacatcatgatagtgctttagggtaattgagtatttcatattaattggtattggtaagaatagcatttctgctgggtattaacatatccatatattattctctcatctgtgatcatatacatgttattaatttaagcccccatatttttgtctcctttctcatctctttcattagtgagttactgttttctggtatttttaaaagcagttatcaaattataaaaattttcagcaacttttctattttgagctaagtgcatctccttctagaatgagtctgtgaacttcttttagaattcccttaagaggaaattattatctatttaaaattctatagtatagttaacagtctcaacttcttaaatcaattattaccctttattataatgaaacttccttagtgtaaagttaggttctcaattaacaataaatatctcttcttaagtttaaggtagtgatgatgagcacaagtgctcttcaggtagtcattactgttaccttattctttaagctatcatctttcatccattcagtctttaaaactactagatgagttaaaatccaactgactctgaaaaaaaatcttctcttttttcaaaatccaccaacttgtgatgattctcctgcttttcatgtttaagttcttatctaatttcaatttgttggtaccctggtgctataggcaagtattcatgttgaagttagtattaagaccaaaattataatgcttttcttaatgggggaaccctaaggctactcactcagtccattgaggggataagagagatggctcattcccatccagttttgtttacaaacgatgttgctcaaatttaggtgactggctactagggaaataaatgaatgtggaattgaggatggaacaaagaattcaatgctttacaataaatggactgtatttgagagttcaagagaggattggagaaaataactgagtatgtaaaaaatggtaagtttctgattgttcagttgaaggcaagtggctggctcgatgaaatgacataactgatagttttcatctgtgaccctgatatcttagcctctatctcagaattgagaaatgagcagagtttatcagaaaggaatttcattgctggtatcttttgtgtgtgcatgatgtatagtacacacagctctccttattgatccttcacaggtgtattatttactttgccttccaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaacactggtgttatgtttttgttttgttttgatttgttttgtttttcctgtgacagcccaaactatattgtattaagttcattaggacttacatctcatacgtgtatttttgtttcctcacctctaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacatgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctacatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaactttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatgtctatgtcttctatttttatataatttcatgttctatgaggaatttagtacctcttcactgtgaaattcgaaataatgatttttataaaagcaaaactagaaatcttttaatgacaattttcattaatttcagggttatcatttttgagaaatctacaccaaagtggttttttaaaattacataactaaaaataaaccacactgtggatacatcttat

SEQ ID NO: 38353 - DNA, 4371 bp, Homo sapiens
cccctccaactctcaacccacttctccagccagcgccccagccctcccgccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccaggtgcggccccggcttttgacctacctccgcaccgcagcgcggtccttcacggggcaggggcggcgtgaacccgtcgggcgtgagcagcagtcggtggagcgggaggtcggcggtggcggggatgggggtatccggagcgcagccggggcgcagctgctggcacaggagctccacaggcagccaaggactcggtcctgtcccagagcctgcggactgtggaggggaggccgcaggaagagcccgggaggagggggtgaggggtcgaggtgtggggcgctgcttgacccagacgccagggccctgggaggaggatgagggggacagagcagatcttgggcgaaaggggaggttcccgcaggctctgtagtcgccgcagttccagcatggtcagcaccccctctgctacacacattcccctcgtgaggggccaggggtgcggccctgtgaccaggacagccattcattgggtgactttgagccaccactggcccctgacctccccaactccaatgaaatctgcgaaaatcttctgacagccgttcctctctggtgctcccttcctcatagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgagtgtgacggcctgcctcgtcgggcggcgggaggaactccccacctccagccgcagcagcactctctgccagcctccctctgaacaggacaccgagccagttatgtcttcttacttagcgatgtgattctctggccttctcagtaagagcctggggaggggaggctctgggctgaaggggtgtggaggagccactgaccatgcagagtcccaatcagtggagccctgagtccatcctttcctctgggccaaactcaggatgggccggctctcctctccttcctttcccttctcttttctcctcctcctgcctcttcttctttctccttctcctcctctttcttctccttttctcttctcttctcttctcttctcttctttctttctctctctctctacctctccctctctttttggggttttagcggttaatccctgcagtggcaggtccacctaggagccgggatcttgggtcctttgtctttcaggtgatgcagatcgtgctggggatcttgagtgcagtcctaggaggatttttctacatccgcgactacaccctcctcgtcacctcgggagctgccatctggacaggggctgtggtgagtagagcaggacagtgcttgactgcctgtgagaggggtggggcattgctctcctgattgccttcctccaacatggcgccacagaatgctggcagtcggagagatctgattatctaggaccattccctgcctgttcagatgagcaaacagctgagggcggtggtggcatgtcctattcacactgtctgctctcccatacccttcccagtgctgttcccaccaggctggctgcctctccctgccttcaacagttaatgtcaactaaggatctaaggacctgctcatctccagatacttgcattgagatggggaaggcagagcgttccagatagtatgtggtcccccaggaagcatcaccccctggttattctcattgtcctccacaggccctgtacacaatggaaacccaggaattgttgtcaacagatgggtgtgtgcagtttgcacaggagctgggtaggctggtcatggtacctacactctcagaatagcactaaaacactcatatttactgacagaagccgagagtaattaccttcacccagcctgtggcaaaatacccagcttaattacagaattagccaaacaggattcaggtccacctgtccactgggacatactagatttcctgttcttcaagcccagctgagtggattattgggcactgttaggacaggcttctagacctaacagtgcccactctgtatagactcacccttcattgagatcttctccagcaccccatgacttttatccacaggatcccaccatccctagaactttcataaagcacttggtgttgtttaaaaaggaaggtttagaagggaagaggggctcacacctggcttgaccacaagctcttaggtgtcactaaagcagggccttttgcagcctcaggagttggatccaggctccaccctctcagcaattatcttaccatggataataaagcttagcatgaaacctcccgcccaagctgtgtgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggtaagttcagggaagggcatgggaggggaccaggttcaggctggaggtcaccccaatctcctgccctgttgcaggcttctctgggccttgcccttttttcccccgactggactctgagagagactgaaacacaaagatttctctctgcctcctccctccccaggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggtaggtggccaaggggaaggggcagcagcaggtggggcagggatggccaggccaggccaggggcaagagtcaggttctccaccagaaataggtgttacctattctgcaccaagcttgcgtattgtcaccaaagacaaagcatcagacaaaatagaaatggctcctgtagggtgttacagacaagtgggaaatacaagcattaaaataataataaatgaaccactatagcaagtgtgccaagtgctgcaaaggtgttaaatgcatgttttcccttgatcctctgaagtcttggaggttatcagggaatcaaatcatagcccaaacctgtcactgtacaaatgaggacacaggcccaatgtgagcagtttccagctgtattctgtacattgaatgcattgacttcccctccagaagccacgaacttggagataaaggggtagagattttcccaggtcaataaggagcatggggacagagcaggaaggcagctgtcatcctggtgcttatggccttggccctctgtccccaggccttgttcagaacccttcaggccatgctcttgggtgtctggattctgctgcttctggcatctctgacccctctgtggctgtactgctggagaatgttcccaaccaaaggggtgagtccctaaggtgtgtgcctgtgtatttggggcagtggaactgctcaaaggagacaggaatggacagtggacagtttggggaggagaaaggggcccatgacccaagtcccacctattatcatgcctgtctttctacccagtggtggcccagcccagaaagcccctatccccaaccaagtggcccccaagtcaaagagcccaggaatccagggaagtccatatccatgctatgcctttggatcaggtaccatgctgctgattctggtagctccagagctaagctgcccctggaggagagactccgccctttctctcccactcacgattgtcttgcctttcctcttccattagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagg

SEQ ID NO: 38354 - DNA, 107631 bp, Homo sapiens
catggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggtaaggaagagcattttaaatacaactatgtctctactacagttaaattttacttgccgttattcacgttgtgtttgtttctattaggttgttatgtaaacttttattatgagtttacatctttagagtgttctgtaagtaaacaagtagtgtttttctagagttttaggcagaaactgctttgctcctggaagaatatatgaaaactacagttaattccaagtaaatacttgtttttccttatatttctttttacatgttgttggaaaatgtagccagtgtttttttttcacattgtcacagtgttctgagtgtaaaggctcacatttaaaagcctctaaaatgataaaggatattaaatgtttcctagtcagcctgttcaagataattggtggaacaattttctcttatttttaaaaacaaaacaaaccaggatgtgttctctaaatgcaacctctcttttttcaagaagagaattatataaaataataaaaacctatcttaaaagaagctaatatcttcatgttgaaaaggtggacccaggtggggtatttgatagaaacacttttatggcaaattgctcaactagctttctctgtgtttgcctgaattgtttctttttcacatgtgtagctatttaagatacgagtgcagcaggttaaaaatattatagtttttcctccatttcgttcataatttatcctgttttattacaaggtgtcttagaatacttttttttaagtttttagatattgacaatattcagcaacaccttatatatgcttgtcaatctttacatttctcaatccacgtgtgttgtccaaagtcctgtatgagagatttttaaaatttaaaatgtacttgggtaactatgtaagttaaaagtgacagtttttatatactggcttgaatttagtttaaagcaacagaaaaataatatccacaaaatgaagactctatttaagatcttgggatatttcttctcactaacactttggaaacaattgttacaattcagagttacccgagaggaattaatatactaggtaactgaagtttaccctttgaaacacaaaaagttatttctctatcttctagactgtagtgactgtaacaaccatttttgtccataatggggtcatcattatgcatatcaactattgttgtgcagcaaagggtggaggactgactatatgatccattagtttttgtatttttgtgtgtaatttttatagtttttctgttctttcctttgccgtcaggatacttgactttggtctcttcctgatctttcattttgctgcttaattcatattagaatgggaaaccagataaccaatcgtgttaagagttatattgaaaataaaagtaagcaggctctggggagcatagtatcaaaggatttcaatataatgataaataagtgggtactggagtcagagttgggctcaaattccactcctttactaatgtccttgcctgtaaccttgggcaaattccttgacctttcttagcttggatttccacatctgtaaaatgggaataacaacacagagctcttgtgggaattaaatcagatgtaaagtactctggtatatatagtagatgctcctctccctttcataagtgaaatacatagactatgcaatatatatttcaagactctttcatcctgcaaaaggactcaggaatttcctgggaaggttccctatagacttatactctttttttccatctctgcatctattgtacaattataaaaggcaatttacttatattgtgttataagcacatgcttttgtgtctgtctcccataggaaggctatgagttcttaagagtactggctgggacctggaagctactaaataaatatccagtggatgaacaaatttatactttctttctgtttttcatcagtagtctgaatagatgaagttttcagtttagggagtttccaccccagcatcattcatttatgcttgcagttatgcaacaaatgtttattgaactcctgctgaatgtcattctgagaactgaggaccagtggtaacaattttgacatcataccaaagggaaacagaccataaagaagtaaacaaatataaaatttaattttagatagtaagggaaagctttcctgaggcaatgacatttaagcagagacatgataaatgaataaatattacccatgtaaaggtgagatttgtgaggggacattccggacatagggaacggtatgtatgaaggcctcatgccaaggagagcagatgagttctaggagctgaaagtaatgcaatatggctggggcagacagtttgagggtggcgtgaatagcttaagaggacatactctggagtttggcagacctggctgcgatactgtcatgtgtcacttaatgatggtgatacactctgagaaatgcatcgttaggtggtatcatatttgtttgaacatcatagggtgaaatcacacaaacctagatactacacacctaggctatgtgttatatagcctgttgtttctaggctacaaacccgtacagcgtgtcactgtactgaatacgctttggcaattgtaatgcaatggtaagtatttgtgtatctaaacatagaaaaggtagagtaataatatagaattacaattgacccttgaacagcataggtttgaactgcatgagtccacttataggaagattattttttcaatagaagttatactaagttgggcggggtggctcacacctgtaatcccagcactttggaaggctgaggtggaaagatctcctgaggtcaggagttggagaccagcctgaacaacatagcaagacccatctctacaaaaagtcaagaaaaaaaaattagctgggtgcagtggagcacacctgtagtaccagctattcaggaggctaaggcaggaggatcgcttgagcccaagagttcgaggttgcagtgagctgtgattgtctcattgtcctccagccctctggcgacagagcaaaaccctgtttcaaacaaacaaacaaacaaaagttacacttgagtatgcctgcctcttctgcctctccttccgcctattccacctctatcacccctgagatagcaagaccaacccctcctcttgatcctcctcctcagtgtactcaaagtgaagaccgtaagaatgaagatcttcatgattatccacgtccacttaatgaatggtaaatatatgatctcttcattatgattttcttaataacattttcttttctctagcttattttattgtaagaatacagtatataatatgtataacatacaaaatatgtgttaattgactgtttatattatcagtaaggtttccagtcaacagtaggctattgttggctaagtttggagggagtcacaagttaaacacagattttcaactgtgtggagggttggccccctaacccccttgttgttcaagggtcaagtgtgtaatcttatgaggccactgttgcatatgggggtccatcatcagctgaaatgttacgcagtatgggactgtactttattaactctacaactttgaataagttacataatctctccttgattcagtttcctcatctgcaaaatgagcattatgcttatggttcctgcctcacaatgttgctgtgagaataaaataaatgatgtttgcaaagcatagcacagtgcctagcataaaagaaatgctcagttaatgttaggtatgcctgctattactaggcagaaaccagatcccagaggggcttataggctatttaagggttgtggactttatcatagaaataatggaagccactgggggattttgagcaaggtagtatagtgattgatagtgtgtcagaaggatcactctagagaatggatttccatggtcaaaagtggatgtgtgacatcaattaggaggttgtcctactagcctatgacaaaagtgatagtggactaggatgtgaggtagggcaggagggagtggaaaaaattaaaatgggtctgatagatatcaaggagttagaaaccacaggatatagtatttagttggatttagaagatgaggaaaataacaaaattaagcatggctctaaagtttttggcttgaggtacttggtgaattgtgcaattgttttctgagacaaaagagtggcagggggtcaatttaggggaaaaatgactgctgttttagacatgttgagtttaagttgcctatgagacatccaagtagaaatagctcctaaatgaatttctgcccccgataccgctgttctagttctgtcactgctatgtcttcttctccagattaaactcaccctccacttttatatctatcctccacatagctgtagagccatttatctaaaatgaaaatctatgtaactttactggcaaaagccctttagaatagaattgaatttaaacttcttaatgtcatatagtacccagcattatctggctttcacttacctctccagcttcactgcctaccattttagcatcagcctcacatgagaaagcaaatattaattcaaatgtagcactccataatgctttctgttattcattagtaaagcagcaaaagctgtggtgcatatgcaatttctgcagctgctcctgaaagcccttaattgctataggtcagctaaaagggctgtagttggcaagggagaaacgatgacaaggtggtagaatgaattcaattccaagcagctaaatctgttaaaaaaaaaaaaaatggacacattgggagatagcatcttttgtttataccccagttctcaatttattgattccacatcagcatgtttaaatatattcacatttttgagaaatattctgggccaggcagtcactgtacttaggacttgaagatcagtaagacttgtttcctgcttttgaagaaggttttctattctcatccaaggctttatactgggtttttaaagaaactttaaaaagaagaattacaccttttgatactcttgattctctaaacaaaggaatgggagtattaatactggcccactttcctaatatagtctactggtgaactatagtcttgatgatacatgtaattaaggaggaaaatatgagagcacatatgtatcaaaagattttgaggcctatccagaatagccaagtacttttccaagaatggtcatttggtcattttcataagtttgccagcaatcaatattgtctgaaagtaaattggcttaagatagaaaatttagaataagcaacaaaatacttatctttggtaagtggggtggtggaggctttcatttagtaaagtgattattacccccccacctccaggagaaatgaaactttcgttgctgggtaggatgcacatttatagctgttagagttacagttggagttgcagtatctagttgctatccaattgagtaataaatagattgaaaatgtaacaataagtttattatttcacataataagtctggaggttggcagttccaagcttgattgattcattggctcaactacattacttgtctgctttcttttttttgttctccttcctcagcatagcaaatgatgtctccattcctacagcatgctattccaggcaccatgtgcagacatgactatctgcagctaagaagaaaagagtttcttcccacgtctctctctcggggaagaaaacctttcccagaaaccctctagcagacttcctctcagtttctattgactgggattgggtcacatgcccttttctaagccagtcattgatgaagaaattgggcatttctatttttggtttggactaatcagcattcagcccctaaggaccaggagacccgccccctgcccccccatcacttgaacagaaaatttctcgatgaggagaagcagtacagaaggcagtcaggcctaattagaggcttccattaaaactgcatgtgtatctaactagataatatatcacttggtctatttataatttggatccgattagattagaagcatacttaattcatttttagtggggctataaaatataacagattggagacattctagaagcagatttggtctttttaaatgattgttttgttttgatttttttttaactgccatttagtggagccaaaagtctaaggtagtgcatgtcaaacattcactgctgactcttagatatcacagcaaatatgagagtcctctttcaatatttacactaagcttctctcttccataccactattttctggcctttcttattttattgatacgttgtgaactcggtccctttccctcagaaagccttgtggcttacttctcattgcctcctctcattcgtgtctttgaccactttccttccttgcttttgaggctcagagaatattctttattctcaggttttctgtccttctttggataaagaatgtgaagaaactgaaggcaaatctttaactttttttttctaaattgtttgaagacagccaattttttttcactttctgacttacaggaggaatcatatctgtactatctatactcagtgtcttctttataatatataaatacatcctgtcctatgttttgactcttcagaaagatcaaaattaacaacagtactctttatgtgttcagatttcgtctattttattttatttatttttgtttatttatttattttgagatgctgtcttgctctgtcgcccaggctgtagtgcagtggcacgatcttggctcactgcaacctctgcctcccgggtcaagcaattctcctgcctcagcctcctgagtagctgggattacaggtgggcgccaccacgcccagctaatttttctatttttagtggagacagggtttcaccatgttggccaggctggtcttgaactcctgaccttgtgatccacccatctcggcctcccaaagtgctgggattacgggcatgagccacagtgcccggcctgatttcatctattttattcctgttggagtgcccccattggcctctaacatgaaaaaaactgattcatttaaaaaatatttttctaacatagttattttgtttacaaatgggatatagtattttgtacaaagatgttaaacacttgcatagtaaattttactttaagatcatgggttgttcatgacatcatgaaggatcctctaaaacaatggcttaattagaattttttctcattttcaacactttgtgtccttaaaggtgctgtatgtgcagaccattcatgaagtaaaagaattagaaagtaggtgtactgttgtctttgtttagagttatatttatttttctcttgataagccatgagaaatttgcaaaatatctttttaccatttgaataggtaattaataattcaaactgctaacttaaggattgttgaaactttggtctgacagaaagtagctgtggaatcttgggtataataaaggattctttttgttttttgagatggagtctcactctgttgcccaggctggagtgcagtggcatgatcttggctgtctgcaacctccacctcccgggttcaagcagttctccctgcctcagcctcccgagtagctgggattacaggtatgcgccaccacacccagctagtttttagtagagatggggtttcaccatgttggccagactggtcttgaactcctgaccttaagtgatctgcctgccttggcttcccaaagtgctgggattgcaggtgtgagccaccgtgcccggcctaatacaggattcttaatcacttaaaattttaataaaatgggcactactttgggttatgtattaatcatgaagaattttataacttaaaaatagtcagtgtttatgttgtagcaaattagcatggactggaaggaaccatagacatgagaaaaatcttagaatttgtggaagaacagagttgatgctggtcagggagggcagcgtgcttaaagtgcttagaaggatgaaagtgctgctggaagtacatcagcaccaagcaagctttgccaccaattctaatctctgctttgtcagaatttctcaaatcagtttattttttcacacgatggtaaaatatctaaatttttaaatagaagtcagtggaaaatagggtttactttgacacattgtttctagctcacatttactacattaagtgagaaagatttgaaatgaccttaaagaaattacttagtactttaattaggctggcagaatatactcaggaaatcagatttcaaggattcttcagaatatttggtgattgtatttctgtgtgtgtgtgtgtgtgtgtgtgtgtgacggagtgtcactctgtcacctaggctggagtgcagtggtgcgacctcggctcactgcaagctccgcctccggggttcacgccattctcctgcctcagcctcccaagtagctgggactacaggtgcccgccaccagacccagctaattttttgtatttttagtagagacgggatttcaccatgatagccaggatggtctcgatctactcaccttgtgatctgcctgcctcggcttcccaaagtgctgggattacaggcataagccgctgcgcctggccagtgattgtatttctaggggcattgacacactagaaatttaggtatgaaatccttagctagatagtcacactatgggaacattatttttatgcttgtttttttttttttctgttggttgctacactgataagccagtgtcaataaagatacatgtaccataaagttactgtataaaagaaaaaaaaactttaaaagatgcttgtttttttaaaagtgcgtttttcgctggagatactttgagagtttctgtaggatgactattaggagcatttattagattttcccagttggtattttattattaaaatctgtctattacgagtagactcacagtttgtggcacacttttcaaataaatagattaaaaacaacctttagtttgtaacaaaaaaattcatgttaaatttggcaacataataattatctgtcttctcatgttctaatgtcttttatataaagaaatctgatagattgtaatgaaatagggaattaccttggaaaaactagatacttttagctttatattttacataaatattaccttatttttaattttaaaagttagaggtcttcttagaattatacattctttcatttattataaaatcaccttaggacaattcctaagcttttatttattttttgtttgtttgttttgttttcttttgttttgtttttgttttgagaccgactgttgctcttgttgcccaggctggagtgcaatggcgtgatttcagctcactgcagcctccccctcagggttcaaacgattctcctgcctcagcctcccaagtggctgggaatacaggctcccgccacgatgcccggctatatttttagtagagatggggtttcaccatgttggccaggctggtttccaacccctgacctcaagtgaaccgcctgcctcggcctcccaaagtgctaggattacaggcgtgagccactgtgcctggcctaattcctaagcttttaaacaatactaaagggaaaaaaatttatgacatgagctttgtggtttatattacccaaataaactttaatatgtatatataatcattcattgaatatacatattcatttagtgaatagtattaatttagtattttaacttgaaagttgtttaaattgacaaactgacaaatatatatgccttgaaaaattaaacatatgggtaggataatttttacttttattgtaatattcagtaaagtgtaattagaatctttaccttactaaaagtgagcatttactgttttgatacctctgtgtttgacaagcactgcacacttgtctttaaattttacatgatttcattttctagctagttggcaggtgttagctgtctataattataactgagtaatttttcaaatgctattcatagcctaaacacagcaagacattcttccaatcatgtgataaaaactgagccttgcaaaatagtggtagagtgatatgttcaatggtaccgaaggacatatttaagagaagcctttcaaaagtaaaaagtaatttaaatgttagggagacaggttttctcacagtgtaagatctctcaaagtcattgatagtgattatacctcaaattaagatgtatctactttctcattgaacaagttaaggtatacattgactgacttaaattataacatatgacctttgttgatgacagtcattctgagtatgaaaaattgaaattttgttgagacaatgtaaattttaccattgaacctaatgaatcatttcttctcatttcattcattagatttgtgtatgtgtgtgtatctactatctgccaaaccctatgcttatctattttttgacatgggaaagaaaaggctatgtatttcacttaagtttaataaaggttatactttaaaaaacaaaagaaactttttatttctgatttactttatttcctaaccatctattctaagtatccacagtctcactttgactagagatcttacttcagaatggtgtaaaggtcatgttgaattttcttactggccatgtgctcatgaataaattaacctctacagtctcagtttcctcatctagtaattgacattttattatctcccttgtggtatggttctaaaaattaagagatgacattggtaaaccattttgtaaactttagtatactgtacaaatttaactgtgaataaactctttgaacctttgtttacttatctgtaaaataataataatacttcatacagtgggtttgagaattatttgaacgtgtaaagcatgtagaagtaaacctaacacatagtaagtgcacaacaaatattggtgatgattgtgatggtgatgataatgatgcatttgatctagatcttccatctaatgagtcaaacttgaaactgccattagtttagaaatggatacgcttgatttttacgtgattgactttcatacatcccgcactttatccacatgtattgaaaatccctaattgccttttgtacattaaattccattttaatacatcgtgtcatagggtaccactgccccagtgtaagtgttagtagttgcccaaagtgacagcagatctggagcaaccagcccttcattggagtccagcatcattctggtatgccagcatggcaccagcagggagaggttgcagagaggcagctgcatggatcatccaggtgatcaagtgcacatggagagacccatggccaaagtttgtgcttcagtacctggacagcattggaggataatggtcaagaccatgggctgtgaagttagtcagaccgggtttaagtcctgctctgccaaactgtgtgactgggcaagttacataacctccttaagcctcagttcccttacagagttatgagcaatgcttactggaacccagtaagcactcagtgaatgtgagtacttagtattctattctgcctccttcctctaggggaggagataggaagttgagccctctagcactatatgcccttagagcccccaagtctccagccaactgagaaagttttaagctactttaaaggttcattggtcctaggggaaatagtgcctctaggaactacaaggattttataaatattgttttagctctctgggaactggatttcccttacactgagttagtctcttatttcacttataaacatttaaatttcaacgtgtcttcagggacacataatataggaaagcaagtgattgtttgtatgccggtattgccagtaagcaaccgaatactctgctcctggttgattcatgtctagtactccaagcaagttatctactacagaagtttctttccttgacggtttaatgaggacattagagctgccctatcagtgtttctactgtgcttcccccaatgggagcttgacatactaagcagaaagtcttcaaaacagtgctttctgtatcagacagcctgatataatttagaagaaaggaactaagcaaggttgaatttgcttggtaatatctggcaggtgtctttggggctcctgctgagctcccaatgcctgcctagtttatcttctgtgaattggggtggatgggaggggaggggcagaggtggcaccagactttcctgtctgctttaaaatgtgccatgggattggaatcaagttgtcttaaagagccattagcagtctgtatgcttttgaaaacaagaagaaaaggcattctgtatgccacacctaacccttagcccttttcatgtaataattcattcaaccttcccaacattgtatgagtagatatttttattcccattttatctgtcaagaaaaaacaaggcccagatgggttaaaaacttgcccaagttatcatagctaatgcaagttgaatatgtcttatccaaaatgcttaagaccaggctgggcaccatgactcacacctgtgatcccagggttttgttggattgcttgagcccagagttcaacacctgcttgggcaacatagtgagacctcatctctacaaaaaatacaaacattagctgggcatggtgatgcatgcctgtggtcccagttccttgggaggtaaagtaggaggattgcttgagcccaggaggtcaaggctgcagtaagtcaagattgcaccactgcactccagcctgggcaacagagggaggccttgtttcaaaacagaacaaaatgcttgggacgagaagtgtttcagatttcagattttttttttttggattttggaatatttgcatatgtataatgagatatcttcgggatgtaacccaaatctaaacacaaaatatatctgttttatatataccttatcacataatctgaaggtaatttttatgcaatacttggaataattttgtgcatgaaatagtctgtattaagtacttgtgtgtggaatttttctacttggggtgtcgtgtcagttctcaaaatgtttcagactttggagcatttgggatttgggatttttggattagggatgctcagtctgtaagaggaggagtcaggtttaaaacccaggctgtgagactcaagagtctgtgctttccaacattatacctcattatctgaataaaaatttaacgttaagattcctaacagtaaaaatatattactttctttcccaaattgttttccttcaaggtaaaacttaaaacttttctaggggaaaccacattctcagatgttattaagttgcatatcaagttcttatttaaaccttgacccatgttgaaactgatttgaaccctactgaatcttcatgtttcactgtggtgtataattttcattatgttgtcattataaaagttgcctgatcgcaaggattctatggactgagatcctggaaatatggtgtataaaaggcttatttttatattaagagattcctagtaagatgatttatttaatgcactacctaaaagaaaatttggtatatttccatgagcaatagactcaagattagctttgaaagttaaaagagcattctcctagctagttcattgttgccatgacagtgctggcagtgcaagtgttgtagtaactccttgcaatgatcttattttagaccctaacgtttgcagtgctgaacgtccccttccccgccccacaagtaactctagtggaaaagtactggttttataactggcttctggctttatagctgaaagactgcactattgtgggcttgaaaaaatagtgtaggagtgttgagtatttttcctgtggattataaatgtttgaaatctcccaaaatacggttttgcattacatatcatacagcaagttgtttatagctaaaaagaaaaggagcctcaattgtctttagaaatcaagcctaggttgtataattacattgagctcatacagaaatcattctcccatttgtatgctcatgcatacttcagattcaacttattcttttattcagttattatggaaaattatcattagaatcataaaggattgtgtttaaacaatgtagaaaagtacttttttgcatccctttcataattcagcatttatttcataaattgtaacattttagtcttgatttcttaaaaagcaaactcacctaagttatataatgttcagaaattactcaatttgaactgggtacccgaaccaacataattgttgaagcatttttaactttgttgcttatatgttttaaattagattttaaaatacctcattgagattttctaattgtaaatcctattatgacagtaccattaagcacaaaatatttgcaaatttataagagtaaatgccatttttgtccttttgcataccatttgttaggtcagagttttgatatgtgcgctaaaaatctgttataacatgatgaaacaaaatgattttggcaactgaccttgtcaaggaagatggaaagtctaactgttatacctcattagtgacacctgcttttttcttaaatactacattaaagcttaattcatcttccttaggtgttaaagatttaaacgtatcttgcatgattgggcctgtattgaatattagagtatgaatatcagacaatcccttttgtttctttttttttttttcagtttagcacagaaaaataactttataagcaaaaatttgaccccaggctagaattgcatttagcctttccaccaggcaatgagaatttatcagaagtgtgtttatttttattctcttagtggtaattattccgataaagaaatatccaattccagtctacaatggtctttgatggctccctctttgaatttggaagtagatatatagtaatatatgaagattcaaaccttgagataaatattctttcatttcatacaatatattattttaattggtcagaatgagactaaattatgattagctcctttctcttgttaaaatacagaattacagggttgttattttttttcctgaatcccacagcacctctatagcagacctccctctccacctaaggctgaaataaatatgctttttaaagataaggttagaattcatttaaaatatttctttatgtctgacactgttttggcattgtgggggatgtaaaaacaaaagaaaacaactattgcccttaagaattttgtaatgaaaatcgaagaacaaattaagactggctaaaaatgtgaaattttatggtactgtgttgacaacagtgcagctgttggtgggacagtgcatcatacagccagactttctagagggcagtttgaatattagtccaaaccttaaaagtgtgtacatgttaatatatttatgatataaatgtattatctatatgtcttttatatacaagtgggtaattaaatatcaaacagcagggattatagacataaaggattattatttatatttatattttattttattttgagacagtgtcttactccatcacccaggctggagcacagcagtgtgactatagctcactgcaccttcaatctcctgggttcaagtgatcctcccacctcagcctcttaagtagctgggactacagatgcacaccactgcacccagccaatttttaagttttttgtagagacagggtctcattatgtttcctaggctggtcacgaacttattgtaattattgaaaattgttttaaaatgtatgtataggaaaagaaataaatatacaaatttaaatagaaaagacagctttaaaatagtatgtaaaatatttattattatagagaagagggaaaagtcaggaaactcatgcaccaaaatattaaccatagttctcttttagaaatagagttattggtgatttaaatttttctttgaataatggtaatcattagtaattaatttttgatatgacttgtttaatgaattaaaaaaattaaaatcacttaaatgtattgagtgcttaccatatggcattgtggtaagcattttacatataacatttgcagtgtttccatgggttacaggttttgaggaagagatctttcccaaacaaaagaagtacacaaatatgcatgaacccactcactataatgttagattaagtttctgatttatttagtcaaggaaacgggaagctcctaggcattctcattgagaagaagtacttgcagccaccttagtgctctttccttggaccccagggttcccaaaggtggggtgcagctgctggtgacactgtctgatcatgtgggtcacaccagatctgcaaaactcagttcatgccatactattgtctttttatatttggggtttacattcatattctggatgagtttacacaactatctgtgcactttgtctgaagtctcatttccctgcaatctccaattttatacctacaacaattctgggaggtgagttttagtttttatagatgaggaaacagacccagaaagatgaacttaaatagtgaatactggagtcgagaaggcatgtctgatttctaagtctctgttcttaatcactagtctattttcctagagttttttggtttttttgtttttgctttttacagtgagcatgtattatttttgtattggaaaacaaaatcaatggggaaaaagtatgtgaaatgtagggtgatacagtacagtcatgtgtcacataatgacatttcagtcaacaacagactgcatatacaatagtggtactataagattataatatatttttactgtactttttctatgtttagatatgtttagatacaaaaatacttatcgttgtgttagaactgcctacaatattcagtccagcaacatgctatagaagttcgcagcctaggagcaataggctctaccataaagcctaggtgtgtagtagagtttaccctctaggtttgtgtaaacacacacaatgatttttgcacaaagattagatcacataacaacacatttctcagaatatatttgtgtcattaagtgaagcatgactgtaattcagagcaaggaaagatcaggatgggttggaataataaagacagcttaatacagcaaataaattttactgtaataattaacttttattctcagtttgtctgtcatttacacaagtatacactgcctctatcccaaacatgcctaaaccaaatctcggatgactggctggaagtaattaatgttctgttgttgtttcctgcagactaagttttggcctcatttttgtttcctttttgtggcccccttttatcttccttgcgccatctgtcagtgcctgtatgaacatgtaactataacttgtgtcaaagctcctcactacattgatgggcattataaataaaacaattccaataaaacaagtttccataaagtaataccctcgtaatttaaagactgagatggccaaaagaagttgtaaaatttacattaaagaattgaaatttccctagaatgttactatgcttgacattcaaactcatacacttatactgtattgaaaacttattgaaagaaagtagattcttatcaagcaaattaaacttacagcataaactaggactgatattcagccagtatgcattggcacagcagtacttgttaaaatactgaactgttttcatactagttggtaaatagtaaattgaagctgcaaaccacagtacaattagtgatacataataaagatggatgatttatcttagaaaccacacatgcacttagattccaatctggtctggtcactgaagcatggaactaggaagtttgctcaaacatcatattatttatttcagatgttggggaaagtgcagaagcccttggatgacagagagagactatgcagtgaactggagaggacctaatttgtgaaagtgtcagtcatgccaaagggaggagcagggtccaggcttaggtggttactgcagaggcttccacaagccgaggaaaaagaccctcagagtcattccctctggggtcggggagggggtgttgaggagcttttatttttttaacaactgaattagttttttatagcctcattacaaatttggtagtttaaaacaacacacaactattatttcacaatttctgtgaattaggaatctgcttacaccttagctgggatccctgtttcagggtctcctataaagctgcaattacagtatctgccagggccatggtctcatctgaaggctcaaattgggaagagttttcatccaagttcattcagatgatgtaagattcagttccttgcaggctaatggattgagggcctcaagttcttagttatgttagctggaggccaccctcagttctttgccacatgggcctttccatttgcttcttcaaaggaaacgtgaggagctggagagagtattagcctgagaaagagtgccagcaagacagaaatcacagtcttttatagcctaatcttggaaaaaacatcccataacttttaccttaatcacttcattagaaaccagccaactaggtttagtccatactcaaaaggaacagattacagaaaagagtgaataccaggaggatcattaggaaccattttaaaagccattgggaaccattaccctaacaacctatctcctgaagctaggagttaggaaaagagtccttcctgcatactatgaagagagctgtgatttagggtatatgcttagaaacctgattaatgtcagaatagagtgtgcttcagctagtgatagtatgagtccagtctcgacttcttcctacctttgcaaccattctccagataaaggagcctcacaccagcctgaacaatagatgctctaccccagtgcctgccccctcactaggtggggctcaccatgcctcagtgggagaggcctgcctggctctagcagcttcttcatcttcctcgttcttcctttcctccatgactcttgtcaaccattattcctatgcaactttaggaaatgttttacttcccattcttggtactaaaagcaaaacagcatttgtccaaaaggtaggaaatggcagtcagctttcttttcatcatttgatacttctctagtgagctgtgagtcaaatctcttctgtgtctatgatttgaggggaaagagaattaaaagcaaatcccaaaactttaatgagcattgtcaaatgaataaggagtgagattaaatattaagcaaacccaaattttattcagatcacccaaagtcaagttggtgtactttactatcaattttgtgttatttataaggaacagatgaaataattttgtcttttttcactttataaaccataattcttatgtattttggctattgtagagctacccacaaatgattacataatttatagcaatttattttaaaaatttaacccactgaatacaatgttgagatgagagcttttcaatgacagagaaagctcttgattttagtagagaaacaaattatcaatatttataattttctcatttcatttttagcatcttggccaaatgttttattaaaattaaactatttttaatgtatattttaaatctagaaggtatatacatatatacacacatatatacagttatgtgttgcttaatgacagatatattctgagaaatgcattgttaggcaattacataattgtgcaaacatcatagaatgtacttacacaaacatagatggtatagcctactacatatctaggctattgctcttaggctacaaacctcgatagcacattactgtaatgaataggcaattgtaacacaatggtatttgtgttatctaaacatagaaaaggcacagtaaaaatgttgcatgataattttatgggatgaccatagtatatatggtccattgttgaccaaaatgttattatgtgacacgtgactgtatgtcccaatactaatagcggttatctctcttggcagtggtttatgcttttcttaatttttccaagatttctataatgagttaatctattataatgagaccaaacacatgtcattaaaaagaaaataagtcaaaacaccactttctattcatagaagagtggcttttaaggtaagtagaacttcagtaaactgtactctctgaaatgtctcttctaatatggtatataccaacttttaaagctgagatttttatttagaaataactttctttcaaacaccttggctgttaatgaagaatattttttcctaatgagttttgcatttgtgggttttttcccctttgtgtttacactgaataaaaatttactcctaattctcagcttttagcttttatgagcgctagatggcactcttgctcaaccaaaatctagtttgttgcccatattttggtgctgtgggtcttaggagaagacgggtttgcaatgtcacaacacttatgtttttaaaggggggttggggaaaagagaccaaagtttccaagtttaaatagccgagcttaactgatttagtgtttccatctattgagaaaataaccatataataacaacgataacagtcattcatttcacaaatattttttgagcacctaccatctttagtactgttctaggtactcatatgcactaaagggaaaaatagataaaaatcactaccctcgtagagcttacattcaaatgcttggatttttttttgcaggtgccactttaaactctgtacatgcattcacccatttaataggaggctgagacacaaagaggttatctaatttgcccctgttcacctagctagtgcagatggcagagcaaggattcaaactcagacatttggtctccagagtttattttgttaatttcaatactatactgcctcttgaaactaaaaaaacaaacaaaaaaacactttattttttattctattgaatgcaaataataaaaatttacctatttataattttttctaaatctgcttaattcaaatatctttgccattttattaaaaaaaaaattgactagataaaatgtctgtattttttggtgattccgtagtcaactatcgtgttgccttagctctctttcaagtcacaaacacagctggccttaagtatttatttaagcatctttatattcctgtttactttaaactccttgaattagccatgcaataatttgggtatgttgtattaagagctctaccacattatggttcagtcattgtataattaaacatgaggcatcaagaatcaaaagttactgttttacttgcctgctctctccattgtgtcattttacattttagtagtactgtgttttgtttattaaaaaaagtaaaatcaacaatatactatgaagctgaaaaatgatacagaagcctaaatcatttcttagtctagagatgcatttcatggtttttagagggcagaaggaacaaatttacctttctctaaaaacatgcgacttggggaaattatatgtgacttagggaaattatgcttgtgtttctcaaggactggagttatattcaacaacatacttgttgtaaactactgactatagaagggaaatcacccactatacaataaaaatatttatggctaattcacacatagataacctatcattgaaacttgcctttcaggaagctgaaataattaattcttaacagctagctaggtcctttttcttttttgctgcagaactgtgttagaggataaagctgtatttttgaaatgctaataattaagagttaactgtgttttaattaaattaagtaattagtaaaagaggatcactcccttcaccagggagaagaaagttttcagagcagagatttattttggaagatgctacaatgtaagcattctcaaattgaggattattgctattttaggtgtctgaaccccttaagctgcatgcaaaactgtgtactcacttgcatttttcttgggagagagcccgtgttttatcagattttcaaagagattgtgatcttaaaagattaagaaccattgctaaaacgagagtgacctgctgcatgttaaacttattttccttaaactttagagaaaaattgaagtgattgaaactggggagttttaaaccaacaaagggaaatttttgttgactaaatgttagctcgtgcctctgagtctgctgagtgagtacaagacacattcttgcagtgtgtctggtgaatatttgtacttgagtttcttatgatgctggtcttaaactggcaggccctcacctggcagtttacaggttaaaagtttaagtctggcttccagaatatgaaaacacagggagctcagctgagcacagcagagttgcagccctcatgtaacatgaacaggaaatacatattaacacagaaattgatcctagactgccggggtccatatcccgattctgcctgtctaacctcgaggaagttacttaccatctctgagcttcagtttatcatcagcaaaatgaagataaaaggaccttcatctctttaaggtacttagcattgtgcctgtcttagaacttagtatggtaaaaaaaaaaaaaaagaaacaaaaactatctttgtatatgccttagttatctaaaatagcacctcttcttaccctctagatccttatcttgatttatttttcttctttgccccaaacacgacctgaactcgttatttacttatatatttattctgtctgccctagtaggttataagctccaggaagactgagactttttcttgttcattgctggaccctctagaccaatgctatcacatacattgtccaacaaatgtttgttgaatgaatgaataatgttagctattattattacttggcagtttctacccaccctctctcccatctgtgtggactgactgtagctttttctctttaaatgagatgggtaaaccaggaggaaaacgtccttccctacctgggtagctgaagtcatagcttcaaaaggaatattaatttcttatacgctcttactactcaaggtgtagcctatgggtcagcagcatcagtatcacttagggaagatattggaaatgcagaatctcaagcctcaccccagttctactggatcagacttgaatccccaaatggttctaatgaatgttatagtttgaaaaatgctatgttgaccactttaagaattttggattttatcttaacagtaatagagaaccactaaaatcctttaggttggagattacattttcagatttttgatttaaagtgattaacttgtattagaaacagtagttgtctttggaaaaagtagccattggctggggacaggaatgagtccaaggcttttcactgtatacgttttcataagcccatttcaactggtgggccctggcggtggcctgtctatgctgttctcccaccccaatcccacccacccctacactatgaaggatagacaccctgccctcacatcagctgctgcacaccccacatacagctgctgcctgtccactttctgagcctaaggttgcgtacatgggccttgtgttcagccatagggaggacaacccatgtgtaggcccagagagctggctcagcccatttgagtagagattcctacggttccaagtacctgaagcataatctgggtgggcacatgccctagtcctgtggacttcatctctcagaggggtgcagctggaggaggtccacagcaggccctctaaagtgtaggggccccactctctgggtctcagagacttaatgctcttttgcacttcctacattcaaatcacgtgaaagtattttgttcaatgtgaatctgttacctacatttaaaaaaataaaatggaacattaaaataaaatgatggttcttgtgtggggcatggataggtacaacaaaggaggcatgaagaccagttaaagggctgttgcattgtttcagcagtaggtgatgtaatgcttggattagcgtgataataagatgtggtttcatcacattttttaagtaattcattgctatgttttttaagtttcataagctcagtattaattttcttaagagtttgtggaggctgggtgcagtggctcacaactataatcccagcactttagaaggctgaggcaggaggatttcttgaggccaggagtttgagaccagcctgggaaacatagtgagaccccccctcccaccatctcaacaaaaaaataaaaagtaaaaattagctatgtgtcgtggtacacggctgtggtcctggctacttgggatgctgaggtgggaggatcacttgaacccaggagtcccaggtaacagtgagctatgattgtatcactgccctccagtctgggtggcagagcaagacccagtcttaaaaaaaaaaaattaaagtttgtgggaattaagttttctggcccatgaatatttgaagatgtttttacttttacctcagattttgttacagttgatttgaatattaggttaaaatcattttctctcataactgtgaaggcattattccattattttctagcatctggtgtttataatgagaagtcttatgccagtctcattcttattcttttagcatggaacttggtgtttttttttgtttgtttgttttattttacccctctctaggaggcttgtttttcttttttccgcaactttttttttaaacctatcaaatagttcaaaaaatagtatggaaaatgccatatacccttcacctagagtcacgtattgttaacattttgccacgatggccttctctgtttttttctctccttttgctcaacctcttgaaagttacaaacacttcaccccaaaatactttatcatgtttttcctaagaagaaggacattctgggaacttaagatgctttcatttatctttagagtttgaaatttcggctgggcgcggtggctcacacctgtaatcccagcactttgggaggccgaggcaggtggatcacctgaggtcaggagttccagaccagcctggccaacatgatgaaaccccatctctactaaaaatacaaaaaattagctaggcatggtggtaggtgcctgtaatcccagctacttgggaggcagaggcaggagaattgcttgaacccaggagacggaggttgcagtgagccaggatcgtaccactgcacttcagcctgggcaataagagtgaagctctgcctcaaaaaaaaaaaaaaaagcccaggaaatttcactggtgtatgtcagaatatgtttctccccactatgcttgggtcttttcaatataaagattgaatctcaaattactcttctatcctctcttttgttacttctcctctattatatctcttatgtctgtccttttttgaccaatagttaagtgttagaccttcatcttaaccttttttcatataccgtttcttttttgtctttttactttatatcttggagagttccctgaacttatcttccaaattacaaatttgcccttcagcccagttctattattcagttcttctattgacatgtttatttagcagccatgtttttaactttcaataactcttttgtattctcagattgttactttctctgagcagccagttcttatattatgagtattttattctctgatgatatcaattaaatttttaattagtttctttttctccctgctgaatcagccaggatcctagcagaaaatggatggcacactcagctggggtgactaaagagaaaaaggactgtctacaaaggtgtatgcagggttaagagaaaccaagaagggatgatgggcattttgaactagtgacatctggaagtcactgtcccccccaaacttcaggggcaaaggttgagtgtagttactggaactcagtgaggtctgcagctataagagaagcctgcctgcctaacaggaactgtggccttcaatagaggaatatacccacttctgccttcagaataaataccctgaccttcttctccctgtcctccaatttgttagtgcctctctatcataaaccaaacagtaagagtaccgtaatgatacagtccatagtggtgagcattttgaagcacaaaacagggtagagtagggcagatacatactttgcaggggcaaatagaacatatccagcatacctgtattgtgtctgtttcatgctatttaggaagacattttgatgagtggattgagactgtgaaaagaatagtacttggggctgatctggtaggataaggcagcagcaaaaataaattgctcttgtgaatagtcaaggtgagtgcagttgagagtcctgaggaagtgtgtataggatttgagtactcaaaactaagagatggaagaggaaagaccggagagagggagaggtaataacacaaagctatagccataggaatgaggctctgccgatgaaatggatccctttgaaaagcttacattccttttttgttttctttgaatttggaggacagttatcttacttagcgttcagttttagggaattttctctcctatttttactatcttttacctccaaaatgtccataaaagacttctacccttgatgactacacattaatgatgatctgtggagtgacagcagggtgggcactgtgcaggagggtgttatgggagctcagggaagttggtcatggtgtggaggacctgcagtgacagtgatacaatccctttgtgcccagatagactggagacctacagatagggaggggaagttgtgagtgaggaggcattggggttcaagctgttttgttgaacagtgagggctggaggatggtgggacatccagactataggctcttgaagttatatactcttttcctcttcagaaaagcaaccagattaaattgtattagaatgaaaggtgaaaagcatacattttcaaagtaggcctgtctgaggaaacataattgattttgcgaatattgcaccagaagaaccagggccaaggagataataagatgatggtggctttttgcctttttcctccagatctgagagtttctattgtattctggcatctgttacttcaacgtttgctgtactgtaagtcttcattgacacttgacccaggcaaatccatttttctctacatagtctctctcgaacttttaagcttagcactgtctttcactattgcagcatgtttctttttgggatggtcattatttcttctcttttaaaaataatatccatttatatctgttggttattcaagtggtatggctgtgtccaccatttgagttatcttcatgagcctcttttttctacttcgtatcacacatacttgaaaacagaagactattgttgacttgtttagtttcatcttatttttattaaaatttaaatgccatcacatgatctcagtgctatgatacatgtctggatcttggttacttgaattggtcgatatttcttaagggaaatagagtagacccacatataattcccacctactttctttttcattttatcccagagggatccacattccttccttaccctaattcactgcagggagacaaagagaaataataaccctcttcccctactgctccagtaaaaattacaacaaatcatagtgactttaaaaaaaaaaaaaaagaaacagcaaaccttcgtgatttaaaaataagcaagcttatgttttgcttcttcccctgtgaggaagctacagcaaaggctctagggaaagagtttggtagaaatcacaaatttgtgtatttttgttttagtttacagacatgttattaagccaaaaatcaagatacaggatctaacaaaggctttttattacctgtcaatatatgtattagttggaaataattaatttgaatgtagaaccaggaactattgtattcgtttaataattttacctttcactgagtatggatagtagtgattcttttatccctcttaaacttgcctcttttaagatttaagggatgatcttattcttagtttaggctcttatcttacattagacgaaaaggagttctaactttgtaaaataccttcaatgtattggttttagattctaattatagatagtatcttctattataatagagaaaaggtatagtaataatttcaatattttaaagtaatattaaagtaatttaatattttaaagaaaataatttttttgtattttaataaggggtcagtattttaagacaccaagaatattacaatcacatatgtcagaaagagaaatgtgtgatccagggtcttttctacacctgaacacacatttatcttattttttggcctgcaacctcgtccttattacaatggcccaatatcttgcttttctttgttttttcatcctctagtcatattgttacacatttgaggctatttaagaaagaaaaaggactctgcttcagagttttctccctatgtcttcatgatcaaatagaaaggaatgtgtgagagggacaatcaggtgatttttaaaaccaagtgaatttatattttagttatttcaatcacagtgaattgttacttcttttaatattggaaaaataaaaagaaacaaatctctgaaaattgaatgagtaaatgaaaacaggaaaagaagaaactaaataacaatagttattcttataaatctgagaagcatcataataatagtattaggggaaaataattttttttataaacctataagaacactgatagtgataatgattctcagacatgcctaaagttaaggaaaatatatgcttataaaggttatgataatagatgtgaaaatgggaaataataggaatagagaactgaaaagagttaatgggctattaaattcgggaacttaaggagagagggattggaaataagtgcaaaattttgcaactcaaatagcacagtttcttatgtgacaggtaacctatgttacatacttgatgaggaaaacaagaggacacagtactattcttgataacttttttaaattgtcacagtatgtaatatgaagacatttaggcaactagagggtgtagaaagtaaaacagaggactggttattgttgctgttgttgctgttttgcctctgttacatatgtagagattgctaaattgttactagtttatcaccacacagattttgccaacctgaaagtgtactctcagcgatatagacttgtttatacttcatatactctatgcttgctatccctccctccctccctcccttccttccttcatctctctccctctctctctctcccacccactctcggtctttccctttccctctcccccaccccacctctcctctcccctcccctcccctcccctcccctcccctcccctcccctcccctctcctctcctctcctctcccctcctctcttctcttctttcatttgatattttttatgtcccatgttttgatttggtgattgatgatgaactgtggctttcagatcttccttttgttctaaagcacatactgtcctaaatcattttctattttggtgttaattagtacatcattgggcagagtattgtctaggtagctgaatccatgatgctttggagctaaatacactattttccattatagcctgatatgtggactaggtcacctttagatttattgactctgagctaactctggagtcatctataaacctttatttatcatcttggcatataatcaggaacataagggtatagctgtttgaggatttgaatgatcatatggcctgtaggaaaaaaagggggcagtgggggaaattctagaagttgacagatatcaatcaagccagtttagtgacaaggctaaatactagtttactaagattctaagactatttcatgatgattttaccgttcattgttaatttccatgtcatgaatttcagttctttagatccaaaattgtatacatggctcaattttattttttctatttaatgcagcattgatatgggtaaagtaaaaggctacaagttggggtaaaataaatgaaaatctaattttttttttagtttttttttggcttttttcttttttttttaaaggataactattttcagacatttttgggtaccagacaacttgtagaaggtatttttcttcttttgaaatgtgttaacttcacaatatgtaatgaatagctttatatgtaaatggttaaaactcccctggtgacgaatttatagattgagtagaaagacaatcagattaaaagatggtagcacaagacgtatctgaatcaaagtatcatcaaaagcttaaaagcaaaaggatcagcaagggtacataggaaaatgcaaaggggaaacagcagtaatcacagcattaatctcagagaagacctcaggattcaaggattaggcaaaactcatcttctggcaagatagtgagttctcagttgggatgagcagacagttccccaactgtggttccctaaattttgattgctctgtctccatgaacatttccacatcatctctatcccctctggtcccatcactgtaattgagttgcctactgggtatggctcatggaaaatttggggcaagtcattggtctatgcagcctactggccttccccccaaccccctgcccaagggcaggcttcctctcttttctcgtgtgctccctcccaccaccccaccctcctacttatttctcttcaaacagttatacctgagcctatgttggcagtttccctctcctcttctatctaatatagaggtgtgtctctaccctggctgacagacatattcatgctcccctctcaggccagaagcctgcccgacctctacagggtgactcctgggactcagacagggcagtgaccaagggctgtttctctctgcaggaaggctctataacccattcgtttggtatactttcagacatctcgttctccctgagaccaactatgaagtgtgtttcaaactttgcagatgcagttgtatatttaccttcatacagcagtcccaccttatctatggtttcactttcctcactttcacttaccaacagtacagtataatgaggtattttgagagagagagagaccacattcacataatctttattatagtatattactataattattctattttattgttacttagtgtttttaatttcttactgggcctaatttctaaattaaactttatcatagctatgtatgtataagagaaaacatagtacatagggggttcagtactacctgtggtttcacacatttatgggggtcttggaatgtgtaccccacagataccaggggactactgtgtatgaattcatgttttaatacagctatttctgtgtctctctctttcacacgcacacaccatcttaaaatttttatatatgacttctcatagtgttttcgttaaagataaatgtttttacatggcctcacataatttatcatccaaactgggacactgtgagagaagggattacaccaagtcaacaggagtaagccaaattgaatagtcagcctccctgcaaggccctccatggtgtggctgctgaccttggcagcctcatcttgcaatgtgctcttcctcgctctgtgcgcctcagactcacaggccctctttgcttactgcttacttttgctcaaaagcctttgacatgctttctcctctacctggacagagctttgcctctgctctcttattcacctaataaactccccttgttcatttttcggatttctctcaattctgacttcctcaagaatgccttccaggctgggcatggtggctcatgcctgtagtcccagctacctgggaggctgaggcaggaggatggcttgagactaggagttcaaggctgcagtgagccgtgactgtaccactgcactccaatctgggtgacagagtaagaccctgtctcttaaaaagaaagccttctagggcttccctaacttgatccattctctctcattattcctcagagcaccatcttttatcacgtttagataattcttggattaatttctgtcctccactaaagtgaggtttaatgtgggtagagaccatatcagggttttctcatcatttattttttcatcactcattaggcacatagtaaaaactaaataaatatttgttagattaattaattttttttttgagacaggatctcgctctgttgcccaggctggagtgcagtggtgcgctctcagttcactgcaacctctgcctcctgggctcaagccatcttcccacctcagcctcctgaggagctaagactacaggtgtgtgctaccatgcctggctaatttttgtatttttagtagagacagggtttcaccatgttgcccaggctggtcgcgaactcctgacctcaagcagtccacccacttccatctcccagagtgctgggataacaggtatgagccacctcacccagcaggttaattaatttaaaagaggaagatgaagatcaagtttattgcatatcccaaaatatttaggtagaattaattctgatacatcccctttaatttttgtttaaaatacatggtacatttttaaattataactgaaagtgttcaaaatttaaaatttttattttacatgttatacacaaatagaaaatttctaaacattaaatttgttgaaaaaaattttttggtcaaggctgtttttttcttagatcgcatgcctgtctattatttaggtttaatacatggaatcagatgtggtttcacagatatgtatattagtacattgttcttttttcctaagggaaatataaaattaagagtaacttattgttgctttaattttagattatgtacattttaaagtcagatatacaactgagttatgaataatatgtgtgagatatttcaaaaagtaaaatgcatttttaaagaaattgttacctttctgagtagcaatttaatcataaattaaatcagggttcatatacatgtattgatttaaccatttaaatgtatttgatttgaaattggtctgtcctgatgcaaggattcagaggggagaatagaaagagcagtggatacttttcctggagacattgaaagttgcctggcataaatttaacacagagagaaggaagattatgtcattattcctgattcccttggtcattcgtcttgtggagaacaattgctacattccagtaacaagttttctgaggcttactaatagctccatgacatattaagtactgatctcatttaattataatttcagtgagattaaattattctatgtagttaaagtagaatcgagcatcctacagatgctgcactaattatagttattgatggcctactttttctgacctaaaaaggtaaatgagggagggaattgtctttgcctttgaggaattttccctctaaaatagattagttcactgtcattgctgtttattttcacctaacacttttctagaatcttcataaaactgcacagtactgaactaatcaatagaaaaggcagatgaatattctcccaaaggaaaaaaggcttggcaggtcaaatcaagcatgtcagatctctcttgccactcccaattagaaattgtaaagttttataaacaggtgctttaagcaaaagatgggatctgtggatcaggaatacatacacaagacactaattttaaaagctattacatttcttaaaatacttatctaaaaattctccttttaaattttttagaatctattctagaaaaaaaactcaacaaattatcctttgttaatgttttatttagtggtgtggctttttccacagattagattgtttactccttaatataaatgtgtgtgtgtgtgtgtgtacgtgtgtgtacacatgtgtttgtcttttttgttgtttgttattgtttattaatgtgtgattaacagaggcctagctttggtgctttcaggctgagaactaaagggatgatttgtagaaaactaaagtaggtcaaagaataccatggtgtagcaaaggggaagtccctgtgtttagtcacattgttttgcctctggtggagttcactttcattgttatagtctaggcctgtcttcctgtgagtggaagaaatcgtcaaattgcagaaaagtctcgggaatattatcataagtaactttttaaaacaatatgttattgtaagttattggaagggccggtaggggcagcaaaggaaaaataaaaagtagaactgaatttatccctaaattaatttcacagatcaaaagcaaaaatatgcatgaatatgacaccttctctaagtatgatgtaaggagtactgtgtgggtctctgtgggatgggaactagcatttcaaattttgcccgccttgtgcttgcttcagcagcacatatgccaaagttggaatgatacagagaaaattagcatgcccctgcacaagaatgacatgcaaatttgtaaagcgttccatattttaaaaataaaaatacaaacaaaattttgccctcttattctgcttttttatatatagccattatggaagtgaccatgtttcgaaatcaaggagctgttccaggctttagcaatccatgtcatgttagttctgaaaatatgcaactgaataaacattaaaagcacacctactgatcgttgcagtagcaactatcacacttttatgaaacaccattttgtgtctgcttggctatgattaagcagtactattagaatccaggaatgtactctggctagcttcaaagatcttagactgttttttacatctcaaagttaaaatgaatttctcttaaaattaaattttaagaaatagcttcctcaggttggttaaatgttaagaagttatctgtaaattatgtgtgtgtgtgtgtgtgtgtatgaagtgatatatatggagttacataaattttgaaaaacttcgttttaaatttggtgtttcctcaaatatagtatacttgatattttggattatgttttctcttacagcagaaggtttattctctgactaaatttcctttctttaggtacccccctacccacccaccctttataagggcaagacacctatgagaatattaagccttttagctcagagttttactgaagttattttctattcttgtatttgccaagaattgctgacaacttaaaaaactatcatacgagtgaaaaccagttgcctagattgtttgatgattttggtcaagtgtggatcgggatttcctgtcatttttcttcctcttctggggctgcattgcttctatctctcagcaattgtacacttggaaagaaaaaacaaaagaaggtcactagatctgaattacttttacttctgtgccaaatgaaactttccttctgttacgtgttacaatgtttggcatcttttggcatctagagagagataagcagttaggaggacaatgtgggatctgtacagtcacgcatcacctaatgatggacatatgttctgagaaatgtcatcaggcaattttgtccttgggcaaacatcacagagtgtacttacacaaacctagatggtatagcctactgcacacgtaggctatatggtataacctagtgttcctaggctacaaacctgtatagcatgttactatactgagtacacactggcagttgtaacacaatggtaattatttgtatatctaaatatatctaagcctgggcaacatggtaaaaccccatctctacaaaaatacaaaaattagtcctgtgtggtggtgtgtgcctgtaggtccagctacttgggaggctgaggtgggaggatcacttgaactcaggaggtcaaggctgcggtgagccgtgatcgtaccactccactccagcctaggcaacagagcgaggccctgcctcaaaaagttaattaattaattaattaatatatctaaacataggaaaggtatagtaaaaaaaaaaaagttactgtacaatattaggggaccctgttgtatatgcagtacatcattgactgaaacatcattatgtgttacatgattgaacctcatctagagacagccagttccttctcttgggctgaaacatgttcctggaattcatatgataaagcaggttatcatcaagagaaactcattttcctatggattatatgatccagcagcttagaatacatttctgaattctttgtgttttggggtgtagctgaatgaagtttttagtatgtcaaagggagacatgttttaagaagtaggcattctactgaaagtattgtaattgcttgctgaatgaaggggataatccttgccactgcctttaaatactaggagttcctgcaggacagcctgaatattttttctggatcattaaatgaacaactgggttccagaagataagagaagtatgaacttctgagcagaggtagatccttgaataagaggaacctttctttagaaacagtaattgaattttgggaattgttgagtatgtcagtctggaatgtgtttggctgcaaataacaaaaaaaccctactatgtagtataaacagataggggtctgcctccacaagaagtcttaattaggcagtccagagccggtgtgatgttcaactacattaataaaagccctctgccatccttagaatgtgatttgtatcaaggttgtaaaaagtctgttgtaccttcacgtatcaatcactatatttctggcatctattgttgtgtaacaaaattaccctaaaacatatcagattaaaacaataaatattaattatctcacatagtttctgagggttgaaaattcaggaatggcttagctgggaggttctggctcagggtcccttatgaggttgcagtcaagataccagctggagctgcagtcctctgaaggcttgtttgagctggagatctcctttctaaactaactcacatgactgtcagcaggagaattcagttccttaccatagggatctctctacagggttcaaggcatggcagtggacttctctcagagcaaatgatctgggagagtggggagggtctagagtgtgtgtgtcaggggagggagaggacagatggagataagaacaagatggaagttgcaatgtcttttataacctaatcttggaagtgagctatcactcctgccatattctgtggtcacagaaccctgatacagtatgggaagggactatacaggatgtagtcccttcaggagggaggcatcactgggagccatcttgtaagctgcctcctacacatcacaaatatgtactacacagtgagaaggaaaggaaagagacagtgctagcagacttctgtttgtatctcattggtgataactgtgtaacatagcttctcaagggaggctgggaagtcaaatgtttaactttcatagcctctgtagtagagacaggcagaaggaagttggaaatggaacttgggttagcctactgtccattttctgccactaccagggcatttgatgacagtgactacttttaatttgcctgtattgcctgttcgtagagttaatgatgcatcttctaggagattaggagtagcccagaaaattgctttttgttgttgttgtttttccaagacaaagtcttgctctgtcacccaggctggagtgcagtggcacgattatggctcacagcagcctcaacctcctaggcacaggttatcctcctgtctcagcctcccaagtagctgggaaaggtgtacgctaccatgcctcgctaatttttaaattatttgtaaagatgaggtctccctatgttgccaaggctggtctcaaactcctgggcttaagcaatcttcctgccttggcctcccaaagtgtagggattacaggcatgagtcactgcacccagtgaaaattactcttttaaaagtgtggtggtttctctagttgttttagaaataaagttctcactggcacctagctagctaacagaaatagcttaaattgtgaatcataagtagtttgttgtgaggaaattttaggttactttctcctttgtattcttctacatttgtttgcataaaatatttaggcagtaaaaattctgaaatctaaaactatacccaatgccagttttcagatccaaaaagaaaaattcttcccaaccacaaacatattgagtaactactatatatcacggacaatgagtacagatcttacacaatttttggaaatttaaaaataatctctgttaggcactattttacttagtgataattttatttgtaatggttactagacttttgtgaaccatattgttgattgaaataaccattctggttttctttctttctttttttttttttttttttttgaggtggagtctcgctctgttgcccaggctggagtgcagtggcatgatctacactcactgcaacctccgcctcccaggttcaagcagttctctgcctcagcctcccgagtagctgggattacaggtgcctgccaccacacccggctaattttttggtatttttagtagagacagggtttcaccatcttggccgggctgatcttgaactcctggcctcgtgatccacccacctcagcccctcaaagggctgggattacaggcatgagccactgcacccagccaccattctgtttattatatattctttcattaattaataccaaactacatttctgaaaaataccacacaacttgaaaacaagaaagtagagtctgaaaaactagggacccaagaaggattggagaggaaagtgaagggagttagatgcaaaaaataaattgaacggagataaggaccagggttatcctaccctccctttcctcttttcacccagggaccaggttaaaagaggattctgtcttcaggaaggagaagcacacagctattagcaggtagaggtgaggattagaaccttgtgtgagcagatgtcatgcctcaaaaatgtatccatatgttttggacaaaaggctggttccataaatatactggaacaactgttcaccttcttggagaaaagtataaaatttggacctacctcatactaacaaatagagctgctatttaatttgaccttaagttagggaagatcttttaaagcgtaaaagcaagggaagaaagctttaatggaaaagatagttttgattgcataaaaattaagtacatcaaaaagtaccttaaatttaaaatataaaccacaagttggaaaaatgagttgtatcatatatgaaaaagttaatattcttaatgtgcaaagaagctcataaaatcataagaaaaagcaaaagacaaaaatagaaaaatggatgtggtaaataaaaattttgaacaagtgtgccaaaaagctcaactttacaatgacagaagaaattttttgagagactattattttttttgtgcctactatcttagtagattgtccttcaggagataatcctcgtgtaggtcaggatgttataaaatgagctttcttatacactgcttatagacatgtaaattggtgtaacataattttatctttttatcagtaattccacttagggcaaaaataatatttcttcacaatagagctctaaaggaattctttactgtattttttaaggattataaaaaatcgagtataaaaatattttttcacctttagactgtatcattctcttctgttaaactgagaaaattaatgaacttgttttttccttcctcttacctcgtatttttgttagtcaagttattattttaatattcttaagatctatgacatttaagttctattccatcatcataactttcagagttagtcttagtttctatatttaagtaaatttgtttttcatcattggtatgaataatcggcagaaaattaaattgacaattacttagatgtatgttcagggaatttttcccagatccctccccccccaaaaaattaagaaaaaacgaaaagaaatgtcttgccaacaatattaaaaatattaaaaaattgacaagggaaaaactggggcaagaagtaattccaaaataaagatgaaaactactaaaattgcacaaagtaaaggtaattgcccagacccagaaggcaaacccaagcctctgttaaatttgtctacatttggtttatcttaaagggtattcaaaagctaccacttttaaaattcctgaagtatgcatacttattaatacagatatgataggtcctagaaaatattttcaaaactgagcgagtgttcgtccttctagttcttgtttcatgagatccaacctttatgaattttctttcccttaagtgtttgaatttcagataaaagcagtgaaagcgtctaatgccttctcattgcatttaggaatgccagagtccttcatgtggcccatgagggctttcactggcccagcctcatctcccagtctcatctccatatttcccattactttctgtgtccttacttagttcactggctttgttactgctgttgttcccactttaatttatagcagcctctcctgtcttggggctttctcatgtttctcagtctgcatggaatgttctctcttcccctcccccacaccatgctttattaacaccagcttatcctttatatcttagtataattgtcagttatgcagggaagtgggatatgtggcatatgacttaagcgctctgttgtcttattgtttgggttttcatcccagttcattatttactggctgtataatcttaagttatttgacttatctctgagccccaatttctttatctgtaaggtgaaggaagataattcttactcataagatgctgtgattatcaaataagaaaatgagagaagccatatgtttccaacacaaggcttcactagcattgaatgaagtacttcttaaatgttagacaaaattattcccaacctacctcctacccccaattccctgctgtgcacacacgcacgcacacacacacacacacacatcctagtcttgaacagctccttttattgaatagtgacgtatatgaccatatacctcttattcctaacatttacaactttcaattactttattgattgtttgattaatgtctgtctcccttgactagattataagctctacggggtagcagctgtgtagttttgctcatcctattctcagtacttagtctggattaagtcaacaataaatatttgtcgagtgtagggacaaatgaatgaactaaaggaatattctgtctcgtctcaaaactgcatacttaatggttgaaatgtttcctgtagtatagttttgcctttaagcctataaatcacaaattcaatatcaatgactagagaataatctactgccagtaacttatataaaacctgcttgtcaataaaaattgttttcaggccttttggaatgtttaaatataacatttaaaaagtacataatgaatactctcattttcaataacattgggaaaggattatattaaaactttaagtgaacattgaagtctagataaactattttaagtaatgtttgatctcagctgtctaaaaatatacataagaaagagaactgaaagtaaatataccagtgtgttataatagcagtggctttctttgagtggtaggattatgatcaattttaatcattttgtgtctatgcttatatatttatatcaatatagtcttcacttttacagtaaaacattgctttataataacaaaaattatctttaaaattttctcaaatatttctggaatttatagagggaaacttcattcatttatctaacaattatttactgagcaactacaaagtgccaggcactgttttaggctaagaggatgagattataataaaataagcaacaattcctttctttgttgaattttcattttgatgtatttgcagctacctgtctgactttggtttgaaacttatcttctacatctgtcttattaaaagtaatggcaaaaacctcaattacttttgcaccaagctaataagccattgttgtctgctgtggtttgaatgtgtcactccaaaatttgggtgctgtcaatgtgatagtattaagaggtggggtctttaaaaggtgattaggccagagggctgctccttcatcagtggaattaaggtccttataaaagaggcttcacacagggtttggctaacttgcctttgttcgactgtcttctgtcatgtaaggagatagcaagaaggcccttatcagaccaaatgccagcatcttgaccctggactttccagcctccagaactgtgagagaaaacaaaacaaaacaaaagattttttaaataaattacccagtctcaggtattctgttacagtggcacaaaatggagtaagacaatgtcacattaatgatttatcatttttatcttgtattcaattacagaaaaaaagaaaaccagtgaccacaatttctaaactctttgtaattctacaagcttttaagtgtttttcatactttagaaccccatctttgacctctaatggtaagcaaaaaggtaataagaggaccctatttaaacattccttaaagggttacattttctccttcaaagagtccattcatatagtattactcactaatatacaatgttgcagtttgttcaactccttttatgttaaaaatacacaactgatgtgttacatttttcactgaagtagcaccattattgtctgactcagtttcaatgtttggtaaataatttttaaaaatctttataatattctgatcctctgaaatttcattgcaccctgctgttttataaaaccaattttaaagctactgatccaaaagaagttttaaaccatcatgaaactgatttctgaaatgagtttttttttgttgtttttttttgtttttaagagatttcctgtttgcttctgaagttagtttgcaaattagttgtttaggactcaggttatatttctgtgtctaagcagcattaatatttggtgattagcttcaggaatcagttcaaaaaaggtattcagcccttcttacttgaagtcatgctaattgaacaactttaaccataacaaacgtccactcataatattatttctatggaggtggctgaggaccacattccccctacctaagcagtagaagctgtgtttgttccttcttgccttcctttgctaggctggaacctggagaccagaaagtaagaatggaaaggaagggatgctagtggtggatgagtgattgttggcagcagtatttttttaattccttatgattactaaaagaagatagctctcttggaaggttggtcttcctgtggtcagactggaaatcagcttttgcctttaggctgagagacctaaggattatgtaagtctattgatttaggaatgggagggaacttctgctgcctgcccatttgtatagataggttatttgaaagttagagactgctttgatgtttgcctgcctctcttaggaagctaatttcatcagtctttcagaccagtccaactaatttttcctccttcaatcagttttatatatttaaagtctatttttaatatttaaagacttgccatactgtctcctttgcaagatggaaagtctatgattcactgtacattaaaatgactttttttttttttttttaacaatttaaacaatagcattctgtgtgtcttttctaggctggagatgtgttctctgcttctagccgctgaatgttttgactgctacttaatggcgctgttgcagacagatgccaccttcagctggtagcacaattggtcagtctttgaacagctctgagttgggccagttattgctgtttggacatgtttagatttgaagttcctcccttccattgtgagtagagcaagattgtgtcatcccataaaacctgttgaaaagtgaaaaagtagtcaaatcagatgcctatccaccagtttggctttttcactaaattggccagtattttacttcatatacagagttttaaaaatcagttgttattcctttacttacagcctttcctttgttgtattttacaacactgttttataaatcttcattttaaaatttcttttaaagctgttgcctatgtttcaaaccaaagtcagacatggagatgtatttacttcctcttctctgggtatttatttgttttgacatttaattcccatgatgcaactttcttgagaattttttaaagagggtattttggtaagttaacttcctttcagttctatgctattaaaaaatacatataaatatatatgtaatgatttcaacataatatatattatacatcaatattagtatataatatattaatataaatatacgtcccctctcctttttattttttattttttaactgacacataataattgtacataattatggggtacataatagtgtttcaattacaatgtgcagtgatcagatcaggataattagcaaatccgtcatctaaacagttatttctttgtgttgaaaacattcaatttcctctcttctagctgtttgaaaatatataatattgttaactatagttatcctacattgctatggaacactagaacttattctgcttatctagctataattttgtatactttagcagatctcttcatattcccccctttccccctactcttcccagcttttagtaacctctcttctaccttttacttccatgagatcaactttttttttttggctttcacatatgagtgagaacatacgatgtttaactttctgttcctggcttattttacttatcataaattcagttccatccatgttgctgtaaatgacaggattccttcttttttatggctgagtagtattccattgtgtgtatataacacattttaaaaatccattcatcctcttttttttgataccaacttttcctacttttatgtgccaagatgttctcaaagccttgcagaaatcatagctgtcatttattcatacacatgttctacaggtgtttgttgaaagctagctctgtacaaagaagcgtgctaagcaaaaaggacaaagacactaagtcctagagagacttgctgtttagtggaggaaacagagaaggaaaccattgttatgttttaagtactcatcccgtcactttttatagctctgaacttcacacattggagtaggattacagcctgtgatatatggccatatcccagggtatgcaggaacacatagaataaattgtgatgtatcttcctggaatttagaatcaggggaatgggaggcagggatgaggaagagataggtaatttaactggtaagtaatgaacagcattattttaggttaaaaataagcatagctgtattagggaataagattttaaaatttgacataaaaaaaattctcctacttgtggccatctacccacaggcttgtcaccatattatcccctgtggaaggagttcactcctctcagaggttagaggtcctctgggaaagattttgtaaaggcccttctatctgttctaataaacctggttgtgttaaacagagaggctagagaaggtggctgccttttcagagcacagccttggtatttcctatgcagtcactaccttttaacagtaatcctttaaaaatactttcactacttttgttaactaaacccacggtgcaatactgtggtgcagatctcaagacaagtaaacaagggaggtggaggaatgaatgtctcaggaaggtggctcctcaaactattcacctgtggttaaactgcctgcaccacatacaagcagggtcagttggagatatctgaatgtttattgaggcctttgtgatcttggaagacaaaagattaagggagggcatttgtgaaggtcattcttcttgtcactgtttcagtgaatgttgacagcaaaaatattgcattagatttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgtggccttccgcagtgtttgtgtccctgggtacttgagattagggagtggtgatgactcttaaccagcatgctgccttcaagcatctgtttaacaaagcacatcttgcaccacccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcagggggctgacccccccacctccctcccggatggggcggctggccgggcagaggggctcctcacttcccagtaggggcggccgggcagaggcgcccctcacctcccggacggggcggctggccgggcagggggctgacccccccacctccctcccggacggggcggctggccgggcagaggggctcctcacttcccagtaggggcggccgggcagaggcgcccctcacctcccagacggggcggctggccgggcggagggctgacccccccacctccctcccggacggggcggctggccgggcggggggctgacccccccacctccctcccggaccgggcggctggccgggcagaggggctcctcacttcccagtaggggcggccgggcagaggcgcccctcacctcccagatggggcggctggccgggtggagggctgaccccccacctccctcccggatggggcggctggccgggcagggggctgaccccccccacctccctcccggacggggtggctgccgggtggagacgctcctcacttcccagatggggtggctgccgggcggagaggctcctcacttctcagacggggcagctgccggacggaggggctcctcacttctcatacggggtggttgccaggcagagggtctcctcacttctcagacagggcggccgggcagagacgctcctcacctcccagacggggtctcggccgggcagaggcactcctcacaacccagatggggcggcggggcagaggcgctccccacatctcagacgatgggcggccgggcagagacgctcctcacttcctagatgtgatggcggctgggaagaggcgctcctcacttcctagatgggatggcggccgggcgcagacgctcctcactttccagactgggcagccaggcagaggggctcctcacatcccagacgatgggtggccaggcagagacactcctcacttcccagacggggtggcggccgggcagaggctgcaatctcggcactttgggaggccaaggcaggcggctgggaggtgtaggttgtagtgagccgagatcatgccactgcactccagcctgggcaccattgagcactgagtgaacgagactccgtctgcaatcccggcacctcgggaggccaaggctggcggatcactcgcggttaggggctggagaccggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagagggagagggctagagctacattatcttattgcattagatttttttaagcttgtaaatataatattttttacttatgttccaaagtatatgaattattgaaagttgaggcattggtttttcatttagagcaaaagacagaatacgcttttttcagcccatatgggttcaaaatcaaattcttattttcaatcagagttcttccatatcgtgcctcacatttatttatttcagaaacatgtattatctactctgtgtaacattccatgccagacactggagaaacagataaggcaaaggtctcattctcaaggagctcacagacaggtgggcaagataaacaggcagttatggtatatactagtaagtgccatgcaagagaattctgcaaaggctttggatggttggggatgaggggatacagaaagggagtagccagggtaagcgctgtagaagagtaatgcctcagctggctcttgaagcctgactaaggagaggccagttgaagaagtgagagataaggtgctctggtcagagagattagcatgtgcaaaagtacagaaccatgagatttactgtgtttgaagaactgtaagtaagttgaactcagtatcattggagacataggcagagatgcaatctgaaatggaattatatgccatgtgaagaatctggattttattttgaaagttagggggaacctataaaggattatatcatcatcagatctgcattttggaaagacttctccagtgtagagaataggctagaaggtggcaaaggcattgagacagaaaggaggctatcgttctaatctgggagagacatggtgagggactgttttgatggggttgggagtgaggttgaggataggggatagattttacagtttctaggatgtagaatattcagaacttgacaagaggttagtaagggtgtcagaggagcctagctaggcacagacttgcaggtgtctgcactggacaactggaggtataatgaaggccttcgtggagatagggaatataagaggtggtagcgtagtgcaatgggtttggggaaggtgatgagttcagcttttttttttttgaaatggagtctcgctcttgttgcccaggatggagtgcagtggcgcaatctcagctcaccgcaacctctacctcctgggttcaaccgattctcttgcctcagctgcccaagtagctgagattacaggcatgcgccaccacgctcagctaattttgtatttttagtagagatggggtttcttcatgttggtcaggctggtctcaaactcctgacctcaggtgatctgccctcctcgacctcccaaagtgctgggattacaggcgtgagccactgcgcccggctgagttcagctttttattttttattttttgattcgagatgtctgtgtgacatcaagattaaatatattaggtagatagagaaataggcctcagattcaggagaaaggactgagatgtaattacaggtttggtcagtgatgaaagcgtgagatcattcagggtgatctagatgtagatattctcttatgttttcttctagatgttttttagtcttatatattaaatttaggtctgtgatccattttgagttactttttgttaagggtatgaggtttatgtctagaatcattttgttttctttcttttctttgcgtatggatgtcctattatttcatcattacttggtggaaagactatcctttcttcctttctccattgaattgcctgtactccttttttttttttttttttttttttttttttttttttttgaggcaagttctcactgtgtcatctaggctggagtgtggtggtgtgatcacggctcactgccctggtatccttggctcagacagccctcctgtcttagcctcccaagtagctgggatcaccggcaggtgccactatgcctggataattttttttttatttgtagtagtggagtctccctgtgttgcttcggctggtcttgaactcctgggctcaagcaatcctcttgccttggcctcccaaagtgctgggattacaggtgtgagccaccatacctggccacttctttgttaacaataagttgaccatatttttatcagtctatttctgggctctctattctgttccattgatatgtgtatctgtcctttcaccaatatcatgctgtattaattatgatagctttataataagtcatgaaaacagttagtatgactgttctaggtcttttgcctttccatataaaattttgaatcagtttgttgacatttacaaaatagcttgccaagattatatttggaatgttgaacttacagatgggaaaaatggacaccttactagtattgagtcttccaatctatgagcattgaatatttctccacttatttggatttttgatttctttgatcagagttttgtagtttttggtgtatagagtctatacatattttgttggatttatgcctattttcttttttattgtaattcttttaatttcaaattccagttgttcactgatggtctatagaaaagcaattcactcttgtatattaactttgtatcctgcaacctgctcaactcccttattagttctaggaattcgttgttttttataaattccttgggattttctatgtacataattgtgtcatctataagtagggacagttgttatttattccgtttgttgtttttgttgttgttgttgttttttatctgtatggcttttatttacttttcttgccttattgccctgactagaacttccaggactatgttgtgtaagagtggtgagagtaaatattctttccttcttcccaatcttaagaggaaagcattccatctttcaccgttaagtataaaaacagctgtaggtttttgtagaagtttttaagctgaggtaactcccactctgttcttatttttctgaaagtttttaaaaatcataaatgagtgttaaatttactcaaatgtttttctgcatcaattaatatgaacatatggtttttcttccttagcctgttaaaatggtagattgcattgattttcagatgttgaaccagccatgcattcctggaataaatccccctaaatcttgatatataatgctttttatacattgtggaattctgtttgctaatattttgtttaggatttttgcctccattttcatgaggctgtatttttctttttttgtattgtctttgtctggttttggtattaggttaatactagcttcataaaaataattgaaaatttttccctccttgttttctggaaaatattatgtaaaattggagttaattctttaaatgtttggtggagttatccagtgaaataaactggatttggaaatttattttgggggagtttttaaaaatcacaaattcaattttcttaatagcaatagggctattcaggtgatctatttcatagtaggtgagttatggagttatggtgggaattgacccattttgtctaacttgtcaaatgtatgagtatagaatgttcacagtattccattattatcttttggtctttgcaggtttgttttttttttttcgcaataatcctctgtttcattcctaatagatattggtaatttatgtcttctcttaattcccgtgtcagtcttgctagaggtttttcaatttttttttcttttcaaagaaccagcagtttgtttcactgattttcttttactcttttgtttttctgttttcaaattcattgatgtttgttctttattattttcttctgtctgcttgattctcagtttatactgctcttctttccctaggctcttgacatagaattttagatcatttatttgaattttttattttttaatgtatatatgtagtgttataaatttccctctcagcactgcttcagctgtgtcccacaaattttgatatgttgtattttcattttcatcctattcaatatattttttaaatctccccgatacctcctctttcactcatgaattatttctgagtgtggtgtttagtttgcaaatgtgtccaggcttccattttcctattatctttctattatttacttctagtgtgatttcgttatgatcagagaacacatactttgcatgattttcattcttttaaatatattcaaatttattttatggccatgatgtattctgttttggtatatattccctgagcatgctaaaaggctatgtattttcttattaggtagagtattttataaatgttgattacatcctgttggtttataatattgttgagttcctctacatttttgctgattttctgtctagttgttctagcaattgttgagagaggaatgttgaagtctcctgctataattatggatttgtttatttctcctttccgtactaccaggttttccttcatatattttacagctctgtttggtggatgtacatttgggtattgctatatattcttggtgggtttaactttttatcatgatatataatgtccctccttgtctctggtaattttctttgctctgaagtctactttatttggtattaatataaaaattcctgctttttcaaaaaatgtagtaaaacaacaattatggtaaataacttctaccgctttttcattgtcctcaaaatccctcctttggcttaatagttacttgttagtggcgtaagtacttgtacaagtatgtttggtagatttactgagttgttggagatgagaaatagcaaaaggtcatctgctatttttatgttgcaattttattttatttttttaaattattatttatttagtttttgagacagagtctcactctgccacccagactggcacaatcacaactcactgcagccttaaccttctgtgttcaaacaatcctcctgcctaagccccccaagtagctgggactataggtgcatgccacaatgcctggctagttttggtttgttttttttttttttaatagaaacagggtcccactatgttgcccaggctgatctcaaactcctgggctcatgctaatctccttcctcagcttcccaaagtgctgggattatgggcatgagccactgtgcctggcctgcaatttgaaatgatgcacactctgtaaattgagggtatgttattttaaaaatttatgctagtttgggccaggtgcggtggctcacgcctgtaatcccagcactttgggaggctgaggcgggcagatcacgaggtcaggagattgagaccatcctggctaacacggtgaaaccccgtctctactaaaaatacaaaaaattagctgggcgtggtcgcgtgcacctgtagttccagctactcaggaggctgaggcgggagaatcgcttgaacccaggaggcagagcttgcagtgagatgagattgcgccactgcactccagcctgggcgacagagcgagactgtctcaaaaaaaaaaaaaaagattatgctagtttgtcacatatatgtttaacagttcatttgttttcaagaagttaaattcagggaagcgacaccaagaattcctgttttaatttaatcattgtagtgggacacctgatgtaatttgctggcgttaccctaagagtccttggacaagtatgtacacaaggaatgagaatggcacaactaaaatgataaattcttagtaactttcccacatttaacaactaaattgacagagaaatcagaagtccaaaacaataaatgaaaccttttaatccttcttcaaccccagtaatttattattactccccctaaaaaatcctcagtcgtaatacttttctgcataatttgttcaaaaaggtgtatttaaatataataaaaaggaatgtcatataaaggagaggagacttgccaaactagattatttctcttgtgaaagaagggagagttgggggttgtggtgggggtagttgttgcttaacttttattagttctgtagttgaagactagcaattcaaataataatctcttatctcatgactgaagtttttacgctaaagataatactgtacttggtatcagtaggccatctctttccaggtaattgttttcccagtcgtggttcctaagtgagctcagccatacacattctctcacagtccttcatttgactgttggtacatacacatttgtgaaatcccagccacagctgtgatgcagtctgtggccatgaaataatcccccttgactgtgctttctcctctctcccatcctgcttccttttcagagttgaagccacaataattcacttcactaacttattttctatatgaacaagactctagttaagacaatagaaagatcaacaaggttcttaaaaaactgaattggtagctaaaataacttttactagaaactttgtagtttatgaaaatactggttctcgtttctagtaactcatttcgccatttgggttagcaagtttagaatctacaaatgtaaatcatctatatattttggtttttaatcccagtgatgggactatgacccctccacttgagatgttttagtagtgcttatcaagataaagatagccagtgcttgctggcagtactcagtaagaaaagtcaccagacagctctgtgatttgcagatttgatgttcttgcctccaagttgtcttaaattggacctcatcttgaactgaaaatcgtgaaatacaatgatgatactttgacattaatagttactgtttgtaaaagtgaagggaaattacagaaaattctcagttaatcatgtttgagaatgtaagatggtatgattaataagctattatgacttaaatgatttatgcagtatatacaatttatattccatacaaatttgtgaagtaggcaaaatttatctttggtcatggtcttccctaccctctatagtatcccttccttgccctcaggcacagagcctcttctttcttcttcttctttcttctcctcctcctccttccttctcctcttctttctttctccttctcctccttccttctccttctcctccctccttctccttttcctccctcctttcttcctccttcttgttctccttctccctccttcttctttctttctctttttctttctttctctttcttcttttctcctcctcctccttcttctttttcttttccttcttctcccttctcccttcttttcttcttctcttttcttctcctcctcctcctccttccttttttctccttccttcttcttttcctcttcatttcttcttcctcctcctcttgctcttctttttcctttctttctgccccaattgccgtcagaatctgctcttagggaagtagctgatccctacaatggagttacctcattcatacacttaacttatgcaaatttaactattcttgcttattaaaaatttcttaaggtagggcagaaaatattttaaatataaattgcataggcaattctgtcccacatcccactcagagcatatgcccctaagtgggtgtgaaatgagaaacagaaatgtgttgtattccctttggtcttgaattcctgcttgcttctcttagagtcaacatctcattgtgctgtaggtaattcaggtgctaaagacttgtgttgttttttgttttttgagacaagtcttggctttgtcttacccaggctggagtgcagtggcacgatctcagctcagctcactgcagcctctgacaaccaggttcaagcaattctcctgcctgagcctcccaagtagctgggactataggcatgtaccaccacacctagctaattttgtatttttagtagagacgaggtttcactatgttggccaggctggtcttgaaatcctgacctcaagtgatctgcccaccttggtctctcaaagtgctgggattataggcgtgagccactgtgcccagctggcttgtgcttttttatacaaagcccctaaatacaagccagtgactccaactagtgctagaaaataaagtcatctgttctaatgctgcaggacaaaatgtctactttggccttagttaagaagtgggctgtcagtctctagcatggaaccttccagaagagattttcaagaatactcatatagacatgattttgaccttaaatgcctacctaaggtttgaatccattatattgcttaatgatttttctatttttcagggtacttgcattttaacaaaagataatggaattagtcagcttatagaattataggcatcgttgaacatcaactaaatatgtaaatggaagatgactaggtatcattttactatttttatctctgaggaagaatctgggtgacaagtttctatgccttttttttttataatagcgcttctgaaattataccaagcaagcagccatatactctagtaaatcataaggccagccttgattttattgatgattgtccaagtttctaaaaactataatatgataaatatttcaacattaaaaccatatattttgcctctggttctcaatttcttcatctatagaattaaagtattaatacttagatgctccaaatctattctagcttcacccaacttataattgttttagctctgaaattctgtaattattacatcacattggactagatgctgaatatattaataattgcattgtgtaatggagggaattttaacatcttggtgtatttcagaatcatccccgtgaattaaggttgctttaattattgctctgcaaagatactaattagtggagtgttatggtttctacggcctaataatgtttcctaggtgaaataaaaacatacttcttttctgtgccctaaattccaatttaaaaggataagagaaaaaacaaaatttttataaccttaatggacattttagctaagattttgatttgaaaagtacattttaatagaaaatagtagtgcaatattgttgcatcacagagtcttaaatagcgtggttcataagtgaggtaacttgtttttctggacttatggcccattggggagggaaagattgtctttactacttagaaagttttcatgcctttttatgctgtatcaggaatataacagctatattttggcagcacattatgggcgggggccctgtagaaaaagacaagggaccttgatcggtaagtttcctaactgaggtgctgaaccaaagccaaagaaagtttttaaacatctgtaaacctttttgttagtactgatggggcagtatgcctatttgtctctctcagatttacgactgttttattattttactgtaattattttaagagcatttttattaggctagaaagagagctgtaagtgaacatatgatactctactaatggggaacaggtgagaataatagcgccactggaaacaagaaagctaaaattgtggtagcacttcctccaggtatttagcttaggcttaagcagagttgtctgaaagttaacaggaaaagaaactacttgtgaagtgttaaaaaccacaacctaaaaaaaattttttttatcatatcatattatagtgtattaagaactacttgtcacagttaagctggtttagtagtatttgataaatacactttccctcaaacctcagataaaaacaaacaaaaaacactagatcccagcatcagaaactggtttgtttctttttcattctcctggagccaagtgtgtaacaatattagtgccatgccatcttttattaggcaaagaatgatggttaagctttccattcctcacaaaaggactacagtctaaagttaaaattcatattaattatttgaaactctgaacttactttttcactcagacaaatcgtaaagccaacccacaaaagctgattttaactgcataggtttgctgaactataaagctggaagcagtaatgacatttagattctattttagcaatgtttctatgaaaaaaactaaattttaactgagaattccaacaacactccctccctccccattctgatgactcctctctttcctaagtgtaccttggtaggaaaaggtcctaataagaggctagaagagggtggaaattctgaatggggcctagaattggaaaagaatggtggggagtcttgagggtttctgaaagtctttgattttaataatacaaagggcagatacaataaggagggcaattactatgctctgggagttacagaagtttagtaatgagcttgtccctattaatcattaatatgtgatagtggtgcagtggtcacgtctgtaatcccagcacttcaggaggctgaggcaggaggatcacttgaggccaggagtttgagaccagcctaagtaacatagcaagactccatctctacaaaaataaaaatagaaataaattagctgggtgtggtggcatgcacctgtagtcccagctactggggaggctaaggtgggaggatcacttaagcccaggaatttgaggcagcagtgcattatgactgagcctgggcaacagagtgagaccccttctcaaaaaaagtgacagaggttctaaggctacatgaagcccagtaagagtcagtgactgtgttcttttccttttcctttttttttttccctctgccgggtagtcacatctttgcctttgtccccaagagtcctgaacaccttatttcctatatttccagtactaaggttcttcctacctactccatatgtcagctttctcccgaccttttatactcagtcttttacttcaatcctataagaaaatttgggaccacagaggtgtagtgtacaaattaacagaggaaaatttaatgtacatttcttaaaatacctgacttagctctctgaagttaggggtctgttttattcagcatctaacacacactagatgctcagcaggcatttgttgagtaatgaacaaatgaatgctgttttggggtcagttcttttttggagttgaacttctaggatgaaaagcaaaatggaccctagagtggttgggggtaaaagacaggttaggaatatgatgtgaactatagcagtggtggggcagctgaatgaatcctcttgccccttttctctcccttaacattatctcttctttctcaccataagttgaggaaaaaacctattaagaaaataagtgaaattgaaattcagatttcactttctctgtattatttaggatgagattaggcttccagtgacagaaaccctgatataaaagttcttaaacaggaaagtttatttttcttccttgtaaataaaggcaatgcaggactggtttagcagctccatataatcatcaggaactcaaatcccttctctgttgttccaacagcatcaagatgtggcttctgtctctaagacagctccagctctggccatcacatccacatttcagacagacgaagaatttactgggagaataagcatatgctttctcactttagtgacattcactatgcacactcccattcccttttgtatctcactggccagagcttagtaacttggtcacacccagcttcaaggaaagctggataatatggtcttcattctcagtggcaatgtgcccagctaaagatttgagcttgtattaaccacagaagaaggagagaatagatgctagggaaactacacatttctacgatgctgatcagtaaattttcttgaaaatatatcaataatgaaagatactcaaagaattgataaataagagataatattcaatattgtatttaaaatatagattctataatatgtaaaatcagtgagggtagattgtacttaacactaaattatttacagatacttagtaaatgttgtaattgagagaagtaattataccattacaaataccaaattttaaaaaatacatcaatacctaataatttttatctcaaatacatattattcaagtccaaaacacaaagaggaggagtaaagtcatgggtgtttaaaaaatgctgtgctaagtaattaatttatattccaagtaagacaggacagttggttcaatgtactgtagctcttactaggtaggtcccacaactaatatttactgaccacttagtattaaccactcactgtgcatgatttcatgtaatcctgtggctctctaagactgctatgttatcatgtccattgtgtgggtgaggacattgaggctaagagagatttaatttatccttgtaacccaggttgttagactctaatgctgatgctttgagccttgcctccgcttctttacgaatgcttaagtccatctgattgtcatcttatcactaacagaaacatggctggaatcaattatgagaggcactgttaactaaaagcttgttcttaatttattataaatatttcttctgtccagatggcaacctgaatccagcattttggcactgtcatacagtaacttgcctgtttctagcagttttcatattatcaaattttgctcttagaactgtcctatgaattatggcccctcccattttacaaatgaaaatctaaggcatgaggagataaaataatgtgctggggttgcaatctagatctcatttttacaaagttcagattcattctaattaattgtgctaccttaagctctgaagataattgcagagggacattatggaataaaaacagctggaggcatcctgtccagaagtgaacaggttataaatgaaaataaccttatcatcctattgataagcatctccatcaaaaccacctctgacaatgccacctttgcttatatttgtttgggtataaagttagaaagaagcaagaggcttcttgggaaataaatttttttattctaattaataatcagtttttaacagtctgccttcttacatttacttaaatttacttcatttcatttccactggcatcactggtttatacctttgttacttcttaaccagaccactgcactctctttagcttaaagtgtgtctttagcttctccctacaactcagactatcctagaagtttctcttaatcttctaaaatcacacctcaacacctcatctccctgcttgcaacatttttaataatcccttgactttttcccctcctctgaatccatagcattgtctgtacctttaacataattctacctcatgggttttcttaaattggattataaggttccttagggctggaattatgattcatctttgtatacaatgaaatacctgtgtgggttcttacaaggcactgtgctctctgttgttaaatgacagttgttgaattcttcccttttagcagaagaaaaaattgttttttaaaaaactacagcctattgtcctcaagcaatggctataaaaggtatatcttcctatcttagccctgaccctgatcgagccctccccttcattaaggggcttgggtagacaaaagaaaagaaggcttggaatatctccttcactgagacaagaggccatcttccaatttatattcttccatattttagcatggttatatatgtatctgtcttcttaccttttctcttcccccccactccccccacgagatgaagtcttgctctgtcacccaggctagagtgcaatggcccaatctcggctcattgcaacctccgcctcctgggttcaagcgattctcctgcctcagcctccccaatagctgggattacaggtgtgcaccatcacacctggctaattttttgtatttttagtagagacagggtttcactatgttggccaggctggtcttgaattcctgaccttgtgatttgcccgcctcggcctcccaaagtgctgggattacaggcgtgagccactgcgcccagccttaccttttcatgtacagggggagcacgcctcatctgaaatgctccaaactctgagacttttttgaggcagagtttcgctcttgttgcccaggctggagtgcaatggcattatctcagctcaccgcaacctccgccttccaggttcaagtgattttcctgcctcaacctcccgaatagctgggattacaggcatgaaccaccacgcctggctaatttttttgtatttttagtagaggtggggtttctccatgttggtcaggctggtctcaaactctcgacctcaggtgatccgcggaaaattccacatataagtacttaacacgaaattttatttatgccaaaattatttacaatattaaattaccttcaagatatgtgtataaggtgtatatgaaacaagtgaatttcatgtttagacttgggttccatccccaagatatttcattatatatatgcaaatatttcaaaatctgaaatacttctggtcccaagcatttggtataggggatactcagcctgtaatcttaggggaagttaatccctaaatctgtttcctgactatatacttctttatacttcctctaaatcacccattatgtaccaagggattttagtgttggaaaaagatgggccatttcctaccctgggagctttcagcctaataagggagactggctagctcactggaaattatagtgcttagagataagtgctgccacagaggaaattttcaaaggaggacatctaactcagaccaggaggggtcagggaagggttctccaacgcagtgacttctaactttaggctgaagatgaggggtgggccatgattagaggggaaagacttgaactcagagggaggagcacatacacaagtctaggaatgattccagcaggtggactgtgaagtttggtggtggtgtgaggctggagaggaggtggaatggtagcactacctcttccactgaagtgcacatatttaatttgccttgagcttctcatgcacagtcactgctttcactcctttgtaccactgctgagaatcttttagggctcctttattaccccctgcagtatctaatcacttttactgactttatagactacctaaaactgaccgtttcccactactaactcactcatctcctgccagagccagggaaatctcttaactgtctcttgagttcatccagtttattctctcttctatgtcattcccctttacccatcttttaagcctttactcactccctacttctggatatttgcagtttgtggtgtataatttaatacaaaattacacgttgcctagaattgttctctaattgtttctgagtattttatgatcaactggattgtaagccccctaagagctggctctgaagctgcattttaaacagttgagtagtggaaaggaaagggcactggacctgaagtcagagcagacctgcatttgacttgtagctctgccacttgtcagttgtatgacatttcttcatgggtaatataggaataatgagatacatcttacaaggttgttgtaagaagttgtacaagtcactctatgggaaattaatttgtagaccataaaatcctatatacattttacattttattctgtagtccctaggtagaaccataatcatttcttaatgtgagatttttatggttcctttccagaccttagaatcttgaagattccagacttatttttttcctttgtgacatatttttctctaagccacatcccagctatttttattcttcctctttttcacctattcccaccccatccttaaacttatggataaagtaactttaggcagctaagaatagaatattttgagacatgagaagttcaggtgcctcatctattgatacattggataaatcttctactgtcttttccccttggtatactctgcatgcataggaacaaacttactactagcaatctacacctttacataaatgctctggacatagagccttgatcatgcctttgtgggcattcacagtcctaagaaatttatttgatattcttttctagatccattctttttattcttgattgtcatatctctccttagaccagattcttagatcggggggtcctagcaatggctttcttgttatgtactaaagtgctgattctgagggttcagagctagggatcttgcttatgctaacacaggactagacagtggagaatcagaggaagcagacacgtgtctaagacccaggtgtctcgaaaagctatggccaagttaaaaggctattttatttttacctgccacttatattgggtgcagagatacttaacattttgagggttgggtaccgtaatatctcagaccttatgttatctgtcatgttaataatgtctaagaaccttactgaggagttctaagagcttgaagaagctcagcaaaatataacgtaattagatacaaacttacatagaaaaataacttgaacatttccttcctcactaggaaaaacagcagctgggtgtgatggcttacacctataatcccagcactttgggaggccaaagtgggaagatcatttgaggcaaggagataaagaccagcttgagcgacatggcaagactctgtctctacaaaaataaaaaaatagctgggtgtggtggcatgcacctgttaaaccctacttgggaggctaagacaggaggatcgcttgagccccaagctcaagactgcagtgagatatgattgtgccactgcactccagcctgggtgacagagcaagaacccatcttaaaagagaaacagaatagacaaatctgcttgttattggaggaaaggagtggcttgaggagggagaggttgtaggaagtggcaacatttaaaattcagtattcacagcatcttaagcaataatttacactcaagaaaaagatttaataaagcaaaatcattcctgcttctcttaagaattgctctgaatagtacaattgccataaatcaagtgcatttagtctggagaccaactttttggttcaattactgtgttttaacccgtgatttctattgttcctaatagtatccttagtcatcagtggctaggaagagtctttctgggacacagagctctattatgcttagaaattgtaggtctttgaaattctttgtaaaatttaggatcattcctcctcttttagtcttccatttactgcttacattattgcaaatcttccacagtaaataatttccttaagaagagaaggtagaaaagtatcctaaaaccatctttatacactaaatctgtttcagagtaggcatgaagctataagaattttatacttatgaagtgaacaatttagactaaatctctatgagacagttaatatacataaaggtaaacttcagccccaattcagagatacccgctctcatgtcaccatatgcaccatgcgcaatcctgtaccattttttcatttcttcagctgcagatttattggaaagtttgggggttgttcttttctgatactaggaggctctctgaaatggtctctttttccagtgcactgctttcgtgacccagtctttgttctgtgccagttctgagatcggggcaattatttttaagtagtagattctctttgcttctatggtatgtgttgcccagtcttccatgtggcatcaactaatactatttttaagagatgcttttttatgactcaagggtactaaaagtagaaccatcttgtttaaccctgtcttaccccctagtattgcccggaagaaaggcactggtctctggaagaaagaccactttacttttttgctgcatggagttaatatagtagaaactcatcagacagtacttaatttaacatacatacatgcaaatgtaccagaacactttaaggtcaaatttggtccctgtgataacaacaacaacaaattagccccattcgagataaacttctcattcccattcttcccctactccaaaaagttatctgtactgtagaatgtttaataattattgtgggaagatagtcagatacaacagatatatttaaaaagtgaatgcccttcacccataatcccattccctgaagagaaacttgagaagatttattttcaaatatcataaaatttatatgatctattaaaacctaaagctataaaactttcagaagaaaacagatggggaaaaaaagtttacaacctgggggtaggcaaaggtttcttatctagaatacaagcatgagacattaaagaaaatattgacaaattggatcatatcaaaattaaaacatgattttcaaaagacatcattaggaaaatgaaaaggcaagccacagactgaaataaaatttataacacatatatcaaagtacttgtattcaaaataatataaagaacacagcacaagaaaataaccaacccaataaaaaatggacaaaaggtttgaactgatacttcacaaatatatatatatgtatttaaatgaccaataagcacattaaaacatgttcagtatcaaaagttatcaaggaaatgcaaattaaaatcacaatgagatattgctacattaggcatcttgggccagataatgctttgttgtgggacggggagctgtcctgtgcattgcaggatagttaggagcctccctggtctctccctgctacataccagtaacaacctgctcctcaccagttgtgaaaattgaaaatatacgcagacattatcaaatgtcccatgggagaaaaaaatcacttgttaagaacaactgcactacacccattagattgactaaaatgttttaaattgacaatgctgagcattggtgaagatgtctcttttttttttttttttttttttttttgagacagagtctccctctgtcgcccaggctggagtgcagtggcgcgatctcagctcactgcagcctccacctccctggttcaagcaattctcctgcctcagcctcctaagtagctgggattacaggcacatgccaccaagtctggctaaattttttttatatttttagtagagacggggtttcaccatgttggccagactggtctcgaactcctgacctcaggcaatctgcccacctcggccacccaaagtgctgggattacaggcgtgagccaccacccccagccaagatgtattttattgttttttagacagaatctttctctgtcactgaggctggaatgcagtgatgcaatctcagcccactgcaacctacacctcccagattcaagcgattctcgtgcctcagcctcctgagtagttgggattataggtatgtggtgccatgtccagctaattttagtatttttagtagagacagggtttcactgtgttggccaggctggtcttgacctccaggcctcaagtgatccatcctgggctcctgaagtgctgggattacaggtgtgagccaccaggcctggcagaagatgtcttatacactgatgggtgataatataaaatggtacaactactttggaaaacagtttggcagttacttaagaagttaaacctggccgggcgcagtggctcacgcctgcaatcccagcactttgggaggctgaggcgggcggatcatgaggtcaagagatcgagaccatcctggccaacatggtgaaaccccgtcgctactaaaaatacaaaaattagttgggcatggtggcgcacgcctgtagtcctagctactcgggaggctgaggcaggagaatcgcttgaaccgaaactgggaggcggagaaggttgcagtgagccgagattgcgccactgcactccagcctggcgacagagcgagactccatctcaaaaaaaaaagttaaacctacacctattatatgatttagccattccactccaagccaagggaaattaaagcatatgttcacacaaagctattcagaattcgtacagaatgtactattctgggtaggtgagaattttacccataaaatgaaaatcttaaatacaaagaactttttctttgttgactgttctttggtctttttcacacttccttctgagatcattttgcttcttcctgaactgacactccttcagttgaggatctgttggtggtagattcttagtttttgtctcttaaaatgtgtttctttcactttatgaaagatagtttcatgtgttaaatacagttcaacaatgatattttctctcaatattttgatcctctggcttccattctttaaaattaggctgtcagcttagttttccctttgtaggtaatctgacttttccctttcatggactttaagatctctttccttgaaatttttcagttttactgtaggccaaggtataatttttttaagttattctgcatgagattcattgtgcttcctgaaaaaaaaaaagagtattggtgtctttaatctgttctggataatccttaaccatcgtgtcttagaatattacctttgtcctattctttctgttttctccttccaattatatatgtattagaccttctatttcatcttaacatgtcttttattttctctctcataaatttcatttctttgctgtatgtgctatattctggactcttcagatttactttctagtttactaataattttcagctatactgagtatgctgtttattgaattttaagttttaattattataaaaactatttcattcattttcaaatctgtctagttattttttgatagtttcctgtttctcacccatactttctatttcctttaaagttttaaaaagcatattgaactggccttctgtatctagtatccaaagtctttgcagatgatttctggcagtcagactgcatctgactttgcagtcttaggtgattattgtttcctgtagtcctcactaatggcatctttttgcatagtactttttattattgtaagcttatattcattggaattgtatctccttcagagaaaatctctatttatttctaactggaacctgggggacataaccagcccactttatactaaatatttaccttgcttttaagagcaggtaggtaataagggaattcatcccccacctccttatgtgtgatccaccttgtgtttatgaatattcaggggagattttaccccttccaccaagaataaaccttaaaacaggcaaatcttctgtcttcttttgtaaatggggtgtttttccttgttcatgctttgagcgtttagccccttgggttttggctttatgatggggtctctgatctacctcccaatttcccaagtcctaggatttgccttctgttttctgtgctgctgctctaggtccctggggatccacagctgccagccttagtgctcactgtctccctagactcctcctgtcggtgggttttggtttctgaggatttctgttactttgccagttcggccattttaaacaatatttcttacacacaggtctccaatttgtgatagttccacttaacaattgtttgactttactaaggtgtgtaagcaacacacattcagtagaaaaatgctgtggaaagtagtacgatactcacaatgctgggcagtggcagcaagtgacagttctcagccacataatcacaaagacagacaaccaatactctaccatgttgccagatgattttgcccaactgtaggctaatgtcagcattctgagcacatttatggtagtctaggctagactataatgtagaagatttggtgtattaaatgcattttttacttatgatattttcaacttattgagtcataaccccattgtaagttgagaagcatctgtagaaatatttttaggtattttgtccaacatgagtaagaagcactaatatcgaggtcagtttttaacctaatctgggagagggcggtgctgtcagggctttttaaggcttataggaccattacccttatagaaaatggcttcctgctactgtgctatccaagttcttatttctgctttatagaatttttctgattcttcctttgtgattaagtgcttcactattccttttttctctgctatcagtttaatggtagtccctatgccctaataagttactatggacttagaaactagataaagaagcttgttataattttgtaccaagtaaaagtaaattgtctctaagagaggcaggtgaagggttttccactgaatacagtacatatgctatggtatgtaaattttgtgacatctattttacatcttttttttaatttgttctagattcatgagattgttttttaaaaagtcaattgagatataatgaaatgttgctatatcaatagtcaacatctattttggcaaaaattactgattttcaaatgtgtgggaaaacattttaagggtgtgtgtgtgtgatcattgaatttcattctacagaaaaaaaaatcactcattctttgagtaggcagtaacatatttagccactaagaacaatctacaatattctcttatgctttaaatatatgaaagtgactttaataatgattatttgacaatgtaagtcttcatttatgtttttatatttttccttttacataaaatgttacattttgtttatgccaaatggtaattttactcattttattttgttagatccaaacctgttgctttctctttagtattctatgtgcaaagcctgtaacataatgaaaatgcagtttaagtacctatttgtatgtgatgtgccagtagttgtaatttcaaagtaagataaacatatgtccccaaacatacttccccaaatccttgcacctgggacagaatgtactcttaacatagaccaaaagggactcataaatactctgtggttgtgccttaaaactgaacacaacataggcacatccactaacattatttataaaagtatcaaaaaaacatagtggatcatattttggaggttaacagtcactgttagcatggtaaactgtcaagtggtagaagattttccttattcagcatgataacatttacaaacttttgttcagaagatgaaatttgagaagacttttgaaggaagttatgataatgtgtccttaatgaaactctgagagaagaatgttttcaagtgtcagggagaaatgtataaagtttcaaaggggaaccataagtagataaatggaatcaagaaagttgggataggattaacatgtatgaggagggcagtaattagggagaagatatattgagagatgttatagaacatttttattttgtctcaatggggaaccagttcagatttgctggagagggatactgttctactgatttgggtggtcacagagggtggagtgagcagtcatacagagcagattgcagggaacatagtgcaggggaagacaggagaagatggtaggagttagggtcccttggcctctttctgatgggcacacaatcactggaatattaacattaacaaaactaaaacattatcaggcagcattatggtatagtagaaagaatatgcttgagttctaacctttactcaggccccttgatgtgtggccttgggttaaatacttaacctctctgagtttcccatttctaaaatgaagatagcatgtacctaaggtgttatgatagttaaatgagttaaaatacataaaatgctttagaacggccaggcatggtgtttcatgtctgtaatcccagcactttgggaggccgaggcggacagatcacgaggtcaggagatcgagaccatcctggctatggtgaaaccctgtctctacttaaaaaataaataatacaaaaaattagccgggcgtggtggtgggcacctgtaggaggctgaggcaggagaatggcatgaacccgggaggtggagcttgcaatgagccgagatcgcgccactgcactccagcctgggcaacagaatgagattccatctcaaaaaaaaaaaaaaaaaaaaaaaaaaaaagctttagaacaatgcctgatgcatacatatgttttagatattctattaatatcaaatcgaaactagtatagcattgccctgcttctggaatcatatcttagattaaaaatctgagttactagtttaaaagctgtccatcaattggcattcatttacctaactgctacaataacaattagcttttcagcattacatgcctttgtagcttaaggcattcttcattcctcagtccaggtgccccgttaggagtaaaaggacttcaaatgggtgcatctctataggaaattaaaagaagaaaggagaaaggaagaagatatggatgttgttctcaaaaaatatatactgggaaggaaaaaaaaaaatgcctggcacatagtaggtgcttaattaacactggttgactgaatgatgaataaataagactagtatatccacatatataaatttttataaatttaaccaatcctttagatatagtatatgtgtattaatgaaactttcagtaatatttggatggatactgttctgaattattagggtttaaaagtccccccaaaaacatgagattgatacagaattgatgtttcttccccaaatgatatattaaactacctttttttctgattcaacatagcttatttatctgtgacaactgaagataaaggagaaggatgaggccaggtgtggtggctcatgcctataatcccagtaggaggccaaggcgggcggatcacttgaggtcaggagttcgagaccagcctggccaacatagtgaaaccccgtctccactaaaaatacaaaaaaaaattagccaggcttggtggcaggcatccgtagtcccagctaattgcgaggctgaggcacgagaattgcttgaacccgggaggcagaggttgcagtgaactgagattgtgccattgcactccagtctgggagtgcaaaaaaaaaaagaaggatgaggcaagatatgactgataaataaaacctagagctagtctccaaacttttcccctactctagggttgtatggaaaacaatgaaatattgggggaaatacacatctatacacttattttacagcatcctacaatgttattagcaaacctcctttgttttaaagtacatggtgggctcggcaaggtggctcacacctgtaatcccaacacttttggaggctgaggcgggagttcacttgagtccatgtagcctgggcaacataacaagaccccatctgtacaaaaatgtcaaaatattaagacagtcatggtggcatgcctgtagtcctacctactcaggaggctgaggtgggagaaccacttgagcccaagagttcgaggctgctgtgagccatgatcaccccattactgcctgggtaacagagcaaaatcctatctctaaaaaagaaaataaagtgtctcctaaaatggtgggtgaaggagattattaatgataatgacaaagcaaactgttctactttaattccttttttagggaactacaaccatcaaatggtttaagtagtatttgaagagaaaagaagtgttgttcatgatgatagtcacagaaaatattggaaactgctttagaatataaatttggcaaactgaagcaaaatgaagaaaactgttaactattgtttcacagtgtttttgtgtctatattgcaggtaatgctctgtcagtttgagcaaatctgaggtctgtgctaaatataacagtgatgaaatctgtaactcttgaaaatcccttctaaatcctctgaaaaccttcttctctccaaggagaaggatatgtattgagtgatagaaataaagaggaaaaaattgtatagaattgcactgtgcaatttgttcagtttgcttgatcctgcatttgttttgaaagttgtatttgtggtatggttgtttttactagtattttatatttttggatttggcctgtagcatttcactggatatttctacctttattttctacccacagcaagaaagaatatttcccacaaaattttttttaactaaaaatacactattattttaatggtaacttgatgtatacagtatctggcataataaagatgaaacaaataatcactacaatactaaaatctaatctattttgccaagagttggtgagaagattttatcagttacttttaacctaggacaatatatcctgttttataatttgttgttttctcttgtgacaatacataaaaaaaagaaaaaaagaagaagcttaggcctcaccggtatctggagcagttgagtccttacctgtttgtctgctttgtgattggctaaaagctgttgctaagtttgtgtttttgttcttagggaaagttaaaagttgagtgtgacctatttgaactgcatcctgctgcttttgactctgctttgctctttcacctgatccacatacttttttctggcatcttttgaagtttagattttttaaaacccacttatgtataaatttagtgtgcaatatttgaagattgtgacattttaatgcgtatttatgatctacaaactaaagtactgtagtttaatttttaaaatctaattgaatacttgaaagttgaatttattgacataaagcaagttctaattgtagaaagcaaatgcattattttaaaacctgcctgttatactaaaaattatctggatatcaataatatctttgttaataagaacaaatccaaactacttaatttttttcaattgaaatgtaatatgaaaatagttattaggtcaaatttttatgatttaggataaagactattcttgctcatactggcatgtgtgtcactaaaggataagagtgactttatttatgttttcttgaagagggctgaaaggactgataatgctttaggttatagactagacccaggacaggctaaatgaaatttacattgtgaaggtgagtttggtctataattcagtagagaaacatgaactgttgtagttccaacagctttttctctttaaggctctatttggcattaatgagaataagactttgaactagattcccccagcactctgctggaaccagttgaaattattggagcattctctgaaccttaaagcctgacccaagtcttgggtgagtgatgtagagagccacagactagcttggatcctccaaacctagtgtgagttccaggatacagatcatgaggggtgtgtgtctgtgtgtgtgtttgtgtgtgtgtgtaaaaaatgttttaatttctttgtcagcttagtctttaataaaacaatattactagaattctgatgtatatagtatctaaaactgtaaaagtgttttatcaatgaattatttaagttcaaataagaaaattcattatcaaatcaattagtgaaaacagtggggctattttatattttatattttcagaaaatttgaaattaaggggttatgaatgatggttgcagtatttctatattttcttatatgcataatatcaagaaaatctgattcacacaggtaagtgcttttgtgggtttttgaaaatatctttatactttcattttttatcgtgctctacatgttcagagaaacttctctagtaatgaactatagaagtcatccctgaaattatagacttagataaatggttttgagtgaaaactttttaaatagttcaccttgcattctcaagatacgctgcagttaaactgatccagaagcttgaacaaaaaagtgaaaaaaatgatttcaaacaactacttgcattctttattataaacataaaagttaaaacaataagcaccaaaatgtacaatatccactaaaaactaaggaatcatgatgggatgtgcaatctgttccttcaacattacaaaattgacagttacaccctttcaggagcacgtaccaagcaaatgtgcctgagcctctcctggcatctttaaagcaaaatatccacttgctgtagcagttcactcactattatagttttacttcagctgatgtagacacgcattaattttttaaaagactagaacacataaactatacccctcctaatcactgacacatttatacatttacaagaatgttcaaatgtgctcacacagatggtgggagagacattatttaataactgaattattactggtaacaaattgttgttttggcagtctccattgaatttaatgttgatatacatttgtaggttactttgaaaaacaaagttcaaatctaatattttataatatctctaaagtatgtgtaaggaatggattttaagaaatataatttgaaaaccactgataatatacaaggaagtccagagcaggaaggggccaggttctagttagctgaaagcatagaactctggataaaatcaggaattatatttttgctatttcttcttcttattattgttctatagaaagagacagggttctcgccatgttgcccaggctagtctcaaactcctggcctcaaatgatcttcccacctcagcctcccaaagtgctgagattacaggcattgagccactgtgcctcgccaggaattatattaaaagattagaactttagagctgaaataaagtttgagagatcattaagttcaattgcccttcatttcaaatttaaagggattacaactagagaggttttcaggctttttattttttctttgcaaaggtagtaaactagatgaccctctatttaatgcttcctaacagaatcccaagctatctgctaatctgtatgatttatgtaagtggttaagtctaactttaaatcccaatctcgaattaagagatttctgcttgttcatatgatttaagaaatgcatatatttgggccgggcgcggtggctcacacctgcaatcccagcactttgggaggccaaggcaggcggatcacgaggtgaggagatcgagaccatcctggctaacatggtgaaaccccgtctctactaaaaatacaaaaaattagctgggtgtggtggtgggtgcctgtagtcccagctgcttgggaggctgaggcaggagaatggtgtgaacccgggcagtggagcttgcagtgagccaagattgcaccactgcgctccagcctgggcgacagagtgagactctgtctaaaagaaatgcataaatttgacatttagtaaatatttacaaataatgaatgattgaatgctaaatggttacatagtatcaagttttctgttaattggtaaaataatagcattattttaaggctcaatgccaaatagagccttaaagagaaaaagctgtgggaactacaacagttcatgtttgtctattgaattatagacgaaattcaccttcacaatataactttcatttagcctgtcctgggtctggtctataactgaaagcatataaaatataaaatatataaaataatagcattattttaccaatgtaaacttatacgaacatatattttaaaaattagactcataacaaattaagagtgttaccctctccaatttatatcatctgaataaaatactattttagtatttctgagttatttgccagaaaataaaaatgcaaaaattaagaaaatcatattctctattactacaagcaaaatgatcttgaattccattcaaatctgaattcctgtaaaaagcatacatttttaagtggtattatatcttttattgtttgagagtatgttttggcaaaacagaaagctagaatggataagcaaatataaacatttttatttgatgaactatagtcccctaaatgtatctataccctttgggtaaaggggaaaatggcccacagagtgagaatttgggagggcagaagaacagacaggaaagttcagtgaacagcattttatttttaaaatacataataacctacaagtagtctccagatttggccttgtacttgtgctcaggttaagaatctacaacttaataccctcttggaaagcaagagacctctgaagaaggcagaaaaagaaggtggtttaaaggattataggacctacaactaaagattatcaaaaaggaactgagtaggggttctttgaactgtgcaagaaaagcacatattgcagaattctattcaccacttggtagtaataatcatagggtggggaggcatggatagggaaggcaggatagctgttataaacaaaaacaactggattttaaaactttagaatattgtcattggtttgtttctttgaataaaaattaccgttagtataaacaaagcatttaaaattctgtcatgattaagctaatgactcattaatatgcatttagcccaaacattttaaccacgggtaaaaatcctatggttaaatgggattagttcagttccattaagtctgtgggttcaggataagttaaagatattaggtttggttttaatctattttgaatggataatttttaatattatgcctggctaattcctcgtatttaaaattataggttacatactaaaccagttcttggcctgtgcacaaatagaagcactatgagaatttcatgtgttcacattgtttaggtacaaatgaaatctagcccctcaaaaaactgttagaaaaattatacaacacagagtatattcagtctgagaaatattttctacttgcatatatttagtatcttttgttgccttttttgagtttgtatatttccttctccttctttaaaaccttcagtagcgcctagcaacatatggcttaaagtcctaaccgtccatttccccctcacattcacctttttcatagacctcatagtattccaaattaaacccattccttcttatttaactcagtgatgatgctgaaaagtagcctctaaacattgtaatatgtctgaatgaattctcccacttaatttttatatctcaacagacactttcttttctatcacttcaccttggatagacctaaggattatttaaagccaaacttggttacaaagtgtttctgaatcttgtcaaacaatggtatcttgtcagacacaggcagtgtctgacttgtaagtacatgcctgacttaacaagtgatccatacatgctcttgtcagaccctgtatagctgctagcctggtagtgcaggagagcagtcacagaaatatcaaagaaaaaatcaaaggagcttgggtatctatgagttccaaggagaagtggagagattctgaaagacagattgcttagcagagctgaacccagtagaagctaattccctcacagagtcagcctgcctgcctataaacaggcaggttttgtggcccctaagcctcaaaaatgtttacctgaatagtgaacttgaaattcattattaggctttcagttaagcttaaacaattttttaatggaaacatctcttcagagttcattcgatacataatttttgagggtctcctgtgtgcagggcactaggacattggaaatatagcagtaaaccaaaaatacagacattctgattttatgaagcttatatcctattgagacaaactaaataaataaataggaggtatcagtaacttacaaaattagtgtgatttgtttgagaagccagctttcttcctaaaacgtaccactttttgagaaacgggggtcatgtgaggaacatgtaggaggttgggtagattcagatgagatatgtagtgaacaggctttgggtggcatgaggccaccaaaggcccagaaagagacactgagaggagtgacagaaatatggaggagagaagctctcaaagcccaagatcacccattccatgatttcttaaaaacaaaacaaaacaaaacaaacaaacaaaaaaactcaccctgagtaaaagcaagggagataaatttttctgtctttctaccctcttttcttgcctccagaatcaagaacttaggtgaatacacagttatcaaaattgtaaatatatattcggtaaatgcagcaacctcatatagtgactgctgctttggattctgacagacctgagttctaattccaggctgaattttacaagttttataactttggtcaagttgcccatacttttagtttctatgtcacaaatttgtaaaataaaaataattacatctgctttatacatgtaaagtgttgtgtctgatacacaggagttaacaaattactggtcttattattatcagcctagaaaacctgaccgttatttaacacattgattttggggtaaaagcaacttttaaatttaaaaccactgacacttcttggaatactacttatttacaaatattggtgatgcctcatatttctaaacagctatgtagaaagttaaaacactacatttctaaaagaggaaactctaaatgagaggaaaataccaaagacttgtcaacattcttgctcctttaaagtgatataattctaaaaattgaagaactgaaaaaaaaaaaaagtatagagcaaataagaggatcagtttaaagttcagtgctaaaaggatcttaatgtacccaaaacatgatgttgaaaagggaaaaagtgcttagcagacaagctatgtagataaaaacaggaagatatgagctggaggagaaaaatctagacaaaattagtaagcagaagtagtcttataaaccagcatttgttctaaatgaaacgttttaaatgacaataggggatttttcaagaatgcttaaaccacataaatgtaacaaatcccactcccactcttaaaggagttctttggtttaatggctaaaaccattactgtatgttttctaaccaattactgcattaagtataattctgattccaatgaggagatgtgcaaatctatagtacagggtttaacatgtggtccataaaagtatgattatgccttttaacctaattactgctttttctactaaaatatatctattccttgtcatgaattgattatactttttaaagacctaatgcgctcagggaagccacttggtcaggagagcagataatctgagatttatctcctaaatttcaaaaacaagagtttgaggcatgattgcctccctcaaggaacttaactaccatactggagagacagaatccactgtcatcttctacacttctctcccttcccattgttccgaagactgccctcttgccttgccaagattgcctcagcagcctaactcatctccttgcccctagttttgccccttgcaatatatttttccaaaccttagctgacatgcaaatctgatgtcactctacagtttacaactttcagtaactccacagtacccttaagaatgaaatccgtattctttaatgaagcttaacactccctcattactgcttatctttttttttttttccctgttgccaggctagagtgcaatggtgcgatcttggctcatcgcaacctctgcctcccgggttcaagcaattctcctgccccagcctccagagtagctgggactacaggcgcacaccaccacgcccagctaatttttttgtattttcagtagagacggggtttcaccatgttggccaggatggtttcgagctcctgaccttgtgatccgccctgcctcggcctcccaaagtgctggaattacaggcgtaagccaccacgcccggcctactgcttatcttttacctaaactccttccgttactctccttaccctcttttccagacccattgagcttcctgtattctgcttccctaatggatcactctttcctttttctgggcctctgcatatgctagatcttttacttagaactctgtgtctattctcccaaactctcccccaaattttctttccaaggcctctctactaatactctaagctgtagctcaggtgtctttttccttcaggaagcctatcttgaaccaccattccaagtgcagagtcccctaatatttcatagttctctgttaaaatcaagtcatttgacaccactctgcttttacatagattatcagcttgctcttcagaaaaataaggctgagtgcattactgctaaggacagatgtagaggcaatgaacctcactttgatacagttgagtaagttgaccaaaatctttttaaaagaaaggaaatatttcagaattactattacttcttggattaaatgtcaggattcttcctgagccaagttcgtaccactgcactccagcctgggcgacagagcgagactccgtctcaaaaaaaaaaaaaaaagaaatatcaaaattaaatgtttaaatagcagactttgtaaggtagctctggcctgtactgacaacctgtggtaaatatcaaaaacacagccctttgtaatcactgttctgtgttcaggatgttcatcttttcagcagatgtttatcgcatgcctgtatgtgctcagccctagaggttgagaggagcagcaccttcagaacatcaggcctaccttcgaaatccttggaaaatactttttattgaattgtttgaaacaaaacatttcaaaagttaaatctgcacaatgatagatgcaggttaattaatacatttattgggctgggtgtggtggctcacacctgtaatcccagcactttgggaggcaaaggcgggaaaattgcttgagtccaggaatttgagaccagcctagacaacataatgagaccctatctctacaaaaaatttaaaaagtagccgggtgtggtggcctctgcctgtagtgccagctactcaggaggctgaggtgggaggatcacttgagccctggaggtcaaggctgcagtgaactgtgataatgccactgcactcatcctggctgacagagcgagactctgtctcaaaaaaaaaaaaaaagaaaaaaaattttaaaaatacatttgttggaactcttggttactgtaaatttatttggaggcaacctttttatgttggagaatagagtgactaattcactctagtgctctatagcagagaacaagaaattagtactctttgaggaatttaggtcagtctttatagagaccataaaggaatcttgacatttaatggcttgaaggttctccataaaccactaaattagaatattaaattaaaattatttttcttttcacataaggcagcattaaataataatttgaaactatctgggggaaaaaggaatcctaattggagcttcctatacaatttcagtatatctgaaatatttcttcaataaatatttatcaagcactaagtatcagcctactatatgcatgcagttagcagttttcacttgcatttacttattttaagccacttttgatttaactgaatgcatgcttttcccttgcctctcattagaaaatggaaagataagcattcttcattttacaaatgtcataactaagattatgccctactagacaactaaaactgtgattccttcagaaataaaatcatacctcaactcttctagaaccagagtcatcatttttcacatacttctacctaactagcttttgcagctcacaatcccatacatcaagtgcatttatgtgtccaactcattcatttacaaccagtttatcttgcagggtatgtcatattgctgcaaattgcatgatgtactgggtttgttttgtttttgtatttgcttacggctgagtgggcatttgattgtactgtttgtttttgtggctgtgctcagtggatgagagcttggaagcctctgtagccttttcttctatatcgacattaactcaatattgcttcttttgaccagtaaaaaatattttgggtgcattagctattttttaaaagcagtatagagaacatatatcatttatcttatttattaggagataaataaaaagtaaccattttgacatgccactttaaacatgatagttgaagagctaaaagagtaacttagttttcactgagacacggtagcgtcacttctaagactgaaacttattttcatttatgagtcctgttctgtggccataactactgctataaattccacttgtttccttgtcagaatgttccaactttttttgttttttaacctgagcacttaagctttgaaaacagcataaacatgcaaaaagagatctaatttaggaatttgtttcttttaaagagagagaatagagttatgtaaagaaatagtactgacacaggactggagggatctgggttctgggcccaacaatgtcagttgtttttctcctttgtaacctgtattttcccaagttcctcatccgatttcagagattgaaattctgtctttataacccagggagggcgcttatgaaggaatattagaaattgtaaagccttcgaatatacttgagaggaaaaaagacgattcagagataggctaccaaggtttattatctgtgtaggggagtgatatttatagcttttacgtagcttagcaaaatgaattttgcattgattataggccaaagtcctgcattctgctgccgattcagcgtcgtttgggcattatgggaaaggaagaagggaaatttcaatagtttatcgaatttagagaacttcattactcctggtgctgtcagaatcagtctcgaggttggctgctgtttggttctaggtaaatggccgagcaggggtgtagggggcagattcccctgtccctgaagcccgaagactcgtgctgcaccttcctgacagtgcacgctcacctcgcggccctccagagcccattccgtacctgagaattagctgttcgtggggaacctgggcccccaaggtgatttttcacctcgccgcgtcagaccgccagttcccagcctccgcgccggaggggcggtgctttgcggggacgcgagcccgcattggcttgcgtggccgccagggcggtgaaatgacgggcgcggggcggggccgcgcggcttgtttgtcggcgccgccccgcccccccgccgtccgtgctgactgaggcgctgcagccaggagccgcggccggctgcccagcgctcgccgcctccgcgcgtccgcagccgtccccgcgccgacatgcgcttggccgccgccgcgaacgaggcgtacacggcccctttggcggtctcggggctgctgggctgcaagcagtgcggcgggggccgcgaccaggacgaggtacctgggcgaggggctgagcgggccgctgggtacctgggcgggtgggcacccggccgagctgccctgtgcaacacggaggtcacgttgcctcctcacagtcgctcccggtcagcatccgaaaacgctccccagatagggcgggctcccggggagcagcgtcccggccctcctgcgcccctcgggggaaggggttgcctgcggtgggtgggagacctgcgcaccgtgagtcgtccctgggcagaaaatgctaagctgggagagactgcggccgcggtcatgtaaatgaaagtctccaatacgtaaataacattgtcgtctggacaagtctccacaagtcagaaatccagcagacctcgagtcttgagggtgaaacagcctgtggatatgccccctcgattgtcttgtcttgtgaaaacagattatttagccaccttcatcccctttgcctcctacttaaaagagagagaaagaaaaaaaacacatttgactcagggaagagatgatgttgcctggaataagtgtgtcctgcaagctctatgacgttatgcacagcgtttactcttgcgtattaagccatcccttttctgaattgtcctttagaaagaggtacttaattgtaacattttgtgtttttttctaagtggttgcaaataggaaaccatttgaaagttactaatgtaaccttaggtaaaactcgaaccttaaatttggattgaaatcaggtgctgtcagagtgttgccttagttcaagaaatctaaatgtgaattattttttctgcagctttactcactaaaatgacgtggtttcgtgatttctttaatggagtctattatcagtatactatgtatattcatagaaacttaaatgaagacactttgtcatgaaggttgtaaagcaccaaatatttttttgagattttaacatttatggacatattagatgttccttgtttacagataataaaacaatctttaaaaatctcttacagtatcgctttggaaactttaccaaaaagtgaaaacagtatgaaagtattgaattaacatttacagtttctgtttgcgggtcataatagatcttttctctttttgagtagaagtgagccccaatcatcatgcttgaatagatctgttatttctgctgatgtttgtgtgcagagtcctggttcttgctcagatctagaatttctaaagatagctttgtaaactaaaagataaagaaatagattttggcttgcatattgttacagcgcttatgggattgtgttgaggaaaccgggaagctttgtatagttgtatttcatttttaatacatcccaacatgtgagaagataacttaggaaggaatgctttataggaaaactattcactttacaaaaagaataacacaattctttcaaatagctagcttccataatgcttttaaattaaacactttcaagaaacggaactcctgagcaaagtatagggcacaaatatggcctaagtattacaaatgcagtaacttaaagtcagtaagttttttttctaaaatatagttcatagaaggcaaaaaaaaaaaaaaaaaaaagtacctggactttcagtatttctgaattacctattagtattaatgacaatattaacataattgttagtacattttgctatagtaggcatatttctaacacttctagatctctccatttctatttaaattttttgaatgtcgaaaggccagcacccagctataggcaatctcccagagaagggcgagtgggatgggaactttcactttttatataacatatctttaccttgttgaaatgtttttcaaaaaacacatgctgcttttgaatttaaaaaataaaattactgtgaatgttgtgataatcacaacagtaatagtgtagcgaggaaaacaaaatgattcaaattatttgtgtatttttacttctcaactaattttgcaggtgggtagatactgtaagccaacaatgctttcattttgcacttgtcattcattcattatttcacttaaggatattgatacagatgcataaatgtatctcacaaatttgaaacatctgactggaacagtacttttcagtacacaaacattgattcatacagtgatacaataaaaacatagtctttctgtggtactactgtcaacattcactacgaattttcactctgaaaattagtgttttgcattatacattgaggaaacatcagaagtaatattgtgatggtggaaacttgttgtctctttcaaagatggttattaggttgttgaggggaaaagattgttctcatgttaatcttccagccacaccttcacagagagcctgtgaggttagtgctgtgattagtatctacatctgcttttcaacaaggccatttgttggtggcagttctgtctcctagaatctggattggccaaaatttgttcaaagtctgtagttaagtttcttacagctacagatgaaggaataattgaattaacctaaataggaagctatgaaatgtatttagtttggcttatgatcaccccattgaacacccgcagtgccttttttgatcagcatctactagaaaagagttgtaaccaatttaacatgtgaccaagaagtgtttcaaaagtgagttttccagaaaatggaaactttttataaaccaagactactactgtataataacagtggtatctgtaagaatctccaaggtatcaagaagtcttaaagaggctcaaaagaataataatgaaagataccaactctagaaccagatgtcattgattcagcccccgtctccaccactcactagtactgactgagctagaatacttgggttcaaatctcagggctttccttggacacagggtggggaacatcacacaccggggcctgtcgtggggtagggggtggggggagggatagcattaggagatatacctaatgtaaatgacaagttaatgggtgcagcaaaccaacatggcacatgcatacatatgtaacaaacctgcacattgtgcacatgtaccctagaacttaaagtataattttaaaaattaaaaaaatctcagggctttcatcagttatgctaaatggagataataatagtacctgcttcatagattaaggtaaggattaatctaagactcttgactttttcatgaatattgtagaacaccaaatactctttctaaactttagtatcatagactcatgttctttgtttacaggtagtataatttaaaacagtgctcagctcatactttgtgttagctgctgctgctgctattgctatttattatcatgagccctagttgctttttcagtgttattcaagaaataagccgaaaactgaaaggcaatttggttctcagatatcattgactagtgttagggtgccagccacagtctagaaaccccactttaccctctcttcctctgctacttctgagaaattagacagccaaatctgttagaccttatacctaagactagaatctataacaaaagactcacgtttgtataatttgtaaaattctatagtttataatatagattataatcccacatagttgggattgatggtattattattttgtcatcatccctattttacagattaggactcttcaatttggaggctaaggaagaggggagacagtgttattaatatgcccactaaatttggcaatagggatggacttacaaagacaagaattacatagaacccttgccataaatataggaaatactctgtttctcaagcattcatagccaccttcttggaattgtaaacctattgttttataataatttggcatataaactatatatttggtagagaaataaaaccagaataatataatttgtatacctctttgtttctaaacctatgtgctgtcaatctggccacatttttaaaaaggtaactacctttcatgatgctaatgtatttgtaagataaaggcctagaaattgaatcagtgaggttttttttcctgcctactgataacataatatatacatattctgcactttgcttctcctccccttccccattattgtaatataacttgaagagcttttaaagtcaactcatgtagaagtgcttcattttttctaaagactgcatgctactctattatatggtcatgctgaactttattgaaacagccttctattgaacactgagattgttttcaacctcgtactattagaaacaatgttgcagtggttatccttttacgtatggcatttcacaaatgtgagcacatctgtaggttaacacttaggatggaattgttgattcaaaggctatgggactttttaattttgatcactattacaaattgcccttcctagcggttgtagtaatatattctctatactcttttttctcatacttcaaaacactctcatcagcaatatataaacaattaatgacagtttctctaccctttctccaatacagcctgtgatcaaactttttgatcttaagcaatctttttggaggaagacagtatctcagcatagttaacttgcagttgttttgagtgtcaagcatttttcaaccatttgtattttcttttccttgaactgtgttgtttgctcatttttaaaatacgattgttggtcaggtgcggtggctcacacctgtaatcctagcatttgggaggccgaggtgggcgcatcacgaggtcaggagattgagaccatcctggctaacatggtgaaaccctgtctctactaaaaatacaaaaaattagccaggtgtggcggcacacgcctgtggtcctagctactcgggagacaggagaatcacttgaacccaggaggcagaggctgcagtgagccgagatcatgccactgtactccagcctgggtgacacagcgagactctgtctccaaaaaaaaaaaaaaagattgttggggattttcgtattgatttatagtaatctttctttaaaatttagccctttgttatttgagtggcaaatataattcctagctttctgtttacttttgactttgtatatatttatttttcccatgtgaaagtctttatttttatgtcattaaatttatcaatcttatattttatgacttttggcttttgtggtattcttaggcctgctgcactccatgagtgttttcttctagtactataatgttttttgctttttttctaagttttcatttttttcttacatttaactctgatttattgtggggtaaagcatgttatagtgttccagcttcactttttttctgaatggctatccagttgtcccaagatcatttgttgaataattcattttcccccatttgaaatgacaccttttcgtatactaaagtcccaagtctcttagttataaaacagtaataaacccttgaaacaggcattttcctaaaatacattttgtttaagtaagacagttttcaagattaaagaaattagaggggataaatgttaattttagccttagttttgtccaataggtattgtttcaaatgtatgtaattggatgagaaattcagcagttagaaaagctaagagtcatcattgtatataaatggctgctattggtgccaaaattatatattgaataacagggatgtcctctggcattcattacaggatgttaaaattgagacacacacgtggccagaccagtgaattaagtgcctcctctaatgaagggtataatgttaaagcattactatcttcagtgtaaggatggactaaccagggagaagtcaccaacctccagtataagattattttatttaaatattattttatgaattctgttggcaaatataaactactttgaatcttgatgtctcctaataaagattaccttcacttttgtccttcctgcttaatttttaaaagcctgttctgctttaaagactttcatttgctgggaccagatttcttggattgctgacacatgtccttctctctgtgcacccacccccaccccatccccactttttttctttaaaaggaaaatatctggtttatatcatgaagaactttaaaagcagtaaggagagagtagaattatatgagtatttaattatatatataatatatatgagtgaaggggttaatctttaattgtataaattctaaaaaaaatttttaaatgacactagataggacataggcctcaaaacaacaaaaagttgaaatatattattttagttttgtttctgtaaacacactatatggggagggtgagggagggaaaggaaaccctaacagattttcagttcttgttaaccatactacaccatcacataaggtacaggattctagagtcactgtgtcaaatgtcagaaaactatttctcaattatttgagcttctctaaaatataatatgggcaagattgatgacatcctgtaaataaaaaaaaacttaatttaaggcaaacttacaaacaaaatgagtttctctaaaattatttaactgcagagaaaacatgccctgtagtgctgtctcttgtgaatttagtttttatttttcataaatttacattctaaccgtgaggtgttgttttagatgtaataataattacactttttctagtttaagacacctaggtggaagtactgctttttcattttctgacgatgcacagggattgatatttgggttggttgagttttagatgtacaaacacactggtcttattttgtatcactgatgatccacagggttggctgctatgtgctgaactttctgttctagactttctgccaagtactttatgcaaaactctggttttagtgaaacaggttttattgtttttaatcagagttgtattataagctgttgttagctatgtaatgctaacagaagagttggtatgtatatacagccatgaaaacaaaccatcaaaacaagcctgtctctgttcgactggttgtttttccctcccattcctttagcctcagttcattttgtttactgccaaaggcctgagatggtgtaattttcttttctaggaacttggcattagaattcctcgaccactaggacagggaccaagcagattcatcccagaaaaggaggtacgttgtttgtgaaagtacatagtgaactgtatgcttttaaggaagagctttcatgacccacatgttggcatctgaagaactgttggtcaacaacatgttttagtcagagttggttgcagttaatcattctttggcagtgaatctgtgggaataaaaagctgttgtacttgtgttgatttctagtatttcatgatgtgtttttaacacccatatttaatcaagtaaagccaagatttgtttttgaccagtgatacaacatctgcttatatttagatgttgtttaggtgtgcccataacctgagttacttagtcttgactgtctccacaggctgatatcagtgctagattggatctttaattctatatatgtataaaagcatctatgctttattttcataagaagtgtatgctattagttaattttagttctccttaaattgagtgagagtaggcggttttgtaaagaaaggctttagtgtctgtttgcaagctctgcaaatttgataatctaaatctgcttctttatctggattctggccaactctgcaagcagcctatctagatggcctttaatgttcagcctttgttgtttatcccctactatataatatgtaactgtttattcttctgtatctttcaaccagttgagtttaaatttgtaacccctctttcttaagccagatttaatctgcttctaaatgatacttagagtgtagcgcatgtatattttcttcccttaacaccaatttaccatttcagtaaccatggtttttctcatttatacagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggtttgtaaacattcagtgaaaaattgtttttgcctatttttattaatctctttaagagacagttaatgctttaaacacagggataaatacttagattatgatatataatatgattcctgttgcacagtctctgtttttcctatttttaaataagtacgctctcaagtataacagaaaaagaagcaagtatttatacattgctgagaaccattcttcattaaataagtagaacacaagttctgtttcattattataaatagttcacattgacataagtggtgcttcctgttcaagatgtaaataatattccattattttatgattggcaccttaattgaagtttcttcttaatctgaagttctgaaagtatatagataaaatgtctaaagttcaaatacttttatcagatattttgtttgttcttggaatatttctaaggttcttacagtatttgaatttttaaaatgtttatataaaaactgcatttctgtagtttacggaaaatttgaaaacatactaataaacttaattagctcttttgcatgttgtaaataaaaaggatatgtagttcaaggttttaatatttataattagaataatctttttgttttaaggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgaggtaagcagtggggtaatatatcttgggagtcatttcagacttttttagagcagttttaggattacagaaaaatcgcacagaaagtacagagagttcctattttctaccccctgaatctcttcccacagatgcacattttcttctgttacagcatttctgtggtacatttgctgtaattgatatattactagtaactctatagttcacattagggttcagtctttgcattgtatcgttctacacattttgacaaatgcctaatgtcacgcatccattacaatatcatatggaatagttagtaccctaaaaatgccctgggttccacctgttcatccctttccccccctttccccttcccctaaacccctgcaaccactcatctttttattgtttctatatagttttgccttttccagaatgtcatacagctggaatcatacaaaagtatgtagcttttcagactggcttctttcatctagcaacatccatttaaggcttcttcatgctttttcacgacttgatagttcatttctttttatcactgaataattctctattgtatagttatgccatagtttgtttatccattcacctattgaaggacatcttggttactgccagtttggggcaattacggataaagctgctgtaaacattcatgtataggtttttgtttcttgttttttgtcgacaaaagttttcacctcatttggataaataattaggtgtgcgatttgtggataatacggtaagcctacgtttacctttgtaagaaactgtaaaactcttccaaagggcagtatcagtttgcattcccaccagcaatgaagcagcattcctgttgtcccacatcttggccagcattggtgtcagtgttttggatttcagccattctgataagtgtgaagtggcatctcattgttatgcatctttatgttacgttttaaatgccatgttaagctagttctggttctatttattaatagagataatagagtaaaagtagattgatgttctctaaaattgtctaccatgcactataaattcttagagatgcatcttttggtcttatctatttcatagaatagatactattagataattaaagatattatcaagaagatacaagatttgaatatattaatacaatgcctattatatattgtcaagtaaggaaaaattatacaagattacaaaatagataatgaagcagaagtgacacagaattgaatagaagaattatagaagttatatataactttttgatgatttaggaatatttaatcaagttgttcaagccactatcttaaaaattccttgaggaggccttataataaacaaagcacaggcgtttcacacagcagcttctacttttaaacacaaatttattacatttgctttgagattttgaactaacaacacagtaattcattcataatccagcatctgaaatacagcagccacttttaagcaaaatgcattctcttacattttaagtcaatatttcagaaaatcaaaataatagtgaatgtcttaacagattatgttaagttctatttgtgaatgcatattcataaaaattagcaaattctgggttctacatgtttcaaatgataattttatgctaggctttgtatgatgactcatgttttcaataaattaaatactaaaatgaactgtatacttttaccacaccccagtacaaaaatatattctttttttttttccccctaagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtattatttgtcatgagattgtcataaaactaatcacaataattgctgttatattatttcttcagttggcttcttagaaaaacccaccctgttaagactgtggagatattgggcccctatatctattcattcagtagggttttattgactgcctcacatgctcatcactagtctaggtgatatacaacattttacaaaagtgatgtacaaaactctaagaccctgtaggagtttacatttagataattttaggatcaggagccaacagcatgtgtcccgtcaggaccaaataatattgattggctactgcagtgacatgagggaaggctgaaaatagtgtggcctggtggtggagactttttgtgccaatcacattcttctcttttgcacaaaataaacagtctggcttcttaattttttatatttcagaagatttaatcaactttgatctagaaatttctctcttcagaattctttttcatgtttaactttgcaccaatatagaaggtgatatcaggtgaatgtaaatgtgttaaaatgctttcacctctattccttctgttcctggcttttatatattcttagttttgttactcctttgaaacagagcaagttcagttttctataagcaaattttaattcctgtatatgatgaatcaaaatctccttctgcattcttttgttgtagtgaaaaagcaagggtttattttatgcttcaaaaataaattttagaagcagtaccacagccatctgaatgctttacatgcattttctgagttatattatccctttgaaatagatttgacaggttgaattgcctttaatttatatatttgacttcgggcaagttactgaatctcagttcttttgtatctaaataaaagtaaaacacaaagttattgtgaggtttaaatgaaatgtctctaaagaagtaaaatgccaagtacagcacttagcatttgtcaggtgctaaataagaggtagcatttacatatggtgaaattagcacaagaaagaataattttcccaaggttgatcataggactgccaaagaccatcagtttcaccctcctttgagctgcctagattcatgttataggcctgcatatggccactgattatttttcaaagcttggcagtcagaagaggatccaagagagtattcagttgctagaatgctaggagatggattcttctccttgctaccaataatttagtacaaggctaaagaaaaaagtacttgattgtttctagttctccttctattaaaagaatgaatagtgaaagaagataatttttatttctctaataagcttcctattcccaggtaagttggatacttttagaaggtttatggcctaccctgatgacactttgacagtgagctgatatggcttgttctttaggtacatatccagtatctgactcagctcttcagatacaaatggtaacaaacaagaattttccctccctcccaaccctggaaactacttattcatttctttactctctccatagttgtcttttccagaatgttatatagttggaatcatacagtacgtagccttttcagattggcttctttcacttagtaatatacatttaaatttcttccatgtctgttcatggcttgatacctaatttctttttagcactgaataatttttcattttctggatgtagcaacatttctttattccagtagctactgaagaacacattggttgcttctaagtgttggtgtattattctgttctcatgctgctaataaagacatacccaagactgggtaatttataaagggaaagaaaaaagagttttcttacacaattttaacattttaatattaaaatgaaatgccattttttttttaatcccaactttagcagatcagtgaaggaacaaagaaacctactttgtttcctttccctcttatttcaatataatttatcaagaattacctttcctaagaatacttaaaatttgggctctttaagaggagaataggtaaacaaaataaattagtgacagataatgtgagttgacagagatcttttttaaactttgagtcatcctgtcatgaaacctaatccttttcagctattttttatttggttactgactctatgtcaggaataactggggaaaatgcatgcatgcaccacaagaatcttcagtatcgtcatagaaacacttcccatcatgaaagtcttagagaaagggcttaatactgggcatttcagtataactgtttggatcaaaagaaaatgtaaagcacaagtgatatagattgtctcttaatatagaattatcctgagagtcattctccagcaagtatttcttgaatatctactatgtaccaggtactatgctaggcttgggatatatacaagtaaaccaaacagatttcctacctttatgaaggtttggtctgggaagggagcctgcattaaatcaatatcatgcgagtaacaattataaattatgattggtcctctgaaggaaagaggagagggttgtgttagaataattggagcttgtggggtaaatgacagtgtttacaaggatgtaagctgctacctgaaggatcaatgggtggaagccaggaagaatggaagatagaggtcttaaaagcattcctggcaaaataaatttataaggggggaaacattaattttgtatgtatacattgagatttgagattaagacttttttttctctttttgagacaaagtctctctctgttgtccaggctggaatacagtggcacaatcacagctcactgcagccttgaactcctcctgggctcaagtgattctcctgccttggtctcccaaaatgctgggattacaggcatgagccactagcccaacccagacttcttaatatattcattttataagaaaggtataaattgcatagatttgatctagcttttgtagcaagaatgcagcagggtatagaagtataaccagtttgactagtgcaaaaccacttggccagtcctttgtcagccccattactctatgtgtgacactgctctagtcatcccagcaagtgacagctgccagatccatttgcagaggtcaggtggccaactccagccatgtagacatctttcatgtttaattggtaaattgtagaaataaagctaattattaaagatgatagacacattgacaatatgtatgcccagtgtacacagttgatgcaaaatcacttatactttgtgtatcttatttatttaaagattaagcaagtagaagttatcttacgcagttctgctttaaattgacaagtagtttaaaacagcataaatggtaatgacattattgctaattttataaggtaaaagcattagaatgtgttcttaaaatcatttttttccttatattttaaaatctgcatgtctgtattcctaataggccaaagtagttttttattcattcatgtacattaaaattataggaatattttccctatattctactaagatataaattctggccaggtgcagtggctcacgcctgtaatcccagcactttggaaggccgaggtggacagatcacaaggtcaggagatcgagaccattcctggctaacacggtgaaaccccgtctctactaaaaaacacaaaaaattagccgggcatggtggcaggcacctgtagtcccagctactcgggaggccgaggcaggagaatggcgtgaacctgggaggtggaccttgcagtgagccgagatcgcgccactgcactgcagcctgggcaacagagcaagactctgtctcaaaaaaaaaaaaaaaaaaaaaagatataaattcttatgagacagacttaaaagataattcatatatattctatgtctgccacatgtaacattaattgtattttttcttcaggtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcaggtaagaacaaccattatatagtcaatataattattgcaaactcaactttttatttagagaatttaaataacttttaaagcatcaatctaaatatgtccttccttttagagagactattgcataggtattcctatttacaaataatttttaaagcaagcaactaagaaaaggtcataagtgaaaacatcctagactaagggggaggacatttaatttggattctggcactaaaattacttctaataagctttgtgaacttggcttagtcacttaacatatgagtgccctcttttttctctttttttttttttttttttttttaagaaacagggtcttgctttgttgccaggctgaagtgcagtggcgtgattgtagctcactgtaacctgagactcttaggctcaagcgatcatcctgcctcagcttcctgagtagctaggactacagacacatgccaccatgcctgcttaattttttaattttttttgtagagatggggtcttgctatattgcccacgcttctcttccttaatatgaggaaatagtcccaagattgcttctagagttaaaattctgtgatttttttgggcacggcagtttgtacctgtagtaccggctactcaagaagctgaggtggaaggatcaccttgaagccaggcattccagactagttggggcaacatagcaagactcctgtctctaaaaaaacaacaacaaaaattatatgatttgtgaaaaggagatatttattaaattaccaacaacctaaatcctctatgtttaacctttatctatatgcaggctacaggagataatatataaaccaggtaatttaaaggagaaaaagtttataaagtgtctccagatgtattttgacaatataatagagtgggagaaagagcaccgagtttcttaatagcaaagaaacaatcaaatttgtttaaatggaggttggatgttcacttttttttcttccaggaaaaatttttgtttccatgcctaaagatgtagagttgtcatctaatgatacacttacatgaaactataatctcatcaactcctaaacatgatgatagtccagaaagtcttagtcacagtgcaggcagcactgtaaaaatgttaacccatgggatttctttctttgatcatgttacatattatatgtcattaatattcaacaaaaataatctaagtgctaaattttggagcatagctgatttttgtagttatcttaaaaattatccaaaagtatgttcatactttgaataagtcgaacctaatacatataaattggaatgggaggagagagaaaggatctatgaaagaggcaataaaaggcatagagaattcaactatgagttttcattttataacagaaaatctccttttactacattctgtttactagcaagtaaactactttgtataattgtaagactactttggttgatattggtcactcagtatcagagaaagagttatgccatttttactcctttgggtaaaatcaattttaactagcatcctatttttaaaaacctttcaatggccttttttcccagatgatgaagaagttacaccagcaagagctgtatctcgtcattttgaggatactagttatggctataaagatttctctagacatgggatgcatgttccaacatttcgtgtccaggtaaaattgcaacttgtatgcacatgattgactagaaatatctcagtctgacttaaaatacaaaacagccacttagatttgagaactatgctaagtgctttgcaggcagtatctcgtcttgtttcagaataaaaggtgaaagactgtttctaattcatccatggaatcatactgtagtttcaatgtatgtatatcttaaaaattttattgtgtaaatatttaaatatgtaagtatttaattcagatgagttgatactcccagcgttcccaaatattgttaggggccagtgttaaataataactattttaccagaattatgaaaatatttgagaaccataagattttgtttctttgctcaaaaaactaaggggcctggcacaatggctcccgcctgtgatcccagcaccttgggaggctgaggcaggtggattgcctgagccgaggcattccacgaccagcctggccaacaaggggaaaccctgtctccacaaaaaaaataaaaataaaaaataaaataaaattagccaggtgtggtggcatgtacctgtggtcccatctactcaggaggctgaggtgggaagatcacttgagcctggaaggttgaggctgcggtgagttgtgatggagccactgcactccagcctgggtgacagagtgggatcctgtctcaaaaaataataaataagctaaggggcaaaatttaggcacaaggaagagttatagaataattatgcaatagattagaaattgaagacatcatgtgggctggaaattttttatggagggacattaggatttgaagaatttggatggtgaaaagggtattgtaagtagaggagactagacaataattaagcttaggttgagggatagagtgaaggaaggaattataaagagattggttggctgctgagagcttcaagctaaagattcctacttctgattagtggtgtatgtttaaaattggttaggtgtgccttaaatgtcaaagtagtttacattagattatgtggggtttgtaggctttgaccagcgtgatggcatactatcaaagaggtgtttttaggaaagcaacaaagaagtaggggcttattaagttttgtttcaggtggaaagaaaggaggcaaggagatttaatataggaaaactaattaggagactcagttaatagggctaaaaggcagaagtgcaggtaggagaaggaatgggtgatagatgtgtttaattaaaaattcacaaaatttggccagatctggtggctcccacgtgtaatcccagcactttgagagaccaagatgggaaaatcactgaggccaagcattcaagactagcatgggcagcaaaacaagaccctatctctacaaataattttaaaagtagccaagcaaggtggcctgtgcctatagttccagttactcaggaggctgaggcagggaggatcgcttgagcccagcagttggagactgcagtgagctgtgatcataccattgtactctagcctggacaacatagtgagaccttgtctcttaaaacacacacacacacacacacacacactcataatttgaagaccacttgaatggctgcagcaatggaaaaggagaggggactcccaagctggtcacatctggggggctgagtggagagagagtgaaagacataaaggccaatgtgtaaggggaagagactattagtttttttttgttgttgtttttttttgagatgagactattagtttttaaactcactgagttataaaacacaaccttttgcatgttgcagtatgggaattgaaaaaaagattggagtgtaagtgaagctgggagttagggataaaagccagttggattgtcagccaaatgacaatgatttttaccatgctacagagctatagatatagaactgtacttgaccacatttattcacatttgttctattccctgtatttaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataaggttagtcttctttctgtgtttataaagagatgttttcctctgggccaaattattcaagtgcttggagcgcacatgcacatagacacacacataatcaaaacccatcccctccccaataacttatttttatgctatttatgcttcaaagaaccactttattgcagcttagttttttcttctctttcctagctaggcaggagggagagttagggaccttgacaagaattgaatgacagctgcctccaggaaagggaggacaagcaagctggtcctagaacaaagtttgtaactgaacacctttagtatcttttctcttcatataatctatctcttgatacacttatgtttctacctccttggaaatcagtacccttatattgcccctctggctgttcttaggctccttctgaggagtacttgctctcataatacgtaatcaaaatgcaaaactttcatgtccttgctgttaggttttcagccatgttactatgttacattgaaaatgcagtcattgtataccaccttctcacacatgcacacaaactctgagctacagtgcttactagttaactatttttgctgtaaaatcaggctttctattatcagagactctggtcaaaacctacaaaccctatttaatctactctaaacggatctggcatttgaagtacagctgaccaactttaaactaatttcccactaatcagtagccagactattgactttagcctcctcaatggtggtagaaccagctttgcaagacctttgtcccctttccactgaaaactcaataggagacttcagtgcctatgtgattggaaatccattacccagtggagcaacgcacacaactggtgcatgcagccatcttggcttaaagcaggataggctctcctaagtatagaccatccttctcctcgcagcccctgccttttttctcatttgaccccagaaactcctagaaacatgagtaaagtaattctaattatttttattttatttatttatacaagtaaatttctctatatagagagatatctatctctctctatctctctctatatatagatatctctagatctagagatctagatctagagatatctctatctctatagatatctctctatatatatatagatatctctagatctagagatatatatacagatatttctatatctctagatatagagatgtatctagatctagatatatatctctagatctagagatatctatctatatatagagagagagaaagtactagtaccaataacaaatgtaattaatttgtttcttaatttcgataatactcaaaatctgttttcagaatttgttcagccaggcgcggtggctcacgcccataatcccagcactttgggaagccaaggcgggcagatcacttgaggtcaggagttttagactagcctggccaatatggtgataccctgtctctactaaaaatacaaaaattggctgggcatggtggcacacacctgtaatcctagcttctcgggaggctgaggtgagagaatcgcttgaacccaggaagcagaggttgcaataagccaagatagcaccactgcactccagcctgggcgacagggcaagactccgtctcaataatagtttgttcctcagtgtggctacgtgttcatgattgcagatatacactattgcttggtacccagtgctatgttaatattgtcagctttcaggaatgatttacttgggtagtagaaaaaatgttatgttagtctccctaagtactctgtttcttatccctttatactcacttattcatctgcagttataaagctctatcatttttggggacagctgcctacacaaagagagaaaaaatacagtattaactattgatgtgtatacttttgtaagatgaaaacaggttatacactgaaaatatcataattctcattatgtctttcaacagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggtatgtgcctattgtggcttatttactttgtaacttagcaatgattcgtagtctccttcacctaacctaatggtgctgaaaccctttccatcacccctaccaacccaaagaaaaacattccaggacagctgtctcaggtaccccttcagaagggaacctgattatgttgatagagtaaaagaataaagacagggaacacaggtgggctggcccgtcttcagaagtgctggcatggctgtcagcacatagaagactgttttataaaagctgtgtataggtagaagtgtctgttctctttgaaacatctttatagaaattactgaataatgatttggcaggggaagttgctattctgataaaacagtgtctagattttctgacatgtaacaaacctccaagaaacatgataaaatataaatgaaagctcaatctatccaaaaagaatattaggccaggtatggtggctcacacctgtaatcccagcacttggggaggccaaggcaggctgatcacttaagatcaggagttcaagaccagactgtccaacatggtgatactaaaaataccaaaaaattagttggacatagtggcatgcacctgtattcccagctacatgggaagctgaggcatgagaatcgcttgaacccaggaggtggaggttgtagtgagccaagatcgtgccactgcacccgagcctgggaaagagtgaaagtgtgcatcaaaaaaaaaaaaaaaagatagctgctgttttgagaaatttataatctgttcaacaaacccaaggctaagttatgctgtactacataggaagtgtaggaagtgtacttattttatgtgttcattagattcactgaaaaactgattgtgaatgcttgtaacccttccttatatgatgttgtattttatattcaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 38355 - DNA, 8841 bp, Homo sapiens
gcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggtgggaaggggccgggcggggtcgtcaaccttgggcccggggtccccctcaccctgcatccggggtcgccccaccttgggcccagggtcgccctcaccctggatccggggtccccctcaccctggattcgggatccccctcaccgtcgatccagagtccctccaccgtggtcctggagtccccctcacccttgacccggatccacccccaccgtggaaccagggtcgacgccaccgtgggcctggagtcccctcaccctcgacctgggctcgcccccaccctggacccgggtcaggtggtaccaagcactatgggcactgtctcctcgcaggggatggtggacaccgcaaagaagaactttggcggcgggaacacggcttgggaggaaaagacgctgtccaagtacgagtccaggtgggtgccctggagcacccctgtgggtcttggcctggcgctgtcctgggaagtcgtgtcctgcctttggtgcctgtgttaatgacagggagacagaacagcccccgaggcaccagtcacccgtccgagtcacctcggcttctccctgaggactaatggctggcccctctctggccttccagcttctgctctggtccctaccccctcaacagacagtggcttttcaaaatgtaaactggaacaccagccccacttgtgggaaccgctcctggcttcccctgacagtggggtccccttattctctgtgcccggagtcctggctccccggcccctgcacccaggttggcgtattggttcggatttttcttcactgccttggaggcgctgacggtgggccggtgtgggcctgtgtttcagcgagattcgcctgctggagatcctggaggggctgtgcgagagcagcgacttcgaatgcaatcagatgctagaggcgcaggaggagcacctggaggcctggtggctgcagctgtgagtgccttaaaacctcttagaagatactttttattttccaacttagaatttgaaataacctcagacttagaaaggtacaggaacagtagggagctcccacctgcctcgcacccaccttacccctgcattaccgttttttatcaccagagtcagcgatcaaaaccaggaaattaaggagaagattctgtccacacctagactcttgtttcctggaccttacaatactccagagcatatgttacgttcagctgcatgtttgttttaaagaaccgtgtctgctgggattcagtgaatgttttcctccatcctcaggaagagcgaatatcctgacttattcgagtggttttgtgtgaagacactgaaagtgtgctgctctccaggaacctacggtcccgactgtctcggtgcgtttctcctcagggaaatcccatctcctacgtcacttcccctcttcttctcatgattcttgggaggtaaaagcacagaggggacctggggtgcatcagctttctgtagggtctgggaccctgccggatggctgcctcccccatccccaacacagcttggagcacttcgcaccgtctggctgcagcctcaccactaacctcatgctttagcgtaaaactctgagtatgtcttcccagctgtgctgttaattcaggggttcacagactcaggttgttcacagctgagtccactcacctgagagtctgtcctgactgacctgtccaggtgcttctccctgtgtgcacagaggtgaccacaccacaacttctgtggctgctattgcagagagcgcagggcactgggtgtctatcaggctgggcacatggccttgagccccaatgggtgccaagggacagggctcttctgtgaagaagtgtgcattgaaactgaagtcacggtttactgtttataaaagccaatctcgtggtcaagcgagatcaggtagcagaagtttcaggttcagaccccccacccgcccaccatcagccttctgccagcccctgctgctgtccctggcatgcactggaggccgcagctaatgttcccactctccctgcagtccccgcgcctgacgcgtcagtgtccctatcaccatgtttcagctgaggctgcccaaagccacacaaagtgcagtcatgtgtaacgaccaggcgtgttctgagaaatgcgtcattaggcgactttgtcatggtgcaaacatcacagcgtgcactccacacgccacacgccacacgcctagatggtgcagccgctctgcacctaggctgcctggcaggccctgctgctcccaggccgcacacctgcacggctcgtgagggtcctgagtactgtgggccatttggcacgtggtaagaatgtgtcacctgaacacatctaaacatagaacaggtaatgaggcacattgtgatgtcactaggcaataagagccgctcagctttagtatcatcttaggggacagctgtgctatgcagggtcccttgttgacctaaacgtcatcatgcagcacgtggccatagtgaagcccaggagcctgtggcttgctccactcaggcgatccaccgccagccctgcagacccaggaaatcagtttccccaaacacccactccaagccttcaggctcatgtacgtcctcagaatcgtacagggtttgggtgccatgcgttctctccgtgtgagaacaccgcaccggtcaccaccaggtgtgctctgagcatggttttgtgtcccctaaagcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacaggtacgggctacgcctgggctggccccggggttgaggcgggatgacaagagccccttgctggagctgcctgcctagatgggaacaggggcctgttgatctttaaccccagatgtccaaggaagcttcgagggcccagaaggatgaatgaaaacatcagaggatagaggcagaggttgtcgggcacttcctgtcccgtaacagccctcagaagggagaagctactcacctttctctctagttcaaggtccaccccgaccttgagttgtgatgggccatgcagtgcacaggtcctggaggtgccgtgtgggccccgcaccggcccagagagcagcatctgtcaaatccctgcaggccgttatgagtggcatctttccaaaggacgttttctccctggttgtcactgatatgtaggaaaactctgagtgtctcggacgtgagtgtgtggttggccggcagcccctaggctattctgggcagacagacccgtggatcgatagtcaggaccggcctctccgattcttacgcccctcagcagtcaggaccggcctctccgattcttacccgccttgctgtctgtctcttggatgttggcgtggcgtgggccacgcatggatccgtggccggaacacgcacacccagccaggctacagctccagagtatggatagctgccttctctccaggttattaaaaattccttggagtcctggtttgctgagaattttaaattcatgggcactgaaaatcccgtgttgcttttccctcttaaattcctcacttttaaacgagccttgtccccaagctggtacctgagagtggggtttgtacccaggcccgcctttgccttccagcctgtgacgagtcctgcaagacgtgctcgggcctgaccaacagagactgcggcgagtgtgaagtgggctgggtgctggacgagggcgcctgtgtgggtgaggagcggcccgggggtggaggagggcgcctgcgtgaggcgtggggggtgtgagatgggggcgtaaggcgtggggggtgtgaggcatgggggcgggaggcaggggggcgtgaagtgtgggggcgtgaggtgggggcgtgaggtgtggggcttggggtgtggggggcgtgaggtgtgggggagcatgaggtggggcgtgaggtgtgggggcgtgaggtgggggcgtgaggtgtgggggcactcactgtctcactctcacacaatgtgtcgccatcctcatggggcgcctgccccggttggcactgagtgtctaaggacagggcctggccatcgcctcatcccctcccctgccgcgtggggcctccgaggatggcatttgagatgattcctcctcaggggctgccctcctccctgcccttccccagccggccctggccacgggctgtgtcaggccatgatcggtccttccccgctccctggccgggctgtcctgggccgctcacagctgtgccgctctgttccagatgtggacgagtgtgcggccgagccgcctccctgcagcgctgcgcagttctgtaagaacgccaacggctcctacacgtgcgaaggtgggccaggcgggcgggtctgcactccggggcctgccgggtttcgttgctgcctttgtcaacattcatttatggcttcttagtgtcacttccatacatcctgcctgccctgagaacacttagtgtggcaaagtaagtcataggtatttgctgcaggaaaatcagaaaattcaagtcagatgaaaagaaaacagttaaaaacccaggaactccctggagagcgcaccctgctggtgcctccactgctcgtgcccccccagcgcccccgcaacgtgccctgcgtgactttccgcagcgcctgtcgggtgttttccactcagcagcttgttgcgaacgtctctgcgtcctgtggtttctctgtcacgctaatgattttggagccattatttcatacttttacaacaatgtctgttgctggacgtttacgtcataacagtttttcaacttataaactgtgaacacttgaaggtaaacttttcacattccttatgattttctgtggattaatttccaaatcgctcagtcaagggaatgtgtcttttagagccatagtgccccagaaaagttgtgctgatccccagtcccagcagcagggaggaggccgcctctgccccgtgtgtgtgacagccccaggcagttttcactgttgggagtgcagacagtgggtccctcagtgagccactaatactggaagccatgcgagaggctctggttattcttaggaagctcctggcaggctggcaaaccaatggtcaccgagctggaggtgggtttgtttctagaatctctgtagcacccagtttctcccaaagagttccaagccaggtggtctgcaccatggctctccgggagcacctgctgcacagcaggacgcgagtctgtgcttttgccgggagacagagacagatcgttataaagtcacttggtgatgaatgaggagaaaacccaaatcctggcggcaccggtgccttgtgcatgtcggggtctgacgggcactggtgccttgtgcatgtcggggtctgacgctggctccctgttgcagagtgtgactccagctgtgtgggctgcacaggggaaggcccaggaaactgtaaagagtgtatctctggctacgcgagggagcacggacagtgtgcaggtcagtgacggggtctgtgctggacgctggtggacccttcccaagtgaccatgatgtgaatggccccagcaggtactgccagggatgggaagcagttgagacccgtcctgcagacgtggctcccccagggtcactgtgcactcgccctgaggtccacgtgagacacagaagcagtgggggtgggggacgggctctgcatggccgaccctggtgtggatggcgctgctgcaccagcctctcgccggtggcctcgttccccaggtccaccgcctctgctctccctccagctcctgggtggcgattgccccgaggcttaagtccaggcctgccatggttgtgggctgcctgggtgagcctgggcgtggatggaacccggtggagaaagtgggtttcctgggcaggcgccatggttcatgcctgtaatccagcactttgggaggctgaggcggggggatcacgaggtcaggagatcgagaccatcctggctaacacggtgaaaccccatctctactaaaaatacaaaaaattagtcgggcgtggtggcgggcgcctgtagtcccagctactcggggggctgaggcagcagaatggcgtgaacccgggaggcggagcttgcagtgagaggagatcgcgccaccgcactccagcctgggcgacagagcgagactccgcctcaaaaaaaaaaaaaaaaggaaaagaaagtgggcttcctgggcgcatgctggccttccggccccacctggaggtctcttctctgcattttctaccagttgagggcccaacttggagacgtgaaattcttccctctcgaagcctttcctgatctttgctcctttctgtaacgtgacgtttgtcatcgttgtgctttctttatgtgaatgaatctgaatgaatgaatttcataatccgctgcgcgtctgctgagcaaagtaattattaaaacggagtcttttcattttagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctggtgagtggcacggctgccctccacacaggctgccctcccctgggccgcagggcttgcacgtagactggctgcttggtctgaaatccacacagatggtggccttgagatggtgagagggggattcccggaagacaggtgcatgacatctctgtgtgggcacgcttgcgcgagaggtactggcttcctgaggatgaagccccaggttcacagctcaaacggaagttcaggcgatgaagggggaagtctctgaagctcagacctcagcgggcgatgagcagaggagcagacgcaggagaagaggcagctaaagagctggaaaagtcatccggggaagctgcccagggtgccgcagagacagggacaggcaggaagtggtggagggcaagcgggtcccccacacctgtttcctggggctaccttaccaagaaccaggaacttagggctccagcaacagaaatgtgccgctcacaggagccagaagtcagaggcccagacgcaagcaggctgcttccttgggaggctgggtgggcgcgtctgttccgggcctctgtcctcgcctggggatgccacctgctccccgtgtcttcacgtggtctccatgcgggtgtctgtctctgtccaaacctcccctctttgtaaggacaccagtcactaatgccctcatgttaacctggccagtggtaaagaccctatttccaaacaaggtcacaatcacaggtactgggagtaaagacttcagcgtgttttgggggacataaatctgcccgtgacagtcctcacagaagtctagaatatagagagtgggaaagaagcagtgttcaaggagatattggctaagggtttttcagaatgaataaggcacgattcagattccagaagctgtttcctgagcaggacaaataaaagcaattccacatctagaagcatcgtagtaaacagcaacagcaagacagaactgaggggttagcagagacggacaggccagaagacaaggctgcctgctaccccctcggtcccctctgccctgggctggccctgcctcttgcccctccctccccccaccctcggtcccctcttgcccctccctcccaccaccctgggtcccctcttgcccctccctccccccaccccgggtcccctcttgcccctccctccccccctcttgcccctccctccccccaccccgggtcccctcttgcccctccctccccccaccccgggtcccctcttgcccctccctccccccaccccgggtcccctcttgcccctccctcccccccgtcccctcattctcctccctcccccccaccctcggtcccctcttgcccctccctccccgtaccaccctcagtcccctctttctcctacctcccccaccctcggtcccctctttctcctcccgccacaaccattgttcaggctcccattctgccaggccgcaaggaaccccttgccgctcccaactctgcatcctccacacccacggcagcgtgggggctctgaaatgccgtctgcctcatctctcatctgctttgtgggaaacgggggtctccgagctgcccttggatggctgcgtccggggctttgagccaggactggacgggcaggccctgcacatgcgctgctgtcctgggaaaggcctcatccccagggccctttgtgctcagccttgacgacctatgcttgttttctgacagaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggagg

SEQ ID NO: 38356 - DNA, 2040 bp, Homo sapiens
gtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggtacgcgggactccggggtcggggaaccccgggccggggctcgggagccggactgggtgtctggagaacagcgccgaactgggggaacaggcggatgtggggatctggggtcaggtggccttcaaacagctcgctcccggctgtgggaagttccatcactctccaagcttcattcacaatccgggcctcagtttctcccaccgtccaattggggttggggggggtcttcagttccacaagtccgaagtacttcgaatggagagagaaagtgagtgagggcgggatgtttagtctaggaaggggcacgcccccagcctggtccgtacagggtctaactagccccagtgatcgacgagttggggaggccgtcgagaggcactagggtctgtgccctctataccatgtggggtgcccccttccatccggtgacttcagtgcccagctatgcggggggagggactggggtcgggcccggtgcccaggagtgagtcacccgccggcggcaggggggttgtggggacctgaccccccccacccccagcgtcccgcgctacgccctccctcccggagctgccgtgtcccggtcgggccgtgcggtcacctgtgaggaatgcgcggggagggcgccggtgactcacgttattcgagccggccgaccctgacctcagaccccagaatagccgagtcccgcccccagcctctgacccgaggccccctccccaggcaccgccccctgctcccgcggcagctcctggagcgcggacctggacaagtgcatggactgcgcgtcttgcagggcgcgaccgcacagcgacttctgcctgggctgtgagtggggggcagggccagtggccagcggaccccagactgggagggagggtggctggtgcgcagagcggggccgagagctttgcatctgggaaatcattcgggaggaggtgggagctgggagggggctccggtcagggaggaggccacgtttgggagaaggcagaaggctcagtcttagggggcggggctggcctggagaggggcgaggtctgactccgagtcccgcccccaggcgctgcagcacctcctgcccccttccggctgctttggcccatccttgggggcgctctgagcctgaccttcgtgctggggctgctttctggctttttggtctggagacgatgccgcaggagagagaagttcaccagtaagtgtgccctggcctgcccagccctgtcagcactcgaccttttctctgctgctgacgaccccacctcttatcttgcagcccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaacttt

SEQ ID NO: 38357 - DNA, 11549 bp, Homo sapiens
atcaagcaggggcagggctggcgctgcggcgggagatgctgtcgggccgcggcggcgcttggcagccaggagctctgcattgaaggcactggggtgaggcttactgcccggcaggctggtgggtacgcgagggctgaggtgtctgtaaatctggccgccagcctccacgggcccggcatttgtccatctttctaggcgctcgcgactcggcgacggcggccgcagtgggacacggaggcggggccgggcacctgtgcgcgtttgcaggcacctgctgcgctggccgcctcgcagcccgggactgctgctggggactgcggctggagctgggctggcccggcccgagggagaggggggcccagctggctcgccccggcccgtgcccgccctccccggccgggtcccgaccccgagctctggttaagggggcgtcgccgggccccagagcccccccactggaggggcccgcggctcccgggccagcatcgagctagctgcgaggccaggacagggcccccgccttgcatcacctcgagacaggtttgtccagattccctgagtgctcagagacgggtttccgcccgcggtgagggtgccggtccgaggccgccgcgggtcccggctgtccccagcgagcctggcccgggccgttttcatctttttttttctggcccctgctctgtctcctcttaacgtgtaatttcttaagtccgattcggggtgatgtgagtgcgctgtggcatgtagagtaacagcagcactcatgttttagcctagttttagctctgccacgcactgtcattcgcgcaggctgaagacccagacttctcagctgggtgatgtaaaggaatgcagccgtggccaaacaggcagaaattctaaaattgtttccaagtgacaaggatgtaacatgtcttgcttccatctatgtcattcctctcagaacatgtatgctgtgcttgtcctagactagaccctgaaaagtgtgctacagtttctcgtgattatgttgctgctggaaacattggattaaaagatccatagcaaagttaggcagcagaagacaatacctcctgcttaatgacaggcagaactggggacaaaatttactggattcttaaagagaatcctaacgcgttagacctttaagagactttacaggtttgcaccagcccattaaatgtatgttgtggagcacaccactgtgtcccaagggatccggtcccgtgttaggtgtgtcctagaggacactggggtgctgcacattactgctagatctgaaaatcagtgtcttcatttgagccaaaggggaacatgcccccgcacatttttgatatctcaagtatattcagtgtgtcatactcacctttaaaggcagatttgcggagaactgttgttacttattgcatgttatccatgctagtagaagagccaggatcttcattcctctgatttaattactgggtggcattttctcttggaaaacaaaacagcagtaatgggcactggcaaggtatggatgacctgggttgggtacgtccctggatgtcacaagctcgtcagagaagacaaattattgctgattggggacatttagtacatggtttgctcatgatctgtttaagaaattaggaaaacgttgcttagttttgacccttttcaccttcagccgtttgattggtgcaagtaggaattcagagaaggagctctgctttaaaggtaacagagcctggggggaaataccagggcagggaagttgctgttcttacagctgggcttggctgcttttcctttgcttctttgtatttttagtaaatgacccactgactttatgacctttgagacatgctttcttatccacgacttgaagcttcggctggaagatctgtacttgtgaaatgtctctcttgcgtgcctgtgttgcatttgtctggattgcttggcagttccttaagtacatgatcctgcagtttctatatgtttcgaagttgtagaaggcagtttattgggggatggtactgacaggactcaggtaactacttttgtcgtcttagtgacatacttgtgctgtgccttcctgttttctcttatttctttggctaatactttgctggaggaatcattttgtactcaggtgagttgaggcagcgcttaaatcagcctccttgtatctattgtttgttcccataaccctgggaacagtgatacaacttatgtgtatgtgggtacagtgcattctgagtctggctttcctgttagttaaatgccgagatgtgctagtaacaactgttgtccgtatcttctgaatttctggcaccaaagctcatctgtgtcactgagtaatctgaatcctggccaagggacctggtgcacagattcttatagacatctaagtgtgaaagaaattagaaccagaaaaggaggtgggtatagaaggaaactatttctgaagatgcctgaagaccttttcctaggtttttataaccccttgttatataacattatattgtatatccagggtgtcataattagttattcatcatttcagaagtcttaactgttggccgggcgtggtggctcatgcccgtaatcccagcactttgggaggctgaggcaggtggatcacttgaggtcaggagttcgagaccagcctggccaacatggtgaaaccctgtctctactaaagatacaaaacttagctgggcatggtggcaggcacctgtaatcccagctactcaggaggctgaggcaggagaatcgcttgaacccaggaggtggaggttgcagtgagccgagatcacaccactgcactccagcctgggcaacagagtgagactccatcttaaaaaaaaaaaaaagtcttaatggttggtgttggcatgtttctatgtcttcccgtcttgttttaaggtaaagtgaatgccgaagacagaagatttggatgatacaccactgactttctttgtttggaatacacgttatgaaccctttctggagcatgtctacaagctctgtacgcaaagtaggtatagttgataaattcagtaagaaaacccatttgcttctgtgtctgaaaatagggtcagaatgaaggctaaaataatctgtcacggtcacctgtaatcttgacaaaattacctggtttttctagttaagggtttactcttgagaaataattattttgttggttgaagtctgtttctgagactaggattgcatctcaaatagaaatcgttctggtcatcacaattctaagatgatttaggttatatttacacatgatgaaatttgtaacattgtagttttctactaaacttcaaggttctacggttagaacagctgtgggaaaggctagtctaatatcattaaatcagacttgaggggcactaatttaatttttctaaataaaatgattttttaaaaatatattttcattttaggaaaggttaaaataggcaaacaataagaaaataaaaaccagctgggcacggtggctcatgcttgtaatccccagcactttgagaggccgaggcgggcagatcacgaggtcaggagatcgagaccatcctgactaacatggtgaaaccccgtctctactaaatatacaaaaaaattagctgggcatggtggcgggcgcctgttgtcccagcttctcaggaagctgaggcaggagaatggcgtcaacccaggaggcaaagcttgcttgcagtgagctgagatcgcgccactgcactccagcctgggcaacagagcaagactccatctcaaaaagaaaaaaaaaaaaaaaaaactataatctcacctctaggagaacaaacaccactattactttttttctatatacatgacatctcttccttacttgtacatagtaatggggtacaagtttagttttgctacattggcatattgcattgtgctgaattcagggcctttagatgcccccatcactggagcaatgcatatgatatacatgtttttatatagctaattaaacagcgtttggttgtacttgcgccaaggaagtacctatgagatggtagtttagtctctgactcatgtcgacctttgtctttgacgaaggatgacagtttatgctggtgatatttgaaatgttgaaacatacccagtagggacaaatcaaaatcagacccaggcaagtgagagaatagcttcattctttgtttctaacctaagtgctaacaggcagtgactgatttcagtcatccacattattttgagcttcttagcacctaaccttctgtagcatgtaagtgctgggggacttttctagccttgtacagttgtctaattgcttagtaaccccttgccctctttttggggccactaggaaaaaacatttctttctgtgtttcagttaatcctgtacacactgattgtatcatccttataggatgagtttccctatatgaaagagtttctctaatgctttggtcttgcttcaggtttgtcttctctttatatgacctgcctgcccaaaggactttctagtcatcttggtcatggtgttagaatgtgcttgtaaaggagtaattccagcatttaggccatggagctaataatgtactcttgtgatttaagaatcatcctaacagatattcttacaacttcatcttgtatagcgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaattgtaagtccttaacaaactatttggttaaattaggaatgatcctttaaagtgaagaatgaaatttattctgatggatgcagtaaagggcagacatttaatctcaaagctcaaacctgtccctttccagtatcagacttaataaatataaaactataggctattgctggtgataaaatgtttcttaaccaagacctaggtagagagataaaaatagcctctcttaaagattctttagagctcgggtgaataagatttaaaggcagagggtactttaatttccatgtctgttttggagagtaacaaaaggaagaaactaaggcttattaagaacctacagtagattggccgggcatggcggctcacgcctataatcctagcactttgggaggcccaggcaggtggatcacgaggttcaggagttcaagaccagcctggccaagatggtgaaaccccgtctctactaaaaatacaaaaattagccaggtttgatggcaggcgcctgtaatcccagctactcgggaggctgaggcagagaattgcttgaagtcgggaggtggaggttgcagtgagccgagattgtgccattgcactccagcctgggcgataaagcgaaaccccgtctcaaagaacctacagtagattaggaacttaataaatttagtcttcgtttatgtgaagtgaggaattcgcctcctggaggtttttctagagagtaggacagtgggagagtggctgtctctgccttcttgggtcagacccatctggagggtggtgctccatttggttgtcgccttgtaggcagcctcctgacagatggaggagaaggcctagcagggagggaccaggaaggccagtccttagggatccacagttgaaggaactggagaagttttcttggagaagagacagcttaagcacgtattaaagttgtcttaatatatttgaaggtctgtcacaaggaaggatcttattctgtatgacccccaaaggcaggacttagcaattctagggaagagacaaagatgtgggctccatgtaaggaagacgctgactggtcaccgaggtctgcagctgggctgcagttgcacctggttgtggagtgcaagaagccaagcagggtgcggagtgctggcagcgaccctgtggtgcctggcacacacgggggctccagcactgcacagacgcagatggcatttcattagagaatttgttaaaaggacagaaagtttggagaattcttaatttccatcatttaaaaattcctttgtatacagttattttaaaagcatccttgagccaggcacagtggcttatgcctgtaatcccagctacttgggagactgacgcaggaggatcactggaacccaggagttcaagaccagcctgggcaatagagtgaccccgtctctaaaaaaaaaattaaaaatttcccagctgcagacctatagtcccggctactcaggaggctgaagtgggaggatcatttgagctctgcaatgtgagacaagtgtaggccatatagtgagacctcatctttttttcttttttttgagatggagtctcactgtgtcacccaggctggggtgcagtggcacaatctcagcttactgcagcctctgcctcctcagagcctctgcctctggattctcctgcttcagcctctggagtagctgggactacaggtgtgcgccaccacacccggctaatttttgtagttttagtaagagactggatttcaccatgttggctaggctggtctcaaactcctgacctcaagtgatctgcctgccttggcgcctcccaaagggctgagattacaggcatgagacatcgcagacagcctatgagacctcatctttttttttttaaaccaaaaaaaaaaaaaaaaaaagcatccttgacccctccctggatgtattaatgttgtaatggtcagtgggtctgaggccccagtgtaactttttaactgtatacaaaggctgggtatgatttggtagtaatggcccctttggctctataatggaggccttgtgtttgaggctgggcagtgagttggacaggcgtctattggggtgattaaatctgtattagaactgccttttctggcaaacttcactgtagtagagatacagctgccagccatgttgctactgacatgctgaattttagcaacttaaaaatggaccggataataactcaaaaatgatgaaaagtaagtgaatggaaagtaggtaataaaaatgataaacttaaggcctgataaactagttcttgatagaatccaggattggtaggttaatgtgatcagaatggctgtgggtgggtaactgggtcccagaagaaccagtgtagcctttgtgtcaatacacttatcgtttcttgttttcagcacccagttttccattccctggcaaggcccacagagttcaggtctctgcatcagggtgtccatttgagagcagggcgtgtgagagccgcacaaggatgcctgccctccccaggcagtactgcgagtctgaacattgccttctgctgtgggatcttgtgattaaaatgtaaaatgacaactttgtgacccaattccaagaaatcttaatttatctaacattgtattttaaaagtttttgaatgatcatccaggcacaaaagcataattttacaaatactctcattgacctcagctgtacagaacttacctcaggttgcattattcggaattacctataggctggtttccaagatgatgttttggaagagcgaatttctgggaggaaactttattcttcatttattcctgtttggctttagttcttactgtggggcccctgctggcctgctggtttctctgtgagctgctgctatgaggccagtagtgggcagcgatcagggctggggctctttcctgagttgtgtcaggtgagagattgtgagaacttggcttgcagggtttgggcatcagctgcccattgaggggccgttcattgtctcaaagtgaatgtggggtggtttgatctgcatgtgtcatttgtatccacacaagttaattattctgcttttgttgtagtaccttggttgtgaagcagaagctaccaggcgtctatgtgcagccatcttatcgctctgcattaagtaagatgaggattcactcttaatttatgggcacatttagttcctcccacacaaatttaggccttaactcttttattttttcctacagtgtggtttggagtaatattcatacggcatggactttaccaagatggcgtatttaagtttacagtttacatccctgataactatccagatggtgactgtccagtaagttggagacacagtctggctttatttgtggatcagcgagaagggctgaaagggcttacagctttcctggttcttttcctgacctggtacctttatgatttatctacccagtagttgtccagggggacttctgtgctttgcagcagcttccggcatgccatcagagctttgtttctctgctcagggtctgcaagggaggctggctgcctgccatcctgcagcactcaccaggtgaatggtggccctcaggctctagtggaggagagggagttttccccgcttcattgcaaaatttagtttttcaggaaaatggtaaaagtagttaagtagccctcttgaggcagctctttagctttaaataacgtgactgccttgtcctgaagctctttttatcacgattcctatgggtctcataagcgccactgcttccattaaaggacatgtctctctttatttaaatacagcgcttggtgttcgatattcctgtctttcacccgctagttgatcccacctcaggtgagctggatgtgaagagagcatttgcaaaatggaggtaagtaaataaagtgtttcttttagtgacataatacagcaagaggacgcctcggtaatcacgccatgtttccctttaggcggaaccataatcatatttggcaggtattaatgtatgcaaggagagttttctacaagattgatacagcaagccccctgaacccagaggctgcagtactgtatgtaacttttgctttgttatttaaaataaatttgaagatgcagctaagtagattaagttagtaactttttgacttaaacttttaacacaggtatgaaaaagatattcagctttttaaaagtaaagttgttgacagtgttaaggtgtgcactgctcgtttgtttgaccaacctaaaatagaagacccctatgcaattaggtaagtggtgcatcccccaagtgaactgtccactgtcctttccaatacactgcttcctttctccaggtggtctcagaatagggatataaaaaggcacatgcataagctgttagcctacaacctttataacttggtgccaactcgatttctgatgcctcttgaggctcttctcttaaacaaaaagcttcacatctgacaggctgtgccgacagcacattctctggtgactttggtttcccagggatccttgtgatatatttattcattcccatgtcaggactcttcttttcagctggcagttttagctggagcccctcttaaactgccaaaccctcattgacattcagatgtggtaaaaggagggaaactgaatagtgtgagaatggtgggttcctgaagcactatgacatttgatttaaggaacagtgtctggaggagtattgggaatggacgaattggtgattttgctctttggcaacattggtagtgcttaggaaggcagtggagtatagctattaagagcttggactcatggccaggcatggtggcttatgccagtaatcctagcactttgggaagccgaggtgggtggatcacgaggtcaggagttcaagaccagcctgaccaatatggccaaaccccatctctactaaaaatacaaaaattggtcaggtgcagtggctcacacttgtaatcccagcactttgggaggccgaggcggggagatcacccgaagttgggagttcgagaccagcctgaccaacatggagaaaccccgtctctattaaaaatacaaaatacaaaattagctgggtgtgggtggtgcatgcctgtaatcccagctactcaggaaggctgaggcaggagaatcacttgaaccagggaggcagaagttgcagtgagccaagatcttggcattgcactccaggtacctgtagtcccagcgaggctgaagcaggagaatggcctgaatctaggaggcggaggttgcagtgagccgagatcacaccactgcactccagcctgggtgacagaactagactcagtctcaaaaaaaagagcttggagtcagcagatggactacgtggcttttgtactttttagctctggtaacccagagcaattaatttactctgctttgctgtcttaatctttaaataacagtacttcaaggggtggtgtgaggcttaaatgagatcattcatgtatgagggatagttatgtgagaaaattaattagataatgtctaaaacatacatgtcgacaacaataaaaaatactgtgctttattaagttaggggaattggcttaaaactgcaaaatgaatgttatagaaatttagtgagccaacaaatagtttttaaatacttttctcttccttaagcttttctccatggaatccttctgtacatgatgaagccagagaaaagatgctgactcagaaagtaagtggataacaacttatgaaatggctaactcattgtttcttttctaaaatgtcttcatttggagactgctcattacatacaagtaactttttttgggaaacaagtttgtacagtgctgaaatctcctcaccagtaattttttaaatatctgttttgattgtgcctagaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattt

SEQ ID NO: 38358 - DNA, 36872 bp, Homo sapiens
cgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcaggtattccaccctcctactaccggctcctttgccctagaccttgagttgggggtgggaagcagcttttttttctggcgtattctgtaggctttgctttgcctctcgggtttttatagtcatatacaagttttcaaaaaggctctaaaatattttatctgccttttgaggaaaacgagtggcagggacccttcttgacttctgattttgaaatttgccattctctgtaaatcattgttagtatcacgagagagtttaaatagcaattgtttggggtggtggtgtcccgtgccatttttttatggttaatacttaaaacattattattagtattaatacatgtacatagttaaaacaacttgaaaatgtaaaatgaaaagtaaaatcactattccccctgtcccctttccagggtggacaatatattatatttactatctacctccttttttttaataatttgtctattgtggttaaatttagggatttatggtgtcttacactgcctccttctgttcttcccttctccagtttttattctttgagttagtaaacacagggtcctaggtgcagcagccttttcttattttatagatattaaaagtcttgaatctacaaagatgataattagaaaaatctatttcctaaataatttacttactgttggtcaattgttctgtgtctttttggtcctgtttccttctgttgctttttctcgaacatgtgatgggcactggttatctgtctatattttgattaatatgagtaataggtcttgttttcagtacatgggtcgctaattgacttttggctctgtaccaggttgcctagataggaaggtttcagttgagggcatgtgagcaggtaccagatgggtagactgggaacctgccttttgcttcaggctttgcagtagtggtggagcaacttctctgctgagtatagctgtttatttcctccgtgtgaactgtaaaattattaagcctaagtttctgctgtgtactcttaacaccagtattcacagtaggggtcctaccccttcatttctaaaaaacttttgattttatcttggagacaaacataactattttggactttttgcttggagattggggagggaggaggactgagtgatttccatggttattgtcgcgctgccagtttatgatccttgggcccactgacttcaagcttgaaacctctagctcggctcagcttgtaggaatagcatttctccctaatgcgtttttttttttttttttttttttgagaaggagtttcgctctgtcgcccaggctggagcgcagtggcgcgatctcggctcactgcaacttccgcctcctgggttcaagcgattcttctgcctcagcctcttgagtagctgagattactggcgcgcgcacgcccggctaattttttttgtatttttagtagagacagggtttcaccatcttggttaggctgatctggtcttgaactcttgacctcgtgatccgcccgtctcggcctcccaaagtgctgggattacaggcgtgagccaccgcgcccggccttggtgcatattcttattttactttgtcctactctggtttgtaggtcaatattccaacaacttttcattttcctgaagttggttaccatctgtcattcactggtggcatttattccttctcctggtacggattttatttccctttatctatctttatcttcttttagtgggatttgaggaaggaaggaatacacgtgtgtgctctctggaaatctctaatgctctttttgttagatgccagcagaacagtgtaaagttgcttgacagttattcttcgtttttgtaactctgggaaccctacatgaggcaggtatatccagaaccagagactgtactgacttgaaagaaaaagccaacagttaacaaatgtgccaagtacctggtaactaatgtggcagaatagcttgaaccggggaggtggaggttgcagtgagctgagatcatgccactgcattccattctgggtgacagagtgatacaatgtctcaagaaaaacaaaaaaagaattttatggccaggcacagtggctaacacctgtaatcccagtgctttggaaggctgaggcaggaggatcgtgtgaggccaggagtttgagaccagtctaggcaacttagcaagacccttgtctctaaaaaaaaaaaactgggcctggtggcatgcatgtgtagtcctcactatcagtaggatcagagtaggctcagagactactaagtgatcagtaggattgcttgagctcaggagttgagtttgaggctgtggtaagctatgatcgcatcactgcattccagcctgagtggcacagcaagaccgtgtccctagtgttcttttccttttttttttttttttttttgagatggagtcttgctctcgttgccaaggctggagtgcggtggcgtgatcttggctcattgcaacctccgcctcccaggttctagtgattctcctgccccagcctccctagtagctaggattacaggcgcccatcaccatgcctggctaagttttatatttttagtagagatggggttttaccattttggccaggctggtttcgaactcctgacctcaggcaatctgtctgccttggcctctcaaagtgctggtgaatacaggtgtgagcccccacgcctggccaagaccctgtctctttgaaaaaaaaaaaaaaaaaaagaattttaccagtctttgataatttggaaaaacccagaaagtgacagttttgcacttagtttttgtgattactagaaggtttccaatgttcattttcttttttaattgctctgtcacctaggctggagtgcagtggtgtgatcatgactcactgcagtctcaacctcctgggctcagtgattgtcccagctcagcatcctgagtatctggtactaccggtgcgcactaccaggcctggctaattaaaaatttatttattgtttgtagagatgggtctccctatgttgcccaggctggtctcaaactattgggctcaagtgatcctcctgccttggcctcctaaagttctgggattgtaggtgtgagacactgctcccagtcatcaaatgtacattttctagaaaaaaggtagtatattacaaagatgtagtgaatgcttttacataccacaacatacaaatcttccagaaggatctactggtgatgtgtgtagaatattgttttattcctgtgaatgcataaaacatatgaatgaaccaaaaatgaaatagagatagtaaaacatagtgttaagagcctggaattctaagacagcttgcctaggtttggatcctgatttctactctcaattgtgtgaccttggtaaacttatttacctctctgggtcttaatgttcttatttccttttttttttttgagacagagtctcgcactgtcgccccagctggtgtgcagtggtgtaatcttggctctctgcaacttgtgcctccagggttcaagcgattctcctgcctcagcctagtgagtagctaggattacaggcgtctgccaccatgcctagctaatttttttgtatttttagtagagacggggtttcactgtgttggccaggctgttcttgaactcctgaccttgcgatcgcctgcctcggcctcccaaagtgctgggattacaggcgtgagccactgcgcctggccttaatgttcttatttataaaaaaaaaaattgaaaaaggataatatggcctggtgtggaggctcacacctgtaatctcagcactttggaagtccgaggcaggaagattgcttgagcctaggagttcaggaccagcctgggcaacatagagtgagaccccatcttgacaaaaaataaacaaaattgggagtcgctcagcctacctgatttaccaaaccactcccttgccaaaaaaaaaaacaaaaaactaaaccaaaaaaaaaaaaagccaggtgtggtagcatatgcctatagtcccacctactcaggaggctgaggtaggaggattgcttgagcctgggaggtcgagattgcagtgagccatgattgtaccaatgcatgccagcctgggtaacagagtgaggccttgtctcaaaaaaaaaaaaaaaagttaaaaaaaaaaaaagtacctgaactcagttgtgaggatcaagtgagttaatttacagtgcttagaacactgtcttgcacatagcaatcactatatacatttaggtgtgattatgacaatgattgttgcagattttatttcaaagcaccacgtcagtattgcatttttaaaagtttgccagtcttaagaattggtttttgccatgtaaatggactttatcagctacttagttcccatttgctaggccaaatatatttcttgcacttgttcaataatacaatacaaaggtcaaggctgtatatgtgtgtattacaagtattcttttttctggtaccttacagtgtatcacatttaaatagcatatatagatagcagtgttagcacttcttgatgtgataagatgtatagcctgaatttttgcacaattaaatttgttttagaaaagtaaataatccagtgtgtaaatctgtcttgtcaagtaggtagatttgtggaattccataaacattttattgctaaatcagggaacaaagagccttaagttatttaaacatttttggtacgtgggtgggatggagtggaacagcattagtgtttcctgtttggtatttaattaatggccttaacttttttcttgccctactcccaaaccatgaaacataactcattttgtgatagggttcaattagagattagggttccatatgttaaaattttgctttttaaaacacctgaagtctgtttgctaattttgataaatgtgtttcatatatgtattcattttttattgagtatgggtttaaggtgagtgagggagactttattttcagaatattcattgtgtaggtttcctaaactgtggcagctgaggcaagaaagttgtcataatcataatatgaaagtgaatgaacctactgcttttagtaaagttagtcacaaatcaaatactcgctcacgttacactagttttcagcccgtctggggatattaacttctttattagttaggttttccctcatttttgggtgttttaccacactttgcagatgtaaagtgagtgtaaaatgaaatagtaattgtttcagagtctttaaatgtgatgaaagagaacagcttgaacagtatataaaactgtagacacacaagaataggaaagaatgaaaccagttaaaaatccaactgacagtttgtcagtttcttacagaactcaacacttataattcagcaatcacactctttggtatttacccaaatgaattgaaaatttatgtccacacaaaaacctgcacacagatgtttatagcagttttattcataactgccaaaacttggaagcaaccaagatgttcttcagtaggtaaatggataaataaactgcggtacatccagacaatgggatattatattatttagtgctaagaagaaatgagctatcaagccatgaaaagacatggaggaatcttaaatgcatattattaactgaaggaaaggctgtatgattccaactatatggcattcttgaaggcacaactatggagacagtaaaaagatcaggagttggatgaattggggtagcacagaggactttaaaaaatagtcatttttttagagcagtttttaggttcacaccaaaattgagctaaagataagagatatcctgtatacctcctacctccacccatgcatagcctcccgcattgtcaacatccccacagagccacggagccatacgtttgttaaaattgaacctacattgacgcttcatcacccaaagtcctgtagtttatatcagggtttactcttggtcttgtactttatggtttggacaaatgtataatgacacgcatcaactcttatggaattgtacacgtaaaattcactgcctttagggcagtgaaacttgcgtatgatacctaatggtaggtacatgtttacactatatacaccgaagagggaccaggaggaagtctaggaagcagttcttgtaagtcaggttaagaattttaattaaaaaggtttcttatttttttaatgagtcaggatctcactatgttgcccaggctggagtgcagtggcgtgatcatggttcactgcagccttgacctcctggactcaggagatcctcccacctcagcttcctgagtagcggcaactacaggcacataccaccatgcctgactaacttttaaaattttttgtagagataagggtctcactgtctcacctagggtggtcttgaactcctagcttcaagcagtccccctgccttggcctcccaaagtgttgggattacagacgtgagccactgtgccccactgagaagtttctttttatatatatataattatgtaatttgccctaattgcataaatttgatcaggcatacctcactttatttggtaaatttgggtagtcttttttccttctctttttttccttgtttccttttccttcagttttcttatcctttttaaatttgtttttctttcttgttctttttttcttatcctttcttgcaactccctttccttttctccttttctctctccccgtttcccccccatctttgccactgtctcttctttccccctcatctcctttttcttctctcctgtactcccctttccccctccctttccttttcgttctccttcctttcttttccctctttctgtttgcctctacttctcttcacatcagcaccttatttcctagcccatattaagaacctgattatatggctccttctatatatgcttatataataaatagtatagacagttgtggtaagcagaataatggccccccaagtatgtccacatcctgatacctggaacctgtgtatatgttgccttacatagcaaaagagagtgcagaggtggttaaggttaaggactttgagatggggagagcatcctggaaggtgcgcctgatttaattgagagtccttaaaaaatggcctggccgtgatcaaagatatgattactaatacatggtcagagagatttctatgttgctggctttgaagatgatggaagggggccatgagccacagaatgcaggtggaatgaggattccctctagaagctgggaaagtatggcaaatggatttttctcttgagcctccagagaggaatgcagccctgctgataaattgtctttagctgagtgagacctgtgttggacttctaacctacaaaactgtaagacaatgaatttttattgtcttaagtcattgaatttgtggtgatttgttgtggcttcagtagaaaactaatacattatatacatgcactgaaatgtgcttatttattttttatgtcattgctttataaaaatagtaccatattataggactttactgaatcttttttcagcaatgccttacagaaatacaaattgtttgatgtcattttttttattgcaagtaaatttctccacatccttgccaatacttattttctgtattgtttttttgatagtggtcattctaatgggtctgaggtagtatctcattgtggttttgacttgcttttgtctaataattagtggtattgagcatctttccatgtgcttattggccatttgtatatcttctttggagaaatgtctattggagtcctttgcccgtttttaaattgggttgttttgttgttgttgtgtgtaggagttctttctatattctggatataaccaaccccttatcagacatgtgattaccaagtatcttttcctgttccatgggttgctttttctctcttgattgtgtcttttgatacccagaagtttttcatcttgatgtaatatatagtccagcttaccaattttttctcttgttgcttgtacttttggtgtcatatccagaaaatcatcaccaaatccagtgtcgtgaaattttgtcagcatgtgttcctctaagattttgatcattttaggtcttatgtttaggtctttgacccacttttaattaatgtttttatatggtgaaaggtaagggtcaaacttcatactacttttgcatgtgaatatccaattttcctagcaccatttgttgaaaagactgccctttccctgttgaaatggtcttggtacctttgtcaaaaattattgtgaggatttatttctgggttctacttctattccactagtctatatgtctttctgtatgccagtatctcagtgttgtgattactatagctgtgtagtaagtgtgagaccttgaacttgtttctccctttcaagattgtcttggctatttggggttccttgagattccatatgaattttaaggtagagttttctctttctggaaaaacatcattgggattttgacagagattgcattgaatctgcggataactttgagtagtattgacatcttaatatttttttccagtcaatgaacataggatgtctttttatttattggtgtctttaatttcttttagcaatagtttgtagtgttcagtgtataagagttttgcttccttaagtttattcctaagtattttattcttttctatgctattgtaagtagaattttcttaatgttccttttggattgttaattattagtgctttgtttgtttgtttgtttttgagatggagccttgatctcggcttactgcaacctccgcctctggggtttaagtgattctcctgcctcagcttctcgagtagctgggattacaggcacacatcaccatgcccggctaatttttgtatttttagtagagacagggtttcgccatgttggccgggctggtcttgaactgctgacctcaggtgatccactagcctctgccttctgaagtgctgagattacaggcatgagccagtgcacccagcatgttagtgttttttaatgtaaccatttttgtgtgttgattcataccttgcaactttgctgaattcatttattagttctaacagttttttcatgaattatcttgggttttctacataaaacatcatgcgatgtgtaaatacaggttgagtatcccttatctaaaatgcttgagaccagagcggtttggatttcaggttttggaatattcacatacacataatgagatgtcttggagatgggactcaagtctaaacacaaaattcatttatgttttatatatactttaaacaggtagcctggagatacttttatacagtattttaaacttgtgcctgaaacagttttggttgtgacccatcacatgaagccaggtgtggaattttctatttgtggcatcatatcagcactcaaaaaatttctgattttggatttttggattagggatgctcaaccagttttacttcttcctttccaatgtggataccttttcctttttttttctttcctaattgttctggctagaacttctatttctttcctaattgctctggctgaacttccagtattatattgattaaagtgaacatccttgtcttgttcctgatcttagaggaaaaacttccagtctttcaccttcacaccattagctgtgggcttttcatatatggcctttattatgttgaggtaatttccttctattcctagtttgttgaatattcttaaatcgtgaaagggtgctgaattttgttagataatttttctgcatcaatcaagaagattgtgttttttttttttattttgttaatgtgatacattatgttgattgattttcattatatagaaccatcattggattccaagaatgtctcccttggtcatggcatataatccttttcatgtgctgttgaattctgtttgttattattttgttgaggattttcacatcagtattaatcaaagataatggtttgtagtttttttatagtgtctttgtcaagctttagtatcaggataatgctggcctcagagtgagtttggaagtgtttacttcctcttcacgtttttggaagagttgagggaatattggtgttgattcttctttaaatgtttggtagaatttatcagtaaagccatctggtcctgggtttttctttgttgggagtaaatagatactttaaaaaaattcaccttttaaaattatttatacaaccccatccaaactttactacctatcctgcaatgtttattttttcctttatggtcatcagcccatccaagatcattgattgcttctaattgtcatgtctttttagtcttaatctatctggaagagttcctgcacctttctctatctttcatgaccttaccaatttagagagtacacacctttattctgtaagatgtctcttaacctgggtctgtcttgtgtttcctaatgttcagattcatgtcatatatttttgggagaaatacctcaaatgactgttgcatgcttctcactgtatgagatcaggaggcacatgctgttgacttagtccacaaccttggtcaagtggatatttgccccgtcaatcatttgtcttaagaagggcaaattgactggtattgtgagagcaggggaaaggagctatcataattttaccatgtcctcagaatctcctttcccacttgagatgtcctaatttaaggtcatcaagaattcgtattttaagaataattagaagtcatttaactttttaggcaagatgagatatgaaaaatttttgtatatgctgtgtggttagggtgaaggttagttggtttttcttttgcatatgctatccagttatttcatgcctgtatattttatttaaattttgctctaaaggttacaatttgtatatttaccacagtctaccttcaaattatattacattagttcattttcagtgtaaaaaatttttcaataatttctattttcctgtttttcctttgaaccatttttgccatacgttttatgtgtatgttagactatagatgatttttaaaaaatatattcctttacgtagactttaaacagttttcttttatatgtatatatattttttgagatggagtctcgctctgtcgcccaggctggagtgcagtgccacaatctcggctcactgcaacctccgcctcctgggttcaagcaattctcctgccccagcctcccgagtagctgggattcaccacacctggctaatttttgtatcttttagtagagacagggtttcaccatgttgagcaggctggtctcgaactcctgacctcaagtgatctgccctccttagcctcccaaagtgctgggattacagatatgagccaccacacctggcctacacttgtttttatggtttgagttttcataacaaacttccccttccacaacagataacacacaagtaagtttgtgtccttttttttttttttttgtctaaaataaattcagtgagtgggttccagctaataagatttagctatatgttaaaaaaatgtatatttgaaaataatctctcatagatgttggacctttagactaatatgcatcatatttgaattttctgattcttaaaggtttttgaaattggaaagtatgtttttgggtctttgaattaggttctttttttttttgctttttttttgagatggagttttcactcctgttgcccaggttggagtgcaatggcgcgatgtctcactgcaacctctgccttctgggttcaagtgattctcttgcctcagcctcccaagtagctgggattacaggcatatgccactaattttgtatttttagtagagacggcatttcaccatgttggtcaggctggtcttgaacccctaacctcaggtgatccacctacctcggcctcacaaagtgctgggattacaggcgtaagccactgcacccggcctaggttctttaattaatatatttttggtatttatgtaaaatgtttttctttttctcccccagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcaggtgagcaaataagacagcgttagctgggaataagacttttagagaaggtaatggttttatttgtaaagtatctttttgacacctgaaaataatttcaatctatgcttagctgtgttataactcagtttccacatttgcttgaattcttgccaaagataaacagttcatatttgtttattcttttgggggttttatgaggatacttccaaatagttaaatctgttttgatttgaaataacaaatagcatcagctatgtgttatgaaataacagctggtactgttatatttgttttgaaataacagctgatggtatttgttttcatgtgttctatttgggttatcaatagaatatcctttgtggttattttccaacatagctagacttgtgaaaatatttttcggaaaattctccaggttactaagaacaggatgatgataaaccagtgtgaaaaaatagaaaagggttggataaaggggagtgagagggggagaatgagagagaaggggctctcactaaattcatagaagtgccgcattgattaacattttatgtttatgtttcttttttattttccagctttattgatatatgattgacaagtaactatatatatttaaggtgtacaatgtgatattttgacatacatatacattgtgaagtgattacaacaatcaagccatttaaaataatcttacatggttaccttttttgtgtgtgtagtgagaagagttgagatccactctcagcgagtttcaagtatacaatactgtattattactatttttgagactggtgctctctctctctgtcacccaggctggagtacagtgatgtgatcacagcttgctccaaccttgaactcctgggctcaggtgattctcctgcctcagccacctgagtagctaggactatgggcatgttccaccatacttggctaattttattttatttttaagtagagatggggtctcactgtattgtccaggctggacaagaacagtattattaactgtagtcaccacactgtgcattagatctctagaacttactcattttgcataactgaaactttgtaccctttgaccatcatctccccatttttcccatccctttatgttccttttctaacccagggtggagtgcagtggtgtgatcatagctcactgcagccttgatctcctgggctcaagtgatcctcccacttcagcctcctgagcaggtgggactacaggtgtgtgccaccatgcctggctaacttttaaatttttagcagagaagagttctcactgtatcatccagtctggtctcgaactcctgagctcaggtgatccttctgccttggcctctcaaagtgctgggattacaggcatgagccggcacgcctggtgatttttttaaaagggtgaatctctagagtcccaagggcattgcagctctggttttataatttcatggtttttatcatttaattctttttatttgcatgttagatggcagattggctagaagtcttaagaaaatgtatggatcattgaaattggaaattattcccaaacagaccacagatatttctttgctcactcaatggaattaaagcaagaaaaaagtgaaacctgtttcagaactgcccatgaactatccagtgctatgtaactctttattcactgtcagtgcaattatggcagggattttatagtggtgaggagagtagtttagttatgtctgtttaaaaatgtttttgttgggccaggcacagtggctcacgcctgtaatcccagcactttgggaggccgaggcaggcggatcacttgaggtcaggagtttgagaccagcttggcaaacatgatgaaaccctgtgtataccaaaaatataaaaaattagctgggtatagtggcatgttcctgtagtcccagctactcagcaggctgaggcaggagagtcgcttgaatctgggtgttagaggttgcagtgaaccaagataatgctacagcattccagcctgggtgacagaacgagactccatctcaaaaaaaaaaaaaaaaaaagaaagaaagaaaaaataattttttttgtggcatgatacaaatatagtaaagtgcacatttctttatttttattttatttatttatttttcgagatggagtctcgctctgtcgcccaggctggagtgcagtggcgccatctcggctcactggaagctccacctcctgggttcacgccattctcctgcctcagcctcccgagtagctggggctacaggtgcccaccaccatgcccagctaattttttgtatttttttagtagagatggggttccaccatgttagccaggatggtcttgatctcctgaccttgtgatctgcccaccttggcctcccaaagtgctgggattacaggcgtgagccaccatgcctggctgtaaagtgcacatttcttacatgtgaaggtgtgcagctcagcaaaattttacatttacatagctctgtaaaccactgcccagatcaagatctagaacatttccagcatagtatgtctgtttttaatttacatcatatttattatgcagcttgtggggcaaattcactgctttgtgggtttactctgataagaatattaatcagtgtgcatttgaagaaatttaaattattttgaaatagtagaaacatcatcagaaggaatcttatttttggaattacatgggagcaaatagttttcatattgtgcccacaaacaattccttcttgctaatagaccttcttgtagcatgaggtaggagctctagctcttctgctggtagtccttcctggaggggttagtaagtttaataataatatatatctttgtaatgtgtggtgttttggttaaaacttttttttgccttaaaaattgttttgaaggaataagatggatttgtgaaaaaaaaaaaaaaactaacccttaaaaatttattgtttcaggaatacttcttatggataacagattgactttcattattaagctgttggtagttttgaatcattatttcttattttacattggtattctcattacagtgaaagtaatttttctcccaagtttaacgaaaaggatgggcatgttgagagaaagagcaagaatggcctgtatgagattgaaaatggaagaccgaggtaggtactgggagcagagcatcttacaataatgagtcaccaaaaagtagaaaagatagttcatatttatcaaatccttgtatgtgccagatgttgtacaaatttatttacatatgtgatgtaattaaatctgcacaataaccctgttggtggatatttttaattgaattttacagataagggaagagagtgtaagcaatttgtatacagctagtaagtggcagaggcagcgtttgaatgcatctttttgtaattgtatcttggaaacagaaataattgaatacattaacagaaagaaaaattgttcagcagatatttattaaatggtatagtatcttaaagtaagaatttatccaaacatgtaagagtaaaaataaagataacccaataattcgggtctttctatactttttaaaaaatgattttcctatacaactcaaaaattatccattttccttaagatattataaaagtgtatcagcctgttctcacagtgctatacagacatacctggccgggcgcagtggctcacgcctgtaatcccagcactttgggaggctgaggtgggcggatcccctaaggtcaggagtttaagaccagcctgaccaacatggagaaaccccatctttactaaagataaaaaatttagccaggcgtggtggcgggcacctgtaatcccagctactcgggaggctgagggaggagaattgcttgaaccgggaggcggaggttgcggtgggctgagattgcgccactgcactccagcctgggcgacagagcgagactccatctcaaaaaaaaaaatagacatacccaagactgggtaatgtataagggaaagaagtttaattaacttacagttctgcatggctggggaggcctcaggaaacctactgtcatggtggaaggcaagagagaagcaaaggtacatcttacatggcaacaggtgacagagagtgaataagtaaagggggaagagccccttataaaaccatcagattggccaggcacagtggctcacacctgtaatcccagcactttgggaggccaaggcgggtggatcacctgagatcaggagttgaagaccagcctggccaatatggcagaaccctgtctctactaaaaatacaaaaattagctgggcttggtggcgggtacctgtaattccagctactcgggaggctgaggcaggagaatcgcttgaacccaggaggcggaggttggagtgagccaggattgtgccgctgcactccagcctgggcaacagagtgagactccatctcaaaaaaacaaacaacaaaaaaaccatcagctctcatgagaactcactcactatcatgagaacagcatggagaaaccgtcccccatgatccagtcacctcccaccaggttctgccctcaattttcgagaattaaaatttgaggtgagatttgggtggagtcacagagccaaatcatattaaaaagttagaaagaagtgtaaaaattagcatgtaccaaataaaaccaaagaaggatcacagatttgaaatcatggttatcatcttataaaaatgttacactttgtattcttggttcctgtaagacaaggaaatggtagtactcctctcatctcaacctggtccttcagttttgctaagttctttctttggtcataacttattcacctttctatgttattgagtctttttaagtcaaattctccttgcatttgactgattccttaggttcttttatagatacaattataaaaatattatgaaaagataggtaagatatatagatggaaatgcaagatagattgttcttttaatgaagtctctttgactaatagaaactaactttagcttgcctgagcaaaagtaaaatttattttaaggctatgctataggaatgtctcaaggagctcaaagcaaaaatgcagctaacttgaggaaaagatggaattcgaaatccatcaggactctctctctgcttcatttatgcttttgtctatatttttggcttattactctctctttgcgaataaccatctgtgcttttcaggttttaatatagtctgtgtgtccattccagtttcctgtttccaagttatggtcttggtcatctatacaaactaatctgtctctttatggtggccttgatcacttgtgttcaggggtgtgtggttacatggaataaaatatggttgcaggccgggcatggtggctcacgcctgtaatcccagcactttgggaggctgaggcgggtggatcgtgaggtcaggagtttgagaccagcctgaccaacatggtgaaaccctgtctctactaaaaatgcgaaaattagctgggcgtggtggtgcatgcctgtaatcccagctactcaggaggctgaggcaggagaattgcttgaacccgggagacggaggttgcagtgagctgagatcatgccaccgcactccagcgtgggtgacagagtgagactctgtctcaaaaaaaaaatatgtatatatatatatggttgctggccactctgcccctcctcctgtgaatttggaaagaattattgtcagctgggcaggtgtcttgtctcttctttctgttgctatttgcaagtcttgctgaaatatttctgagtctagtacaaaaacaatataaaaattcattcaattttaataacagtcactgggaaaaaagaataaaaagagatggcaaaaagggaaattttggcaagttgtttatttactttcatatagtgggagggcaagagatacagcaccatgaagtagaattacatgttagaacattttagtagtacataatgaaagttgaacatttaaagaatgtttactgaaataaaatgacacaggcatgagtattgataggtttctctgacaaatttttaacactggattgtggcatcaggttaaatagttggcatttttataaaattgtattttagtctacttgaaatctatgaaatagtaatactaataccttatcatatgctacaaatatatattattgataataaaaatccagaaaccattgaggaaaaagggatttaatgtaacagggacaattttaataggaagggttgtaggagagtagagtaggaaatgagaataatgagaaagtgaagagagatctaggtgttccagaagaaaccaggaacgttccagtttgaatttaggagtataggtgaaaactgaaacaaatcatcacattgtagaaccacttggggtatgagagcctctttctggatcaagtttaaagcatatcacatgcgcaaaagaaaaattaaatagcagtgtcatgaaatacatgacttcagcaccagatatgtgatagttccattggatttgtaaggacttattctgtcttactgcttatgttctcttcttttgggttatatcaaatcaggttaaaaagatgaacacattcaattgattttatgctttttttgtttttccagaaatcctgcaggacggactggactggtgggccgggggcttttggggcgatggggcccaaatcacgctgcagatcccattataaccaggtaagaaccaataaaaagcatatcagtagcaaagagctaagtgatagaaaaattgcagactgtagctatgtttgtgtatatatgtatacctgtgtgtatatacatatgtatgtgtttgtatatatatgtatgtatacagtcatgcattgcttaacaatgaggacacgttctgagaaatgcattattaggtgattttgttgttgtgtgaacatcatagagtatatttacataaaactagattgtgtaggtgcaattgtataagtagtatacacctatgccatatgctatagcctattgctcttaggctacaagcctgtacagcatgttactgtactgaatactataggcaactgtaacacaattgtaagtgtatgtatatctaaacatagggaaagtaggtaaaaacacgatataaaagataaaaaaccatacacctgttttgggcacttaccctgaatggagcttataggactggaagttgatctgggtgagtcagtgagtggtgagtgaacatgaaagcctaagacattactgtcccctattgtagagtttataaacactgcatacttaggctacaccaaatttataaaaaatattttcattttgttaataataaattgaccttaacttactgtaacttctttataaacttaaacatttttaaaacctttttggcttttttatagtaacagcttaaaacacatcatgcaactgtacaaaaatagtttcttttgttacctccttattctgtgcactttttttaatttaaaaaaagttgtttcttctgtttgtttttaaactgtttgttaaaaactaagacacaaacacacacattagcctatggctatacaaggtcaggatcatcaatatcactgttttccacctccacatcttgtcccactggaaagttgtcaggggcagtaatatgcatggagctgtcatctcctatgataataacgccttcctcttgaatatctcctgaatgacctgcctgaggctgttttacagttaactttttttataagtagaaggaatatactctaaaataatgataaaaagtacagtatagtaaatacataagccagtaacatagtcacttattatcaagtattatatactgtatgtgattgtactcttatgactggcagtgcagtaggtttgtttacgtcagcatcaccacaagcatgtgagtaatgcattgggtgaggatattgacaatggcttatgacatcattaggtgataggaatgtttcagctccattgtaatcttatgggaccaccgttgcatatgtggtctgttattgaccaaaacatcattatgtggcacgactatacacacacacacatgcctgcacatgtatattacataaatatgcatgcagatgtatatataattgatattttaaagagactttatataaaatcatagtgatgcgatgtaagtataaagctgtacttatatgagtaggttaggcattatataaagaaggtaaattctatttatgcatctatttattgaacatctatttgttctcagcattgagtaggcactttggtaaatataaaaaattctaagaatcctaagctggttctctgtcactgaagagcaatggctttagttgcaagatggaaaatgtgaagtaagaaaacatgttaaatgtgatcaaataatatgggtgattcaggatgctttagaagattagaagattggatgtgggtcatgactgtggtaaactagtgcacccaagaaaggctttataaagcaggtagatttgagctgaacttgaaccttgggtagggagacagcaggaagcctaagaaaagggtttgtagtaatatctgagtagagaccagcttggttgaaacagaatattcttgtagaagagtagtgggcgaaaaatgaaacttaaagttaatttttgtgcagttttattgtggagaattttaaatgccaaagttaggagtatggactggagccattgaaggtttcagaacgggggagaggcattctcttccgaggcagacctatgtggtaagccaaatcatattcaagtctcttgatgagcatgaatcagaattaagaaggtcagtgaatctaatgtttagatatgcttagctatctccacaggaatcatctttctaatgtacctgaaatattgtcatatttgtcatccttttaatttttatttttttacttttagaatttctttgctgaccatctgtctccccacgtggaattgtcatgttctttctttaaataatgcaaatatcctcatattgttactttcttagttttgatattttgggggcttttcttcaaggagactctgtttttctttgatctgagatataataataatttgatagtttaactctttatatatttttttattttcaagttactggaagaggcacccattctcacccggtcttattttcttacttgccctcttgattctcctgccaaaaaggatctttacccaaccccaaattttatcttccctccatccatccatccacttactcacccattcacctacctacttacttaactactgatcagcctacctctccatccacatactgttagaacctctatggtttaaatgagatggaaagagttaataaaaaaaatattaatggcagtgttagtttctgattttggtgaagctggctaaaaacaggaaggtatgaaatgtttgaaacaggaatgtaatgctagtaaggggacaagagcagaaaagggaagccagagttttgaaggttagaatctagttagcttatctttatctatggtggacccaatagtggctgggagtatacatggtgattgtgtatcaagttgttttgaaatggtagacttttttagcttaactttgtcatacagataagagaactgaaggcttagagatggtccgaggctataagagagcccacaggtggcagagtctggctttcaactgtactcttaagttgatgttctttgttatctcaataatgcattaattaataattaatagtaatgcattaattaataaattgatgagttcctctaaatagatgagaggcagcagaaatggaacagagaagaatgaaagatgttgaaggaagattcaagccttagatgaattgttaaaagtattctacttttagactagtctattccaggcatcctgtcagtgctatcattagtttttctatttgtttttcacagaagcccctccaagtaggtattgatatatctattttgaggatttgaaaatagagactcactggggttaagttacttgcctaaatgttgtagatctgacatctgaatcaggggtaagtggctttaaatactgtactttttctgttacaccactagtgagtctttactatactgtactttttatcattgttttagagtatattcattctactggagaatcacccaggcactttcagagccaagatttcacccccctttctttcaagtatgcacttcatgattcaaaacagcgttgttcaggatttcataaactttttcagaagctccggggcaggtgttaaattttcggattcccaggcatctctcctagagattgtccaggtacaattatcaaaagtttcttcagatcctctagagtcaaaatgagttgggaagtgttaatatattattgtgaataaattcaggtcaaacaattgatgacaatttcattttctgttcacttttggttaaagacaggaaggtacatactgttagaactggggagggaatagcaatagggcatagaaatattactgatattcagtaaatgtttattaggttcgtcaattaaaatgatgtattagttctgttagatcaagaaattttgttttaaaattggtgataatgtatttaatactaataaataatatagcaagaagctactctgcttaaaatccatacatttgtccttcagaataaaatctgagaacatatgcaagctgctgatcatctctctgatcctgccttctccccagtagcatctctctctttttttttttttttgagatgggtcttgctatgttaccctggctggtcttgaactcctgatctcaagcagtcctcccacctcggcttcccaaagtgctaagattacaggcaggagccaccacactacacctggccagtggccagcatctctctctattctgtttctcatccttgtttcatagtcacaactggctggctgaagagcagtagctgtattgagtctttgttttcccagctccttgcatgtgatgtgtagtaggtgccagtaaatgtttatgagtgaacatagccaccatttgccttcttatctttcctttttttttttttttttttaagacagattctagctctgtcgcccaggctggagtgtagtggtgctatctcggctcactgcaacctccaagtgattctcctgcttcagcctcccaagtagctgggactataggtgcacaccaccccgcccagctaattttttgtatttagtagagacagggtttcaccatgttggccaggatggtcttgatctcttgacttcgtgatctgcctgcctcggcctctcaaagtgctgggattacaggcgtgggccactgctcctggccgtctttcctcttatctaattagtgtaaacattctgcttgttcagtttaagtagatagtatagtaattaagaacacagattctggaaccagattgtccaggttcaaagttgtgtttacgcccttgttaacactgtagtcttggggaagttacctaacttttctgtgcctcattttccatatctgtaaaataaagataataaaacaactatgttatagggttgttttgaggcttaaatggataaatacattaaagcacttagaacagtgttttatatatatataataaatgctatctaaatggcttttagaaaataaaaataaaatccatactgtcttctgtcctgtcatcatcttttacctggatcatagtagtagcctcccagctgatcttcttgagtccagtcttgctttcctccagaccaacatacatgcttttgtcaaagtgagtgagctttctaaaatacaaactggttatggttttaccctgcttaaaaacactctctggctctctaagtaaacgaattagatgaatcttgtcgtataagcctgttgcccacttttctggtctatcttttccctcactgatgcccatggtgctagaccccatatgaacattcagtttcttgaacacattattttattttatgactttgtttcttgcttatgtattcccctttctggcattttaaaaacagatgtgccctcttgtactaattattatttcatttctgtttaatatactcatcaaactatcacccttctgctaatttagagccactgctagactatgagctctttcatgggaggaactagatatggtagatatggtagtcagctactatataaggaaatttggaaactcatatgcatactaatattttattgggtttcatccagagtaatacttatatcatagaccttcttttttggtttagcattggaagttttttttttttttgttttgttttgttttgcctgagagatcattaggacaattcctaaaattgggctagaggttgatatggaggtgaggaaggggaaggggagatttattaatatcaacatctctggcaaagagagtgtggttagaaaaagtgtattctgaaactaacattgccttgatactttctacaaaacccataagcaattcaatttaaaatataaaataaaaggatagagttttttttgtttatcaaatcagagggcataaagattgagaagcagggccgggtggcttacacctgtaattgcagcactttgggatgccgaggtgggaggatggcttgaggccaggagttcaagaccagctgggtaacatagcaggagaccccatttgtaaaacaaaaaaaattagctgggcatggtggcccacgcctgtagtcctagctacacaggaggctgagacaggaggattgcttgagcccaggagtttaaggttacagtgaactatgattgcaccactgtactctagccttggtgacagagcaagaccctgtctttttaaaaaaaaaaaaaaaaagattgagaagtactgcttttgacaccagctaaactgggtcatataatctgcttttctcttagcacagggtgaactgttaaaagcaaattttttttttttttttttttttttgagatggagtctcactctgtcatccaggctggagtgtaatggcacgatctttgctcactgcagcctctgcctcctgggttcaagtgattctcctgcctcagcctcctgagtagctaggactacaggcacccatcatcatgcctagctaatttttgtatttttgtagaaacagggcttcaccatgttggccaggctggtcttgaactgctgacctcaggtgatccacccaccttggcctcccaaagtgctgggatttcaggtgtgagtcaccacgcctggcccaaagcaaatcttaccatgcctttttcactaccagtaattttttttttcttatttttagataggccctctctctgtcgcccaagctggagtgtagtggcaccatcttatctcagtgcaaccttaaactcctgggtacagtgacccttctgcctcagtctcccaagtagctaggactataggtgcatgccactgcacccagctaattttttattttttgtagagatgaggtcttccgttgttgcccatcctggtcttgaactcctgagctcaagcaattctcccaaagtgttgggattacaagtgcgagacactgcgcctggcaactaccagtaatttttaaaaggggattcgtaaacttattttttaaaaaactttgataaccttttctttaaattctattctgctacttctttttttgttaatactttaagtagtaaaaattgtttatatcctgaattttcattacagataatgtagtgtcttttatgtaatgtagacatttgtcctggtttgtaacagtgatgaatatagaatatttccagtaaaaatcaatagttttaaataaaactagctgatttgagataaatttatatatactctgctttaaagaaaaagtccttgtaactttatctcaagtttgagatagaaccttagtttttgttgtaaatccgttatgattttatattactattcacagatggaaaagggatagcagtggaaataaaatcatgcatcctgtttctgggaagcatatcttacaatttgttgcaataaaaaggaaagactgtggagaatgggcaatcccaggggtaagcattaaaattaaattagtgtttaagttccttttagttgctttacttactacagggttattgtttgtgaatcttttctattccattttcctctattccttcccacttcatttagtaattcttatgtttttcatccctgcatgaagtgtcattgtcagcaacaagtttaggataatccaagactgttagaatctgcgtgtaattctgacacctttgggaaataacgtgggctttgaagttagatgtaggtctgtgttctggccgttctacttgcagctgggtgattgggagttcaggccctcatctttaaaataaagagatctacttcacaggattattagagatcacatttaataggcattcattatgttgggtcccatttcagaatttaacctccactccaagcccaaggtagtatttttaagcactttttggttgaattctgataacttttgacaatatttaaaaaattagcttttgttatttactgttctgtgtagtttaaataatttctataatgttatcaagatgagtatacttttgttggcttgtagtttgaatttatggcagtggtatatttgaagtggccatttattttttattttttatttatttatttattttgagacagagtctcactctgttgcccaggctggagtgcattggcgcaatcttggctcattgcaacctttgcctcctgggttcatgcaattcttgtgcctcagtctcccaacgtagctgggattacaagtgtgtgccgctatgcctggctaatttttgtaattttagtagagacaggtttcactgcgttggccaggctggtctcgaactcctggcctcaagcaatctgcctgccccggggcctcccaaagtgctgggattacaggtgtgagccaccacacctggcctgaagtggccgtttaaaatgtttatgtgtgtggtagagggttttatattttataccatattgtgaaatggagatagtttgatatgaggatgactctttataaaaacatacagttgtctgcaagaatgtttttttctgtgtagaataaaaatgagtggaaataaggatctcagccgactctgataaaagtttaggctaatttctttttctttttcttttttttttttttttttttgagacggagtctcactctgttgcccggctggagtgcaatggcatgatctcagcttactgcagcctccacctcctgggttcaagcaattccctgcctcagcctcccgagtagctgggattataggcgaccaccaccacacctagctaatttttgtatttttagtagagacagggtttcaccatcttggccaggctggtcttgaactcctgacctcgtgatccacccaccctgacctcccaaagtgctgggattacaggcatgagccactgtgcttggtgaactttaggctaatttctatgagccaaatagtcaaacttcacttaggttgaaagcaataacgtaataatgatttcatcatagaatcttgcatttttattgttatttaaaattcttatcaggaaactgctgtcattgttatcattttgacagttattcatctaatcagtgtatttttagtatcttccttttgtcagctaatattttagacactgagaatacaacagagcaacatgaacaaataacctctgtcttttggtgctcccattccagttggagagacagataatataagatacataagttaaatatatcgcatgttagaaggcagtaagtattaagaaacaaaagcaaggtagaggactaggaagtgtttgagagtttgcgattttagacagggcagttaagagaagacctccctgaggaggtgcatgttaggtaactatctgaaggaaatgaattagtgaaccatgcagatatctagagaaaagcatcttggatagagataatagcaggtacaaaggctctcagcgggcagcatgttaggcaggtcctgggaacattgaggaggtcagtgtggctggaatggaatgaacaatgggggaagaatcaatgtgctgtgttatttctaacctccagtcctttttccttagttcgagtttggcaagtaccaggaaattggtttgattgccataggctaaccttggaccaatcactgtggccaaatacatgaggtatccttattggctccttctactagcaacagatggtttagagaacagtgtatcacagagaaatggggatcactattataggcagattgaataataaatgttcactctactactcaataaatatttgttgaacaaatcaaagctgatcccttttttcaaaatttttaatgtgactcttaggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtggtaagaaatagtgtttctgggagggatttagttctgtggattgatgaaaatgacttaaaagttgacctggaaatctgtatgtccttctctaaataaagtggaatacttgtatatttaaaatatattcacaaaaacaaattacagatcttcactgtaaataggtttctatttaaagttttatagcccaactttaggctatataggctaaaatgatatatatttagttcatttatatcatttattataataacttttttcttcttagtttttctttcttttttttttgagatggagtctcgctctgtcacccaggctggagtgcagtggcacgatcttggcttactgcaaccttcacctcccaggttcaagcaattctcctgcctcagcctctggagtagctgggattacaggcttccaccaccacgcccggctaatttttgtatttttagtagagacagggtttcaccatgttggccaggctggccttgaactcctgacttcaggttacctgcccgcctcggcctcccaaagtgctgggattacaggtgtaagccaacacgcctggcctgtaaactattttctttcacgttgagtacccatccaacagaaagctttttgtatgtgcatgaattcagctctctctgaaagaacatttacattttaaattatgtcatacagagatttttctggttgataatcatttaagtctcatgtctgttttgtccatataccctctgtgatagggtcttgctctgttgttcaggctggagtgcagtggtgttatggctcactgcagttttgacctcttgggctcctgtgatcctcccacgtcagtcttctgggtagctgggaccacaggcaaacaccaccgcactgggctaattttttgttttttgttttatagagatggggttttaccatgttgtccaggctggtcttgaactcctgggctgaaggatccccccacctcgacctcccaaagtgctaggattacaggtgtgagcctggcattccgtgcttttaaaaaaataccttacaaggtatatgcacactaataataagaaaataacagagttttttttttttttttttttgagatgaagtctcgctcttgtccccaggctggagtgcaatggcgcgatctcggctcactgcaacctctgcctcccaggttcaagtgattctcctgcctcagcctccagagtagctgggattacaagcatgtgccaccatgcctgactaatttttgtatttttagtagtgacggggtttcaccatgttggccaggcaggtcttgaactcttgacctcaggtgatccgcctgcctcggcctcccaaagtcctgggattacaggcgtgagccaccgcacccggcctttttttggtcagtttttatttggattgcttgttttcttttcagaattgggatttagttatttatgttgtccagatttttttgagttacgtttgtgctagatgaatagatccaaatatcttcatatattaatagcttaagtagtaatctttagttttatttatagatctcctttgtttaactagaagaatctacctttgtatttcagaaactataatcacagaaaaatacttaagtgatggactcttaaaaaatcatattgcccaaatttgactgttctcagattctgaaattagagtttgaagtgttgagggtttcatgatttatttatttgttttgagacagtgtctggctctgtcaccaggctggagtgcagtgatgcgatctcggctcactgcaacctctgcctcacgggttcatgcgattctcctgcctcagcctcctgagtagctgggactacaggtgttctccaccatgcccagctaatttttgtgtttttagtagagacgaggtttcaccatgttggccaggatggtcttgatctcttgacctcatgatccgcccacctccgcctcccaaagtgctggtattacaggcatgagccaccacgcctggcctgagggtttcatgatttttaaagctgcctcaaaagagaatattgttctttgggaaatttgaaacaagcacatgaagtactacattaaaagttttatgatatttacatttctttctttttttctttctttctttctttttttttttttttgagacagagtctcgctgtgttgcccaggctggagtgcagtggcgcgatcttggctcactgctacctccacctcctgggttcaagtaatttctcctgtcttagcctcccgagtagccgggactacaggcacctaccaccatgcatggctaattttttttgtatttttagtagagacagggtttcaccttgttggtcaggctggtctcgaactcctgacctcaggtgatccacccgcctcagcctcccaaagtgctgcgattacaggcgtgagccaccgcgcccggctatttacatttctttaaaaaaattttgatagaaacacataatgtcaaatttaccatctaaactgttgaaggtacagctcagtagcattaagtatgttcatgttgttgggcaacaggatatttacatttctgatgctagtgaaggtaacatgctctgctgtactcactacaccttggacttttaaaaaatttgtcttcttttgaaaatagatatataagggatatgttgatgatcctcgaaacactgataatgcatggatggagacagaagctgtgaactaccatgacgaaacaggtaactttatatttattaaactggctgggattaaaggatcaatttaagccattagcccactaaggcatgattaaatctggactatttagcatcttaaaccaattaactgttgattgtaggactgtagttatatgaaagcaaaattgttggtattaaaggaatacatagaagaaatcttcaaaacttttatcaccagtgactaaattttctttaatccattggtaacatttgaaattaaggatgaaattatgggctaaaatgatatgctttaaagatgtcagattatttattgagtatagttccctttttttgcaaaacaaaagcaactgggatttgggtaggaagtatggcaatgataaaggaaatgggatttatatcttactatttcaaatatttttataataatcttggattgttaatacacaaagcaataacaaaaaattccaagtactgaaaaaattttaaatgaatgctgtttctggtgtatggaatttaaaattttatgaggagggtcaaacctgttattacagaaggagaaaggaaaaatctgctgtcttaaaaattaatttggtcttaatgtacacattgaatggctcccttgaaacatattttattgctaaatttgatttgtttttatttgtagcataaaagtgggggcaccatgctagagaaatgaaatgaatgttccactcatagttctttctgagctgtgtaaccttgtacaaatcatttgtcctcttggactcagttttttcacttacaaaatgggctagaactagatctgtcatttccatatcctgtgcttttgcttgttgaacttggaggaaactcctgggaccattttctattcctgtatttccactaaggtgtattagaagagtttatcctagtatgaaaacttagaagaaatatgcagatgtaaattagaagcaggtctgtacaactttagtactgataaatttgttaactactttaaagttttggagttaaaaacaatgactgatcctccagaagttgattatagagtttatggattgttcactgtttttaccctatctttttctctctttaaacttaaaaaattttgttttgataattccaaaatctctgccatatttgagttcggttttaatatttgctttgtttctttaggctatgttttttgccttttagcgtgcttttagtgcttttttttcttttttctttttttttttttttaaccccgagatggagtcttgctctgtcacccacgctggagtgcagtggcatgataatggctcactgcaacctctgcctctcgggttcaggcgattctcctgcctcagactctcaagtagctggtactacaggcatgcaccaccatgcctggctaatttttgtatttttagtagagatggggtttcaccatgttggccaggctggtctcaaactccttacttcaggtaatccacccaccttggcctcccaaagtgctgggattacagtcatgagccactgcgcctggctgtagtgcttttttgaaaattgaccatgatataacttgtaagggaactaaggcaaatagttctttagcgtgaggttttatgtttatctggctaggagttaggctgtgttttttgtttgctgtcattgtatgtgtcagaggctaaaatttcctctagttttgggtttccctggagacttattaaatgaggtctgaagcatgcccttctttcagctgtcttccccttttattaaacaggagtcctattgatagatatggtggtaaattctagaggaaggggaatcataggagaatatatggttagatgtcagtcttttagtgagcctgtggccctgggctgtgacccttcatatgttattctcagcttccctccttcctccccaatccttaggaaagacaggaaatccagcgggggctggagttgggtatttcctttccctcaggttgcttagggcttggtaaaatagttttccttgagggcagagtgatctgggtgtatttgaaattggttacctttcccctctccatgttagaaaggagagaggatttttctccagtcttcacctggtggctttcttggaggtaaagctcactaaaatgtaggccccctcttcatactggtatggctgaccccctaggagattttatctttcaagctagtccaaaggtcagctttcagcagttagttaccctttaagtgttcctaccaggtgctgactccagcggtaggcttctctccctggtcagttgtgattctctgtatttgcctgtctctccagtttttggtatggcagtgtggtctctactaagaatacaaaaaaattagctgggcgtggtggcagatgcctgtaatcccaggtactcggggggctgaggcaggagaatcgcttgtactcaggacgcggaggttgcagtgagccgtgattgtgccactgcacttcagcctggtcaacaacagcgagactccatctaaaaataaataaaataaaataaaatatttaagtaatgttgccttgaatactttaataggcttgtctctatttcatcagaataaattcttcaaagaggaattactggattgcttattgtatcttcagtgcctagtacagtctggcacacaagatgcactctgatatttacagaatgagtgcttgtcaaagaaaacttactttttaaaagctcttgataaacattgccaaatttcctacagaaatattccatttatattcccagcagtgattgggagcacttattttttatttttttgataatttaaattttttttttttttttttgaggtggagtctcaccctgttgccaggctggagtgcagtggtgtgatcttggctcactgcaacctccacctcatggattcagacaattctcttgcctcagcctcccaagtaagctgggactgcaggcatgtgccaccactcctggctaatttttgtatttttagtagagatggggtttcaccatgttggccaggctggtctcgaactcctgacctcaggtgatctacccgcctcagctttgtttatttttttacatttaaatctctcatccctcttggactgattttgatgtaaggtttcatattcatgtaatataatctcgtttttaaggataatctttttagagaaaactctttgtgtttatctaaaatttagggacttggttaaaatttggacattttggaatactctagttttttttcttttattcattctgctgaccagggatggaatggtctagtttttaattcacttggccggctagtacaatgatgatataagattattttaaataagaatacttgacgacatagatatgctaaaacagaaatgagtttttcttggtgatggtttttctttggcaaccaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataacttctgtttcatctagttcttgtttgtcaatgccttccctcccgctccccatcttctgaggcctgaaggatgttcctgccacatcaaactcctttaggcagagtaccgccactggatgtatagtttaatgtttcatctgatttttctttaaattatttccttcacattttgcttcacatgatcttgttgaagctaattttgaaaatggaaactatgttttcttgactttagaagcattagttttaagaggaaatttcagccactagtcaatagagatcaaaatcagtgaacaagagctgatactctcattttcaaaaattctgaattaaaaaaagtccaggaagttagtaatttaaatcagtatgttcatttcactctagtgaaactactatatgttgtaaattagttaaaaatggatgttcagaaaagaattgaaatcaggacaaaaaattacagatgctagtgaggttgtagagaaaaaggaatgcttatacgctgttagtgggagtgtaaattggtccaaccattgtggaagagagtgtagagagtcctcaaatatttaaagatatttgacccagtaatcccattactaggtatatacccgaaggaatataaattgttctattataaacacatactcacgtgtatgttcattgctgcactattcacaatagcgaagacatgaaatcaacctaaatgttcatcagtgatagactggataaagacaatgtggtatatgtacaccatggaatactatgcagccgtaaaaaagaataagatcatgtcctctgaaaagacatgggtggagctggaggccattatccttagcaaactaatgcaagaacagaaaaccaaacactgcatgttctcttataagtgagagctaaatggtgagaacacatggacatgggaacaacacattctggggtctattggagggtgggaggagggagaggatcaggaaaaataactaatgagtactaggcttaataccttggtgatgaaattatctgtacaacaaaccctcatgacacaagtttacctatgtaacaaacctgcacatgtacccctgtacttaacaacaaaataaacacaaaggaaaatgtt

SEQ ID NO: 38359 - DNA, 85077 bp, Homo sapiens
ctaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggtgagtggacagaggaccccactgcccgcgggacatcccctggccctcatgcctgccctgccctcttgggaccccaccactgagccctccctgccaggccttcctctgagcagtgacatggaactgccctctcaaagggggatccaggccccagactatgctggagccaggaggcttgctgggggggcccttgctgcacctcagagccccacaccctcttctattcaagtgcattcccggtactcgcctggcattgtagttatgagcacggacttgggagtcaggcactatcaccagtcctggcactatcaccctgggccaatcacttcactgctctctgcctatttctctgtctgcaaaatgggagagtgagagcccgcctccctgggctgtgtgagggttaaaagagatcatccaggttaaacatttagcacagagtctgatatacagtaagtgctcaataaataagatctcccattgctgttgttgctgctgctgctgctgctgttattattactattagccaccctgggttgcagatgccgttggcccaataaagcacagctgaggctcagtaggagtagtgatttacacagggagatagtcaggaccaagacagatatgcaaatttcctgatcctagatgaggattttttgcctagcagtatctataagaacatcattcttcagacaagcctctagaggaagttgtagagggctgcagcgggttcactggtgtatcctgacctctcttggttgagagaggagaccagctcagttccctggcaccttgcccctgcccctctgatgtgtctccaacctctttgtctctttcctgtaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagaggtgaggcttgctgaggcaggctgacagccctgggtggagctgtgaatcagctggtgggccccacccagaggatcatgtctgtgcatggggacctgacatgggggacagcagaggaaggataggggagccaggatgggctgtgagaggtaggcctgaaattgatctttcagggaccttccggtgctgagattgcatccctccccatgtggcagatggggaagctgagacccatgtgggtcaggcaatgagtcttccccaactgggtgcccaactcgtgacatggtccttgcccgagaactcagctcataatattgatgggctctgaagatccttagggtcagggtggtccagaagttccaaggaggactctgttttccagacagaccccaagaagaggctaggcttagtcctcggcccaagccagctccctcacatgacttctctcttcactactaagagaataaaattgcccctctacttcaacatggttttcaaaataatattattaagacccatctctcaggactgttgtgagagtttaaaatatatgcacctaaaagaaaataaatgttcagtaaatggttatttttcttttcattccccccagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacaggtgagaccctactgagctcctggcggggtggtgaggtgggagaggcaaatgtatggacaaagagtcccctggggaccaggttggcaggctaagcagaggttctggaaaacatctgaaatttccctcaggaaatcccacccttggagcctctccactggtccaaggcactgtttccaggaggcacctggacattaaaatacagatgtgttacccagcacatctgggggacaacagagcaaggagaggggagcctggatggggttacacatcacctggtttactggacagggcactggcctggggtcaggagagctgggttcaatttccactgagctcctcaccccacaagtggcctacagctagtcccatgcccatcagtgctcactggacactctctgggttagaccatgtccagggctttacgtgtacattggacttaaattttacaaccactccgtgagataaatattgctattatcataccctggagatgagaaaaccaaggattaaaaagatagtctcacagttagtactagcaaagatggaattcagccttcactctctctcacgcagcaatccacacttttaactcttacacagggagtgccctcatctgggcaataaggacagtcatactaaagccacaggtacagaggctcctgatgccacaggttccttaaccactgaaccatgctgcctctcaatgccggaggatgcctcctttgaaatctgagaggttttaagttaaaaggatttcttctgcacccagcaaggagtgaacttgtagattttgtggtcgtatatggcctaggctcaaagtatatcagtttacttaattactcacaccacttgccattcaaaaaaagaagccatgtaacaaacctgcacatataccgcgtgagtctaaaataaaaaataaataaactcatgttttaaaaatcttgatagggtatataaggaaagatcaacattcgagttaaactaaggaaaacagaaagtcaagaaaggaagattctaatactttaagttgtttctttctatatttgagaatcacaaagataactttttctcagaattattttgtgaattaaaaaatccaaacaataaagacaattaaaactgaaaaacagaaaagaaggaagataggaagaatataaagacatatcagagccatctatagaagcataaaaatgcagtaactttaaaagtgaaaaaaacaagtatgaaaaccacaaagactacctcattgctataaataaagtttccatcaattgtgggcattctagcaacactggcaaaaggggaaatataatgggttacacaatacctgttactcaatagaaaagaccaatgcaagggaaataacatttttccctgattctaaattctaagggaattcttcaaatagggaacttaaaaaaaaaacaacaacaaacttttattttagtttcagaaacacatgtgcaggtttgttatataggtaagttatgtgtcacaagtgtttggtgtacagattatcttgtcgcccaggtaataagcatggtacctgttaggttgggttttttgtttgtttttgtttttgttttttgtttgttgttttttgttttttgttgtgttttgttttgagacagagtcttgctcggtcacccaggctggagtgcagtggcgtgatctccactcactgcaagctctgcctcccgggttcacgccattctcctgcctcagcctcccgagtcgctgggactacaggtgcccgccacgaagccctgctaattttttgtatttttagtagagatggggtttcaccatgttagtcaggctggtctcgaactcctgatccgaggtgatccacccacctcagccacccaaagtgctaggattacaggtgtgagccaccgcgcccggcccggtagttttttaatccttacccttctcccactcttcactctcaaaaggtcccagtgtctattgttccttttatgtgtccatgtgtacgcaatgtttacctctaacttatgaatgagaacatgcggtatttcattgtctgttcctgtgttagttcacttataatgctctccaactccattcaagttgctgcaaaggcatgacctcattcatttttatggctgtgtagtattccatgtgtaaatgtcccacattttctttagcagtatggttgattccatactggtgctattgtgactagtgctgcaataaacatacatgtacatgcatctttatggtagaatgctctacattcctttgggtatatacccaataatgggattgctagattgaatgatagttcagagttctttggcaaatcgcgaaattcctttccacagtggctgaactaatttacattcttaccagcagtgtataagtgttcctgtttctctgcaatctcaccaatatctgttattttttgacttttaaattatagccattctgactggtgtagaatagtacctcattatgggtttgatttgcatttttctttttttccagagaaggtctctttttttattctattctggccttcaactgatggaatgagagccacccacatcagggagggtgatcttattttttttttttttaatactttaagttctagggtacatgtgcacaacatgcaggtttgttacatgtgtatgcatgtgccatgctggtgtgctgcacccattaactcatcatttacattaggtatatctcctaatgctatccctcccccctcctccaaccccacgacaggccctggtgtgtgatgttgcccttcctgtgtccaggtgttctcattgttcatttcccacctatgagtgagaacatgcggtgtttggttgtttgtccctgcgatagtttgctgagaatgatggtttccagcttcatccatttccctacaaaggacatgaactcatccttttttatggctgcatagtattccatggtgtatatgtgccactttttcttaatccagtctatcattgatggacatttgggttggttccaagtctttgctattgtaaatagtgccacaataaacatacgtgtgcatgtgtctttatagcagcatgatttataatcctttgggtatatacccagtaatgggatggctgggtcaaatggtatttctagttctagatccttgaggaattgccacactgtcttccacaatggttgaaccagtttacagtcccaccaacagtgtaaaagtgttcctatttctccacatcctctccagcacctgttgtttcctgactttttaatattcaccattctaacttgtatgagatggtatcccattgtggttttgatttgcatttctctaatggccagtgatgatgagcattttttcatatgtctgttggctacataaatgtcttcttttgagaagtgtctgttcatatccttcacccactttttgatggagttgtttgtttttttcttgtaaatttgtttgagttctttgtagattctggatattagccctttgttagatgagtagattgcaaaaattttgtcccattctgtaggttgcctgttcactctgatggtagtttcttttgctgtgcagaagctctttagtttaattagatctcatatgtcaattttggcttttgttgccattgctttgaatgttttagacatgaagtccttgcccatgcctatgtcctgaatggtattgcctaggttttcttctagggtttttatggttttaggtctgacatttaagtctttaatccatcttgaattaatttttgtataaggtgtaaggaagggatccagtttcagctttctacatatggctaaccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcagatagcatgatgcctccagctttgttcttttggcttaggattgtcttggcagtgcgggctcttttttggttccatatgaacttttaagtcgttttttccaattctgtgaagaaagtcattggtagcttgatggggatggcattaaatctataaattaccttgggcagtatggccattttcatgatattgattcttcctatccatgagcatggaatgttcttccatttgtttgtgtcctcttttatttcattgagcagtggtttgtagttctccttgaagaggtccttcacatcctttgtaagttggattgctaggtattttattctctttgaagcaattgtgaatgcaagttcactcaagatttggttctctgtctgttattggtgtgtaagaatgcttgtgacttttgcacattgattttgtatcctgagacttcgctgaagttgcttatcagcttaaggagattttgggctgagacgatggggttttctaaatattcagtcatgtcatctgcaaacagggacaatttgacttcctcttttcctaattgaatacgctttatttctttctcctgcctgattgccctggccagaacttccaacactatgttgaataggagtgatgagagagggcatccctgtcttgtgccagttttcaaagggaatgcttgcagtttttgcccattcagtatgatattggctgtcggtttgccataaatagctcttattattttgagatacatcccatcaatacctaatttattgagggtttttagcatgtagggctgttgaattttttcaaaggccttttctgcatctattgagataatcatgtggtttttgtctttggttgtgtttatatgctggattgcatttattgatttgcgtatgttgaaccagccttagcatcccagggatgaagcccacttgatcatgctggataagctttttgatgtgctgctggattcggtttgccagtattttattgaggatttttgcatcaatgttcatcagggatattggtctaaaattcctttttttttgttgtgtctctgccaggctttggtatcaggatgatgcttgcctcgtaaaatgagttagggaggattccttctttttctattgattggaatagtttcagaaggaatggtaccagctcctccttgtacgtctggtagaatttggctgtgaatccgtctggattggtaggctattaattattgcctcaatttcagagcctgttattggtctattcagggattcaacttcttcctggtttagtcttggaagggtgtatgtgtccaggaatgtgtccatttcttctagattttctagtttatttgtgtagaggtgtttatagtattctctgatggtagtttgtatttctgtaggatcggtggtgatatcccctttatcatttcttattgcatctatttgattcttctctcttttcttctttattcgtcttgctagcggtctatcaattttgttgatcttttcaaaaaaccagctcctggattcattgattttttgaaaggttttttgtgtctctgtctccttcagttctgctctgatcttagttatttcttgccttctgctagcttttgaatgtgtttgctcttgcttttctagttctttctattgtgatgttagggtgtcaattttagatctttcctgctttctcttgtgggcatttagtgctataaatttccctctacacacagctttaaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgaatggtctgagagacagtttgttataatttctgtccttttacatttgctgaggagtgctttacttccaactatgtggtcaattttggaataagcgcaatgtgtgctgagaagaatatatattctgttgatttggggtggagagttctgtagatgtctattaggtcccttggtgcagagctgagttcaattcctggatatcctttttaactttctgtctcgttgatctgtctaatgttgacaggggggtgttaaagtctcccattattattgtgtgggagtcttaagtctctttgtaggtctctaaggtcttgctttatgaatctgggtgatcctgtattgggtgcatatatatttaggatagttagctcttcttgttgaattgatccctttaccattatgtaatggccttctttgtctcttttagtctttgttggtttaaagtctgttttatcagagactaggattgcaacccctgcctttttttgttttccatttgcttggtagatcttcctccatccctttattttgagcctatgtgtgtctttgcacgtgagatgggtttcctgaatacagcacactgatgggtcttgactctttatcccatttccctgtctgtgtcttttaatcggagcatttagcccatttacatttaaggttaatattgttatgtgtgaatttgatcctgtcattatgatgttagctggttattttgctcatgagttgatgcagtttcttcctagcattggtggtctttacagtttggcatgtttttgcagtggctgataccggttgttcctttccatgtttagtgcttccttcaggaactcttttagggcaggcctggtggtgacaaaatctctcagcatttgcttgtctgtaaaggattttatttctccttcacttatgaagcttagtttggctggatatgaaattctgggttgaaaattcttttctttaagaaagttgaatattgccaggcgtggtggctcacacctgtaatcccagcattttgggaggccgagatgggcagaccatgaggtcaggagatcgagaccgtcctggctaacatggtgaaaccccatctctactaaaaaatacaaaaaaaattagccgggcgtgatggcgggcacctatagtcccagctgctcaggaggctaaggcaggagaatggcatgaacctgggaggcggagcttgcagtgagccgaggttatgccactgcactccagcctgggtgacagagcgagactccatctcaaaaaaaaaaaaaaaaaaagaatgttgaatattggcccccactctcttctggcttgtagagtttctgccgagagatccactgttagtctgatgggcttccctttgtgggtaacccgacctttctctctggctgcccttaacattttttccttcatttcagctttggtgaatctgacaattatgtgtcttggagttgctcttcttaaggagtatctttgtggtgttctctgtagctcctgaatttgaatgttggcctgccttgctaggttggggaagttctcctggataatatcctgcagaatgatttccaacttggttccattctccccgtcactttcaggtacaccaatcagatgtagatttggtcttttcacatagtcccatatttcttggaggctttgttcgtttctttttactcttttttctctaaacttctcttcttccttcatttcattcatttggtcttcaatcactgataccctttcttccagttgatcgaattggctactgaagcttgtgcattcttcacgtagttctcgtgccatggttttcagctccatcaggtcatttaaggacttctctacactggttattttagttagccatttgtctaatcttttttcaaggtttttagcttctttgtgatggattcgaacttcctcctttagctcggagaagtttgatcttctgaagccttcttctctcaactcatcaaagtcattctccgtccagctttgttccattgctggcgaggagctatgttcctttggagggggagaggcgctctgatttttagaattttcagcttttctggtcagttttttccccatctttgtggttttatctacctttggtctttgacataaagatggggttttggtgtggatgtcctttatgtttgttagttttccttctaacagtcaggaccctcagctgcaggtctgttggagtttgctggaggtccactccagaccttgtttgcctgggtatcagcagcagaggctgaagaacagcgaatattgctaaacagcaaatgttgctgcctgatccttcctctggaagcttcgtctcagagaggtagacggctgtgtgaggtgtcagtctgcccctacttgggggtgcttcccagttaggctactcgggggtcagggacccacctgaggaggcagtctgtctgttctcagatctcaaactccatgctgggagaaccgctgctctcttcaaagctgtcaaacagggacatttaagtctgcagaggtttctgctgccttttgtttggctatgccctgcccccagaggtggagtctacagaggcaggcaggcctccttgagctgcggtgggctccacccagttcaagcttcccagctgctttgtttacctactcaagcctcagcaatggtgggcacccctccccccgcctcactgccgccttgctgttcaatctcagactgctggctagcaataagtgaggctccgtgggtacaggaccctctgagccaggcacgggatataatctcctggtgtgccgtttgcaaagaccgttggaaaagtgcagtattagggtgggagtgacccaattttccaggtgccatctgtcacagcttcccttggctaggaaagggaattccctgaccccttgcacttcccaggtgaggcaatgcctcgccctgctttggcttatgctcggtgggctgcacccactgtcctgcacccactgtctgacaagccccagtgagatgaacctggtacctcagttggaaatacagaaatcacctgtcttctgcgctgctcaccctgggagttgtagaccggagctgttcctattcggccatcttggaaccaccccaatttgcattttgctaataataagtgatgttgagcattttttcatatgctgttggccatgtgtatgtcttcttttgaagagtctattggtgtcctttgtccacttttttttttttttttttctgagacaaagtatcacactgtcatccaagctggaatgcagtggtgagatctctgctcattgcaacctccacctcacgggctcaagggattctcctgcctcaccctcccaagtagctgggattacaggtgtgcaccactacgcccagctaatttttgtattttttagtagagatggtctgttggccaggctggtctcgaattcctcacctcaagtgatctgtccacctcagtccccaaagtggtaggattacaggcatgagccaccatgcctggccatttgtccactttttaatgggattgtttttggcttattaatgtgtttaagttccttatagattctggatattccaactttgtcagatgggtagtttgcaaatattttctcccattctgtgggttgtctatttactttgtgggtagtttcttttgctgtgcagaagttctctagtttaattaggtcccatttgtcaatttttgttttcattgcaattgtttttggcatcttcctcatgaaatttttgccaggacctatgttcagaatagtatttcctaagttttcttcaagggtttttaaagttctaggttttacgtttaagactttcatccatcttccattgatctttgtatatagtatcaggaaggggtccagtttcagtcttctgcatatggctagccagttatctcagcatcacgtattgaatagggaatgctttccccattgcttgtttttgtcaacattatcaaagatcagatggttgtagatatacagctttatttctgggcattttattctgttccattggtctatgtgtctgtttttgtaccagtagcatgccgttttggttactgttgccttgtagtatagtttaaaaataggtaatgtgatgcctccagatttgttattttttacttagaattgctttggctatttgggctgttttttggttccatattaattttagaatttctttctcattatgtgaagaatgtcattggttgcttgctaggaatagcattgaatctgtaaattgcttggagtagtatggcgattttaacaatattgattattcctattcatgagcatggaatgttttccatttgtgtgtgtatcatctctgatttctttcagcagtgttttgtagttcttgctatagagatctttcacaatcctggttagatgtattcctaggtacttttttgtggctattgtgaatgggattgcattcttgatttggtgcttattgcacaatgttacataatacttactacccaatagaagaaattgattttgtatcctgaaactttgctgaagttgtttattagatctagcagatttgggacagagactaggaggttttctaggtataaaatcataacatctgcaaacagagatactttgacttcctctcctcctatttggatgtcttttacttctttctcttacctgattgctctgggtaggacttctagtactatgttgaatagatggtgagaatgagcatccttgtcttgttctggttctcaaggagaatacttccagcttttgcccattcagtgtgatgttggctgtggttttgtcataaatggcccttattattttgaggtatgctccttcaatgtctagtttgttgagagttttaacattgaaggatgttgaattttatcaaatgctttttctgcatctattgagatgatcatgtgggggcttttttacttctatttatgtgatagatcacatttattgatttgcatatgttgaatcaaacatgcatcccagagataaaacctatctggttgtggtgaattcgctttttgacgtgctgctggattcagtttgctagtattttgctgaagatttttgcagctatgttcatcacagatattgtccttaagttttcttcttttgttgtgtctctgccaggtttcggtatcagaatgataccaaactcatagaatgatacctaactcatagaatgagttagagaggagtcccctcctcctcaattttttggaatagtttcagtagaaattgtacgagctcttctttatgtgtctggtagaattcagctgtgaatctctctggtcctggcctttttctggttgttagaatttttattactgattcaattttagaactcgttattgctctgttcagagttttaatttcttcctggttcagtcctaggaatttatttcttgtaggtttttctagtttctgtatatagaggtgttcgtaatagtctctgagggttttttatatttccacggggtcaatggtaatgtcctctttgtcatttctggttgtgtttatttggatcttctgtcttttttttttctttattagtctagctagtggtctatcgatcttatttattcttccaaagaatgaacttttggttttgttgatcttttgtatggttttttccatctcaattttattcagttcagctctgattttggttatttcttgtcttctgctagctttgggattgatcttgctcttgtttttctaattcttctatttgtgatgttaggttgctaatttgagatttttctaactttttgatatgggcatttactgctataaactttccactgctttatctgtgtcccagagaattggcatattgtatctttgttctaattggtttcaaagaatttctttatttctgccttaatttcattgtttacccaaaagccactcaggagcaggttgtttaatttccatgaattgtatggttctgagctatcttcttagtattgattttttttaattgtgcagtggtccaagagtgtggctggtatgatttgggttttttaaaatttgctgagaactttttatggcagattgtgtggttgattttacagtatatgccatgtgcaaatgagaagaatatatattctgttgtttggggtggagagttctgtagatgtctcttaggcccatttggtcaagtgtcgaatttaggtcccaaatatctttgttagtattctgccttgatgatctgttcaatactgtcagtgggtgaagtctcccattattactatatggttatctaagtctcttcatcagtctctaagaactcgtcttatgaatctgggtgctcctgtattggatgcatatatattcctgacagttaagtcttcttgttgaattgaaccctttattattatgtgatgcctttctttgtcttttttgattgatgttgatttgaagtctgttttgtgtgaaattagaatggcaatccgtgcttttgtttgttttccatttgcttggtagatttttccccatccctttactttgagcctatgaatgtcattgcatgtgagatggatctcttgaagacagtatccagttgggccatgcttctttattgaacttgccactctgtgccttttaatgggagcatttagcccatttacatttggattaatatcgatatgtgtgagtttaatcctgtcatcatgttgttagctgattattttgcagacttgattttgtagttgcttgatagtatcagtggactgtgtactttagtgtgttttatggtggccagtgatggtcttttgtttccatatttagcactcccttaagaacctcttgtaaggcaggtctggtggtaataaattcccttagcatttgcttgtctgaaaaggatcttatttctccttcgcttataaggcttagtttggctgtatatgaaattcttggttggagcacagtcatagtggtaggtggccacgggggtgcttgtgtcactttctaatgaggttaaaggtggctttaggtggcttagaagagacagagactgtatgtttggcagaaagtaaggaaagagaacaagagtctctgcctggtaacctagataattcaaccagattttgtctaagactattaaggtggtacctctatgactgtgcaagaaccacagcattactgggcttagggtgccctctaaagcagaaatgccttagatcacaaaactcaagtcctttcaaatctggaaagcctttccaaaaaggctgcctataaataagcctggacagtgaagactacaataaatgctcaactcttcaatgcccagacactgaagaacatctactagcattaacaccatccaggaaaacatgacctcaccataaggcatcagggaccaattctggagaaagagagatatgtgacctttcagacagaattcaaaatagctgtgttgaggaaattcaaagaaactcaagataacacagagaaggaattcagaattctagcagataaatgtaataaagagattgaaataattaaaaataatcaaacagaaattctggagctgaaaaaattcaatttgcatactgaagaatgcatcagagtcctttcatagcagaatggatccagcagaagaaagaattagtgagcttgaagacaggctataattgaaaatacacagaagggacaaaagaaaaaagaataaaaaaaacaatgaaacacacctgcaggatctagaaaatagcctcaaaatggcaaatctaagagttattggccttaaggaggaggtagtgaaagaaataggagtagaagttttattcaaagggataagagaaaatttcccaaacctagggaaagatatccaagtacaagaaggttttagaacaccgagtagatttaacccaaagtagactacctcaaggcatttaataatcaaactcccaaaggtcaaggataaagaaaggattttaaaagcagcaagagaaaagaaacaagtaacatactatggagttccaatacatctggccgcagacttttcatggaaaccttacaggccaggagagagtggcatgacatatttaaagttctgaaggaaagaaaacttttaccctaaatagtatatctggtgaaaatatctttcaaacatgaaggagaaataaagattttcccaaacaaaagctgaaggatttcatcaataccaaacccatcctacaagaaatgctaaaaggagtacttcaatcagaaagagaagaacattaatgagcaatcatcacctgaaggtaagaaacttactcataatagtaagtacaccgaaaaacacagaatatttttacactgtaactgtggtgtataacctctcttaccctaagtagacagactagatgatgaaccaatcaaaaataataactacaacaacttttcaagacacagtcagtaaaataatatataaatagaaacaacaaaaagtttaaaaagctgggaaatgaagttaagtttttattagttttctttctgcctgtttgtttatttgtttatccaaatagtgttgttatcagattaaaataatagattataagatggtatttgcaagcctcatggtaacctcaaaccaaaaaacataaaatggatacacaaaaaataaaaatcaagaaaccaaattatatcaccagagaaaatcatcttcactagaggaagacaggaataaaagaaagaagagaagatcacaaaacaagcagaaaacaaataataaaatggcaagagtaagtccttacttatcaataataagtaatgtaaatggattaaactatccaatcaaaagacatagactggctgaatgaatgaaaaaacaagaaccaatgatctgttccctacaagaaacacatttcacctataaagacacacataaacagaaaatgaagtgatggaaaaatatattacatgccagtggaaaacaaaaaagagcagaagtcactatacttgtatcagacaaaatagatttcaaaacaaaaactatacaaagagagacaaagaaggtcactatataatgataatggagtcaattcagcaagaggatataacaattttaaatatatatgcacccaacacaggaacacccagatatgtaaaggaaatattattagagctaaagagagagataggcctcaatacaataatagctggagactttaacaccccacttttagcattggacgtatcttccagacagaaaatcagcaaagaaacatgaaacttaatctgcattacagaccaaatggatctaatagatatttacagaacattccatccaagagctgcagaatacacattcttttcctcagcacatggatcattcccaaggatacaccatatattagctcacaaaacaagtcttaaaacattcaaaaaattgaaataatatcaagcatcttctctgaccacaatgcaataaaattagaaattaataataagaggaatttagaaaactacataaatacatgaaaattaaacaatatgctcctgagtgaccagtgggtcaatgaagaaattaagaacaaaataaagaaagaaaaatttcttgaaacaaatgatcatggaaacacaatataccaaaacctatgggatatattaagagagaagtttatagctataagtgcctatatcaaaaaagaggaaaaacttcaaataaacaatctaatgatgcatcttaaagagagaaaagcaggaacaaaccaaacccactattagtagatgaaaagaaataacaaagatcagagcagaaataaatgaaattaaaaagaaaaaatacaaaagatcaatgaaacaaaaagttgattttttgaaaagttaaaatcgacaaacctttagccaagctaagaaaaaaagagagaagatctaaataaataaaatcagaaatgaaaaaggaaacatttcagctgatactgcagaaattcaagggatcattagtggctgctatgagcaattatatgccaataaattggaaaatctagaagaaatggacaaatctctagatacatacagcctaccaagactgaactaggaagaaatccaaaacctaaacagaccaataacaagtaacaacatggaagccgtaataaaaagccttacagtgaagaaaagccaaggactggatggcttcactgctgaaattctacccaacatttaagaagaactagtatcagtcctactgaaactactccgaaaaaatagaggaggaaggactattaccacactcattctctgaggccagtattaccttaataccaaaaccagacaaaaacacatcaaaaaattgactaaaaacttaaatctaagacctcaaactatgaagctactacaagaaaacattggggaaaatctccaggacattggtctgcaaagatttcttgagcaataacacacaagcataggcaaccaaagcaaacatggacaaacaagatcatgtcaagttaaaaagcttctgcacagtgagggatacaataaacaaagtgaagagacaacccacagaatgggagaaagtatttgcaaactacccttcagacaagggattaataaccagaatatataaggagctcaaatgactctataggaaaaaatctaaaattcgatcaaaaaatagttaaaagattagaatagacgtttctcagaagaagatatacaaatggcaaacaggcatatgaaaaggcattcaacatcactgatagtcagagaaatgcaaatgaaaactgcaatatcacctcaccccagctaaaatggcttttatccaaaagacaggcaagaacaaattcttgtgagggtgtggagaaaaggaaactctcatacactgttggtgggaacgtaaattagtacaaccactatggagaacagtttggagtttcctcaaaaaactaaaaattggctgggcgcagtggctcatgcctgtaatcccagcactttgggaggccgaggtgggcagatcatgaggtcaggagattgagaccatcctggctaacacagtgaaaccccatctctactaaaaacacaaaaaattagccaggtgcagtggcgggcacctgtagtcccagctactcgggaggctgaggcagcagaatggtgtgaacccaggaggcggagcttgcagtgagccaagattgcgccactgcactccagcctgggcaacagagcaagactctgtctaaaaaaaaaaaaaaaaaaaaaacactaaaaattgagcaatctcactgcagggtatacatccaaaagaaaggaaatcagaatatcgaagagatacatgcacttctatgtttgtggcagcactgtttataatagccaagattggaagcaacccaagtgtccatcagcagatgaacagatatagaaaacgtggtgcatatacatactattcagccatcaaagagaatgagtcccagtcatttgcaacaaacatggatgaaactggagattacgttatgtgaaataagccaggcacaggaagacaaacatcacatgttctcacttatttgtgggatctaaaactcaaatcaattgaactcatggacatagagagcagaaggatggttaccagaagctgagaaaagtagtggggggcaagagggaaaggtggggatagttagtgggtacaaaaaaatagaaagaatgaataagacccactgtttgatagcacaatagggtgactatagtcaataataaattaattgtatactttttaataacaaagaatatagttggattgtttgtaactcaaaggttaaatgtttgaggagctgcataccccattctccatgatgtgcttattttacagtgcttacttgtatcaaaccatctcatggatccccataaatacatacacctactacatatccacaaaatttttaaaaaataattttaaaattttaaaaaagaaaagaaattattggctggaatttcttttctttaaggatgctgaatataggcccccaatctcttctgccttgcagggcttctgctgaaaagttcactgttagcctgatgaggttccctttttaggtgacctgccccttctgtgtctagctgcctttattgttttttctttcatgttggccttggagaatctgaggacttggggaatctgagaactatgtgttttagggatgattgtcttgtatagtatctcacaaggattctttgcatttcctgaatttaaatgttggcttctctagggaggttggggaaacttttgtggacaatatcttcaaatacgttttccaagttgctggctttctcatgctctttcagggatgccagcgagtcatagatttggtctctttccaaaatcccatattcctcagaggtgttgttcatttgttttcattcttttttatttttgtctgactgagttaatttggagaaccagtcttcaggctctgagattctttcctcagcttggtctatcctgttgttaatacttgctattgtattatgaaattcttgtagtgagatttccagctctatcagatcagtttggttctttcctaaaatgaccatttcgtctttcagctcctgtatcattttatcatattccttagattgcttggactggattttgactttctcctgaatctcaatgatcttcattcctactcatattctgaattctatgtctgtcatttcagccatttcagcctgttaaaataccattgctgaggcactagtgcacacatctggagataggaagacactgtggctttttgagttaccagagctcttgagctggttctttctcgtgtgtgtgggctgatgttcctttaatctttgaagttgtcttcctttggatggggttttttttgttttgtttttatcttgtttgaagcccttgggggtttgattgtcgtataaggtgggttcagtcaactggcttcgattctggaagatttcaggtggccaaggctcagctcagcactcctgagctgcctgctctaactctagaaggctggtactgggtccccagccttttcctctggcctcctggggttcagaacctgctgcattagaggggccaaggtgttcccagtccgctggcctcaacagtccagtgggggtgcaggccaaagtgcttccttgtggcagtgccagcaggatctgtgctcactcacacatggcaccagccacagtggcatggcagggtgcgtgtgtgttggctggggcagggcactggtgggagcctttgccttagttttcatggcactgaatactgcaaaacattttggtgttgtattttggggccgccatccagtaggcagtgcttaagagtgatcaccaggagatacactcttactctgctgcgtggttcttcatgtttcagtacagttggcagtagtgttctgtgtgtgttggggacaggggggtgaccttctcacttagtccactcctgggccttagacaagacccttctgattactggctccacacctgcatttcttttgttgggtgttctggtaaacggggttccttcaggcaggggccgtggttggcagacaggccgtatccttgctgggtccgccctgcagagagaggcatacctcctccacctcactcctccaccagcctacaaactcggacatctcacctctgtcagtgataagagaatgagggctcttccctgcttgggcattgtccaaaccagcaagtcctgctcagctaggatctgcagaagtgggtggggtcacgtaatcagctgtctgggtgcttcccagaggaacaggggatggcacccacccacagagtagcgggactgctgggctggaagctctagcaggtgtggcccatctggctaccacaggcagaggtggttggagtcacccaccctgccatctgggtgtttccctgggcagtaacaggaggctgcacccctcagccggattcagacagaattaggaccactgcgctggaagctctagcagacatggcctgcatggctaggagaggcggtggtgggtggagtcacccaccctgccttcagagtgtttctcggggaaccgggagtttgcctctgctggctgagttcagacagaagcagactgctagcagacattgcccgcctggctaccagtggcagggatgggcagagtcaccccctctgctgtccaagtggggaacctgaacaaaataatatcccaaagaacagtttcatggcaagtataaaaaccacatggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaaaaaaaaaaccacatggcatgctttttgatctatcaagagcaaaggtaggaaaacttgtttgagtaaaagacaagatagtaggctgggtgcagtggcccatgcctgtaatcccagcactttgggaggctgaggcgggcagatcacgtgaggtcaggagtttgagaccagcatggccaacatggtgaaaccccatctctacaaaaatacaaaaattagctggcgtgatggcgggtacttataatcccagctactctgggggctgaggcaggagaatcgcttgaccctgggaggcggaggttgcggtgagccgagatcgtgccactgcactccagcctgggtgacaagagagaaactctgcctcaaaaaaataaataaaataaaatgaaattcacctaaggagagaagggagaggcactgaacatattgtgaagaaaagaacagaagaggttgtaactgttgttctatttggaatctgactaagataggagcctgaggtccctccctgggaaacaatggtgtatataacctcagcttctcacaggtcatgaggtatcttccatcagtctcaggtcgggctcgcccggaagcctgagaccggatttggttgcaggtggcttactggggaggtgatttcttggactcatcaacaagagagaatggtgaggcggggaaacccaggaaaggtagattatggaacaggttaccttgtgagcaactgaggctccatgctgctgcggttgtctgggagacggtgagaacatgcctgagtgttatctgtcctgggggcaagggaccccacctgtcatccactaagggcacctcctggactggagaactatcctccagtatttctggcccacccggcttacaggcagagaaagagccctcagacagatgaccacagctgttgccgagggacaccattggcaggtactgcaatagcaggtgcttgggatgctgtcagcatctgctacacactccagtgtctcctccagtcctccatgacctacaacccccagcttacagatgagaaaactgaggctcataggggctaatggccagcatcataagcttagtgaggactgagagttgtgtctgttttgttcactctttatccccaacccctatagcagcacctggcacagagtaagcccttgataaatattcagtgaaggaaagtcattcagggagtgtgacttagttgagtcaagacttgaactgggatattctaccccaaagcacatgtccttccgccgcatggcaagaacataccagtgtctgcagacagcgcagtgtgtggcttggagtaggtgcctaaaacagttgtttaattaattaattaattcttctattctctacctttatgttccttctttccctcccttacttagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgtgagtacccaaaccacccatgtctgcagctcctctgtcagtccataagcccgagtgacctgagcaccagaggcatgctcactgagcctggccgggggtgggggtggctaaaggatcagggtctccagtgacttctaactgcccaatctgaccaccatgctctgtctacctaagctcctctgcagtgcccggctgtggggcaggccctgcttgcttctggagaggccactgggccctgccgtgtctgccacctctcctcctacccttagaatgaccgtccatcttctctcctggacgtgctcccaccttcctgctgaccttagctacccccacactccccaaggatcaggcagcccccctacccctgctcctctctctgggcattcattctctcggagaaattgctcctccagctgcttcaggaaccctttccatgacaacgacattggccctgagatcttccccatcagctctcaaaaagagtttcctatttttccctgcaaaactgacttcataattatttgtgaccgtggtgccaccattgccccacgcactcaacctgaaacccactctctggctgtgcaagaatagcttcctccaaccattctccagcccggcagtactgagaacttccccatcccggttccccgacctctgtcgtggtatcgatcacatgctattggtatgtgtctatgtcctgctttagatgattcattccataagtatttattaagcactgattctatgccaggccctacagatcacagattaaaaagcacaatacgtgccttaaggagctcaaaaaataggggagaagacaaacattcatttaatgacaacagagtgtgatgtctacaacagtagaggtatggacaaggtactgtggtggcccaaggaagggagtgatcacacgagtgggtaataaagattctcagaggaagaaatgtttgatgtgggccttcatatttatatttttaaaactttttctcacaataaaattcatgttcattataggaaaaaaaaaaagatatgtaggctgggtgaagtagctcacacctgtaattccagtactttgggaggctgaagcaggaggatcacttgaggccaggagttcgagaccagcctggccaacatggcaaaaccccatctctaccaaaaaatacaaaaattatctgggcatggtggcacacgcctgtaatcccagctattagggagactgaggcatgagaatcacttgaatctgggagacggagtttgcaatgagctgagatcgtgatactgaactccaacctgggcaacagagccagactccgtctcaaaaaacaaacaaacaaaagataacgtagataagcaaaaagatgaaaaatagtatcaataagaattccatcattctgtaataaccatcattaaaaattggctgggtgtggtggctcacacctgtaatcccagcactttgggaggccgaggcaggtggatcacctgaggtcaggagttcgagaccagcctggtcaacatggtgaaaccccatctctactaaaaatacataaattagccgaaaatggtgtcaggcgcctgtaatcccagctactcaggaggctgaggcaggagaatcacttgacaggtcaggggcagaggttgcagtgagctgagattgtgccacttcactccagcctgggaaaaagagcaaaactcagtctcaaaaaaaaaaaaaattagtggtcaattgtaagaaccccagtcttttttctgtgcacatgtctatggcgaaatcgaaccatattgtacattttattttatagtcagttttattttctttatatatcaaggctatcttcttgtgagtgggtgtggggtatttttttttttttttggtttgttgttgtctgagacggagtctcgctctgtcccctaggctggagtgcagtggtgcaatcacagctcactgcagcctggaccacccgagtttaagggatcctcttacctcagccccgctaggagctgagactacaggagcatgccaacatgcagcgataatttttgtatattttttgtatagagatgagatttcactgtgttgaccaagctggtctcaaactcctgggctcaagcaagctgctcaccttgacctcccaaagtgctgggatcacagatgtgagccaccatgcccagcccttcatgtgtgtgtgtgtgtgtgtgtgtgtgtgtgtgtgtgtgtgtgtgtgtagagagagagacagagacagagacagacagagtcttgctctgtcaccaggctggcatgcggtggcacgatctctgctcactgcaacctctgcctcccaggttcaagcaattctcatgcctcagcctccagagtagctgggattacaggcacgcaccaccacacccagctaattttttgtcgtcttagtagaaacggggtttcaccatgttggccaggttggtcttgaactcctgacctcaaatgatccttctgcctcagcctcccaaagtgctgggatcacaggcatgagccaccatgccagccctttatatatttttaagtagtctgatacaacaccattttgaatgaccacatgctattccatagggaaagtgccatggctgatttgaccattctcctgttcttggccattttaagctgcttctagttgttcatagttataaatgtgaggtaggctttaaaggacctggatacaggtactgcaagtagcagtggacaggtgggaaatcttcaaagagttccaagcagctagaggcagagaccagatggtggctggccgggggatgggggctgggataggcaaagggaaccaagaacaccaggccagagaggagagtttgggatgggcgggagcaagtggagccttaagagaatgccgtgggaaagtcagaggcttcagccacaagtgggaggagaaattttcaaggaactgaatcagctagacaaggcagagagaagaataaggaagctactataaaaaaaacaagaaagttcaggaagaaagggtggaggttggccaagggctgtgtgaaggaagaggagaaccaaccagagatattaaagaaatgaagatgacaggatgggagcttccaggtgtttggcatgtgattaagcattgtgcattttcaagtataaatttttaattttttttcagtcaccttgattaaggatggcaaatgccaacggaaataaaaaatttaaaatgtatttttcaagtttcacaaaactaagtaagtgtaaaagaaattcaagtaagctttcatttatggctttttttcgtgtgtgtgtgtgtgtgtgtgtgtgtgtgtgtgtgtgtgatgggatctcactgtgtctcccaggaatagtgcagtggcatgaccatacctcactgcaaccttggcctcccaggttcaagccattctcctgcctcagcctcctgagtagctgggactacaggtgcacaccaccacattgcctaattttttttattttttgtagaaacaggatcttactatgttgcccaggctggtcttaaactcctgggctcaatcgatcctcctgcctctacctcctcaagtactgggattacaggctagagccactgcactcagctggctttttttatatgtttgtagtacttgtactttcacagttattaaaacttaaaactgctctaggacttttgggatactctttagtagcttttaattctcacatacccctctgcagcaggtgctattgctgtcctctttttgcagcggaggagacggagtgagggatagagaagcagagcccacatgcaggcagctccttgcctctgcttcttgcccccacatggctctgcagacttaggggaaaagatgaattcaggttggggacttgttgggacaaattagatcaaagaattactgggatgtcaaggtggggatatccaaccagaaaatagaaaactcagtctgaaacttggaatagagatttgagtagttgaagccttggaggtagatgaggtcactaaagtagtgtgtgaaaacagattaaatgggtggaaattccatgagtcggagtctactctaacaccctcagacaaagcccgtcatctcttcccctcaggctgcaaatattctctcctagggcactccccacagccatccctctcctgcagaccctcttgttatcctgggaaggggatagggtcccatgtgagccaacctggacagcagtgcatatgatcatatacagtcttccatcacaacatcctcaggccatctctcccaggctctgctactgcctcccgtcttctttcctgggcactgggactccagaatgtctgtgccaaaggaacacaggtgtgtctgcatcaaagggaggaaggctgtcaaattttttttaaattaaaattgtcaaatttttttaaaaaatttttttcttatctgcagtgctcagcaccgaggccaggccctatgctgagcagtgcagatttaaaaaaaaaaaaaaaaagacaaatgtctgtccctgccctcaaggaactcccagactgaggcagaaacagacacacaaggtgaacacttcagtgtgctatggtaagggctgtagaatgaggagccacatggaggagagggacctagccctgggtgacgggcagacaggcagggagggctggtcagtactggagatggcactacccgctgtggcctggtgctcagggggacaaagcccaactgtgttgtgcagggctgggcacctcaaacccctgccagacacatcacatctctcctgtccttctctctccccctcaggttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggtgagtctggcctgggttctgttctgaagcagggatggggaagagatccaaggcagaagctgagtctgggctgagggatttgtctttgtatttatcaaatattcgttgaggccttctctggccgggatgactttagtaaacaaacacagataggattttttgctcataaaaaaaaaaaattccttcatgaagtgaggtttgagggaggtctgaagaatacagaggatttaactaagcaaagcaggaaggaaaaagttccaggaaaagagaatagcatgtacaaaggctctgtggagaaggcaggaggaggcagtcaagaaactgaaagcaggccagtgtggctggagggcagatagcaaagggttgagataaggctacagataccaacaggaagtagactatgccaggcttgtgcaccatgttggatttgggtcttttcctgatggtgtggaattttaagcagaaggttgacaagatcagtacattttcaaaatagaaactggctgcaacatgaaaaatggattggaagagtgcaaaagtagaggctgggaaaccaattagtaagaaaattgcagtagtccctgcaaagatggtaatagtttggactaaggaaaattatagtacttttaaatgtcacagatagtcatagcttggactatggtattggcaatggatatggaacaaagtggctagatgtaagagagctataaaagtaaaatcaactgggctcagtaatggattgaatttaggaaaaaaaggaagaggaagatatcaaggatgattttaggtttctgaccaaagcaactcatgggatagtggcatcttcatcaagatggggaatactaaaagaaaagtgattggggggtggaatgtcatgagtgtgatctcgtgcttgctggtttcaagatcctttcaaggtatccaactggacctgccaaataggtttcaaataaagctctatccaaagataagatcgccccataaaacaaatctcaacaaatctgcaaggactgaaatcatacaaagtatattctctgaccatgataaaatgaaattagaaatcaacaatagaaggaaagttgaggagttcataaatacactgaaatttaaaaacacactcctaaataaccaagggtcaaagaagaaatcacaaaggaaattagaaaacactttgagagggatgaaaacaaaatcacaacatgccaaaatgtattggatgcagctaatgcagtgcttaaagggaagtttatagttataaatacttctatttaaaaaaaaaaaaaaaaaaaaaaaaaaaaaaaggaaagatagagccagacatgatggcccatgcctgtaatcccaaatctttggaaggccaaggcaggacaattgccttaggccaggagtttgagaccagcctgggcaacatagagagactctgtctctacaaaaacataaaataaaaaattagttgagaatgatgatgtgtgcctgttgtcataactacttaggaggctgagacaggagtctcacttgagcccaggagttcaacactgcagtgagctgtgattatgccattgcacttcaagctgggcaacagagacagaccttatctctaaaaaaattactcaaaatttttttaattaatgaaaaaaagaaaagataccactacatacttatcagaatggccaaaatccaaaacactgacaacaccaaatgctgacgaggatgtggaaaaacaggaactctcattcattgttggtgggaatgcaaaatgagacagcccctttggaatacagtctagcagttttctacaaaacaaaatatacttttaccataggatccagcaatcgcattccttgatatttaccaaaatgagttgaatacctctgtccacacaaaaacctgcacatgaatgtttatggcagctttgttcatcattgccaaaacttggaagcaagctgcccttcagaaagtgaatggactcataaattgtggtacaaacagacaatggactattattcaatgctaaaaagaaataagctatcaagctacacaaagatatggagaaactttaaatgcatgttactaaaagaagccaatctaaaaaggctacatgctgtatgcttccaactatatgacattctggaagaggcaaaaacaaggagatagtaaaaaagattagtggtttccagggcttgggggaagggaggaattaatagagcacagtagagttttagggcagtgaaactattctatatactgtaatcgttcatacatattattttacagcaatcaaaatccatagaatgtacaccaccaagagtgacccctaatgtaaactatggactttgggtgatgatgtgtccatgtcagtttatcaattgtaacaaatgtcaccacaatatactagtgtggtacagcatgtcagcagtgggaaagattgtatgagggatgtggggacagggagtatatgggaactcgctgtactttttgctcaattttactgtgaacctaaaactactctaaaaaataaagtctattgaagaagaagaaaaagaagaagcagagaaatctcaaataagtaacctaaacttacaccttaagaatttgttttccttaggtctttcatgttagtaaagaaatttttttaaaaagcaaacaaaaccaaaagcaagcagggggaaagaaataataaagactagagtagagataaatgaaacagagaatagaaaacaatacagaaaaccaatgaaactaaaagttagttctttaaaaataccaacaaaatttgacaccttttagctagactaactaaaatgtaagaagattcagattactaaaatcagaaataaaagatggggtatcacaattgaacttacagaaataaaaggattataagtgaatattatgaaatattgtaagccaacaaattagataacccagatgaaatgagccaacttccagaaagacacgaatacctaaactgacttaataagaaatacaaaatcttaatagacttataacaaatagagatattgaattagtaagttaaaaactttctatgaaacaaagcccaggcccagatggctttactagtgaattctaccaaatatttaaagaagaattaacacttatattttcaaactcttccaaaaatagcagaaaagagaacacgtgccaatttgttctatgagaccaatattaccctgataccaaaattagactaagataaccaaaagcatcacaagagaaaaaaaaaaatctgcaggccaacatcctttatgaatatatatgcaaaattacataacaaaatactggcaacatataaaaaggattgtagaccatgaccaaatgggatttatcccaagaatgcaaattgggtttaacctaggataattgatcaatgtaatgcaagatgttaatagaataaagaacacaaaccaatgattatctcaaagacacaaaaaaagcatttgacaaaccctcaacaccttttcacattggaaacactcagcaaactagaaataaaagggaactttatcaacctgataaagttgttaccagtaaaaaaacccacagctaacattatacttaatggtggatgactgagtgctttccccctaagattaggaataagacaaagatgtctgttcttgccatttctattcaacactgtactcaaggttccatccagagtaattaagcaagaaaatgaaattaacagcttccagattgaaaagaaagtaattaaactattatttgcaggtgacatgacattgtatgtagaaaatcctaaggaatctacaaatattaaaattagggccaggtgtggtggctcatgccctgtaatcccagcactttgggaggctgaggtgggtggattgcttgagttccggagttcaagaccagccagggcaacacggcaaaaccctgtctctaccaaaactacaaaatattagccgggcgtggtggcacacgcccacagtcccagctactcaggaggctgaggtgggagaatcgcttcagcctggtaggcagaggtagcagtgagctgagattgtgccactgcactccaacctgggtgacaaagggagaccctgttgaaaaagaaaaaaaaaaaaaactaatgatttcagcaaggtttcaggaaacaagatcaatatacaaaaattagttgtgctgctatacactagcaatgaacaatccaaaaattaaattaggaaaacaataaatttaacaaaagaaaacttgtatacagagaactacaaaaaatggttgaaagaaattatgtaagacctaaacaaatgaaaagatgtcccatgttcatagattggaagacttgatattattaaaatgacaataccccccaaactgatctatagattcaacacaatccctagcagaatcccagctgccatttttgcagaaatggacaagctgattctaaaattcacgggcaaaaataagattgcatgtcaagcctggggaacacccccaccccagtatttaatggccaaagaagagccaacaaacaagcctgagaaggaggggccacatagatgaaagggacaccaggagagagaggtgtcatggaacccaacagagcagagggtctcaaggaggtcagcagggactactgctgctgggaggtcaagataaggactgaaatttgtccattggattagtgataggaaagtcatgaataacctcagcagaagtaccttatgtggcatgaagaggcgagaatgcagactggagtgcattaaagagggagaaggaggtaaaaaatgagaccacaaatatactttcttcaaagactttgatagtgaaaaggaggaaagcactaaagcagaggggatggtgggctgagtaaatgtgtgtgtctgtccatctgcttacttgcatttaagaaggaaaagatctcagtttgagaatcagtgaggaggagtgataaaagacacaagaaggagaaggagtcattgatggctctctatcctcagagggaggagggaggagaaagattggccttggaagagggaggaaatgtctcctttactgtaacaggaggggagatgaggacagggaagagagaggtaggaacataggtttcactctgagaagctgagaggttcccatctgatggcttcatttttctctgagaaataggaattgagttgtttgctaggagtgagtgtgagggttgaggtgttggatgtttggaaaaggcaagatcttcaaatggccatagtagagtgtgagatctctgccagtcaggcattgctgtggcccatgtgagggtcgtggtcatgattcaagatggcagccacctaccctgttgcacaggtgggagtttgggtggagagtggaaagatagcagaattcagggttagccagaggaatgtgatggaaggtcagagggtaagaaattcaggatactgccaatgaaggatcatggaatctaacctacattccaaggaaattgaagaaaagaaagtgataagagattgaaagaaaggagattgtaagaaaggaaagcaatcaagagattgttcattaaaaaggagttacagtgggagaagttgagcaggcagagtaaggaggcaagcccagcctcgtgctgtgactttctgtatccttatgaggctgctctacccactcctaagacctatccaaggagaaccaccagagtccagtaaaaatgcttttgagcaggactaaggaatcctggttctacctcaaacttcacaccccagtaggaagacaccaatcttcaatgtactctttttacattggcataaaatttcactatctcaaacccaaacaactccatatctgttaattccttgggccttccaaaaaacaccctgcaaaaatggcagagcagggacaactatttccattttccatatataaagaaatgggctggggaaggacattccctggagccagacacacacaggttcaaatcttgcctctaacggttacagattgaaaactatgggtaggtttctttagcaagtttcagtttactcattaataacatggattcaccatgtctgttgcacaaggtggctgcaaagtcaaaggagatcatgtatgctatgtacttagggtcatgtgtgctatgtatttagggttatgtatgctgtgtacttaggacatgtatgctatgtacttagggtcatgtatgctatgtatttagggtcatgtatgctatgtacttaggaccatgtatgctatgtacttaggttcatgtatgatgtgtatttagggtcatgtatgctatgtatttagtgcctaagttgtcctaagaggctcagagaaattaacgacttgccaaattcacatagttagcagtgggagagctggacacaactcagtgagggcaagacccagcaccaacacctacctcctctgtatcaggtaagccggggcctgattaattctggctcactgggggtagcaccataaaaagaaagaaaatctggatcaggcaaatgtgaatatttcccacaataaaaacatctccatatggaagagtgtacagccttacacacgcttggatgccagactacccaagacccgcaagcaaagtcctaactattgtatttctctttttttatttacctacatctcctcatttcctccccctcctcgcccctgataaccaccatttattctttctttgtatgtattttgcttttttaatatttcacccacaagtgagaccatgtagtgtttttctttctatgtctggcttatttcacttttggatttatcttgaaatgcattgaataagctggtgtcaggaattctggggttttgtcactaatggcctgtaaaattgagcacattacgcagacaaaggagaaattggcgggagtggggttggagagctcaaaaaaggaatgccggaaagagcaaggtcaggggagagaccagacagagggtgtggaatcgaagacacatgagggtggacccttggcctcctctggaacagaagagaaaggactatgtgatgacacaggcagctgaggacggagaggtggagggacattgagggttttggtttccacagcagcagcatcctttaagcactaaccttctgccaggggcttccctaagaacatggcatacatgatctccttggatcttgcagccagctggtacaatagacatggcagatccatgatactgatgagtgaactgaaacttggtaaagacatctgccatagtcttcaacttgtaactgacagaggcaagatttgaatccatctctgtctagccccaaagcctgtgcccttcacctgcccactggggtcactgctgcccaaggtcagatggcctcagcctcctcacagaggtccaataccaagtgtcttcactggggcttgggagtgggtaggattggaggagggaagtccacacagcacagcttgtaatggtaagttgtttaaaaataaataaagccccaagagaggcacatttgtttatgctgagatgagtcctgggggcaggaacatgcctagtgaaaatgagcttgtcaacaagcaggaaatcagataagccaggtgggtagaaccgaccacccagggagagagtgggctggcaggagacagccatctgggaagtaggccctcagctgtgagatgccagccacaggcagtgagcacagagccacatctgccagctgcgtctggactttcttgggccacactctgcagctcagggttggaagcagagaaggaagacagtgattgtccagggagacgttaccgagggcctggtgcactctaaaatccaagtgctctacaatgccacatactgagtcgtgtgtgtgtgtctgtgtgtgtctgtgtgtgtgtctgtgtctgtgtctgtgtgtgtatgtgtgtgtgtgtctgtgtgtctgtgtgtgtgtgtctgtgtgtgtgtctgtatgtgtgtctgtgtgtcaaagtgtgtgtctctgtgtatgtctgtgtatgtgtgtgtgtatccgtgtgtgtctgtgtgtgggtgtctgtgtctgtgtgggtgtctgtgtgtgtgtgtgtgtgtgtctgtgtgtctgtgtgtaagagagacagggggaattggggtttcgctctgtcacctaagctggagtgcagtggtgtgatcatgactcaatgcagcctcaaactcctggatacgagccatcctcccacctcggcctccaaaagtgtggggattacaggcaggagtcaccacaccttgccaggatgtgtgtttaatgcagctgaccttaaattcctggctggataggaaagtccagaaggaagccagagaaaaacaaaggggaaaagtaggtcttatgagagcaaggaaagacagagatttttggagaggatggagagtggtatttgagtccaaccagaaggataaccaggccccaccttcagcctccttccccctcacacacagccgctcccataatcatatcagatggccgctcccacagtgtctgccaaccctgcatctgcagctccagacccaaacccaacaccctcctctgaggtgtcccagaggctcctgaaattcagcctattcttacctagactatcctccctaactaaaaacaaactgttcctcctctcagaaccaactgcatcattttcaggacccaatacaaaatgaaaatgcagtgtcctagctcaaaagtcaggatgaaagtgctgttaaaggtactacgatacagagctttttctttcttccatagtttctctctcaacctatcacagtgtattttatttgctatttaacaatgcattcccttgggcactgggacactagcagtgtttgtccagaccctcaaaggtgctcggaggcctctccacagctcagcatgtgcacatggtgcaccagatgcagggtgcctctcccacaagtcaccagatccaggcaccatgccccagagtgggtaaaatgtcaagccagacatgtctccttcccatgggccaccaccccagcctaaagcagatgggagaccctccagggtattgccaggatgcattaggtatctagatcagtggtgggggagatttgcccccaccaaatcaccaaatgtgccatgatgctgccagcccaaatcgagaaaggctgccacctgccctaccccaagatgccccaccccaacctacccatgcctgatccaggcccccaccagagataaagcgtggcaataatcactgggctgaggttgagtgggggccccacaacactcaaatgcaggatgaccaagaactatttcccctagagggagggagggaggtggcaggagatggcatcacctatgagctgaggctccatggtcccatcagacttcacctacaaaacacaaatttaaagacaaaattattaagaaattcaagatggccaccacagagcattaacccccccaatctagaagggtccttctcacacccctgccagttccgggtccttctgagcacggggccctgtgcaaccaccctggttgtacaccaatgaaactgacactcttctaacatctgctttctcagtaagtgacagcagcttctactctgaatccaaccttgaggcctccctggactccactgagtgccacagggtctgctccaaacatctcccgaagtcgctgctctgacagttgctcatcctcccccacagaccccttgcctcctgcctttccccacccagccacctccacttcctcagggatcttgcattttttttttttttatttgagatggagtcctgctctgtcacccaggctggagtgcagtggcatgatctcagctcactacaacctccctcagggatctttctaaagcaatgcagagaccacatcactgctggcctcaggaactttcatgggctcatcactgccacagggaaataggtctaaacatcttataatgacatccaagacctactactatcttgatattttctagctttaccctcagactttctctctacctgggtagcctttacgctaacatcactatactaaccgcgtgctgtgatttcacatctgccctaccagccacgcgtgcccctgcctccgccctcacctcagtgaatcactcatttaagtttcaccgtttccaccctgccttggcaatcactcattcctctgccttcagctgcacctgacttgcccctcttttgaggctatttcattcatttatttactacatacttactaagcacctactgtatgctagaccctgctctgggcactgggatatgactagtaatgaaaatggggctgggcacggtggctcacgcctgtaatcctaacactttgggaggctgaggtgggtggatcacctgaggtcaggggttgaagaccagcctggccaacatggcgaaaccccgtctttactaaaaatacaaaaattagccgggcatggtggcaggcacctgtaatcccagctactcaggaggctgaggcaggagaatcacttgaacccagggcgcggaggttgcagtgagccgagatcacgccactgcactccagcctgggtgaaagagcgagactccatctcacagaaagaaggaagggagggagggaaggagggagggaggaaggagagagaaagaaaggagggagggagggaggaaggaaggagaaagaggaaaggaaggaaggaaggaaggagagggagggagggagggagggaaatgggcaaaattccttcctcaaggagcttacattctagttgggagggaggacaagaagccaaataagtaagtaaaatatattgtgagtgacatgagctatagagaaaagtaaagcagaaaggagcagggagtctggggatgggtgtgcaattttaagtggagagacgaggcaagatgtcaccaaagcgacttccttctgagcaaagacctgacgcaagtggaggagcaccccatgaggtgtcagcaccagaagattgttccaggcagaagaagcagcagaagcagcaggtgcagagaccttaggtggaactgtgcctggggtgaggaaggaagagagagaagggcagtgactatggacctaaaagagattagagatgaggacagagatgatgaggatccaagtccccagagccctgtagaccaggaaaaggaccgtgaattgtattctgagtaatgtgggaaaacattggagggttttaatcaaaaaggatcaaaaaactaactattatgtgtttctatgtctatccccaagtaccatgtgcatttctggggcctgggagggttttctagacctctgcctggcccacaggcctggtgcatagtaggtgattaatggttgcttatgggtgtctgttgaatcaacaggtgagtaacctgaagaccatgggtgtgtgtcttccacaggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagtaattgttcttggtgggcagggggaggtggagggaactgcctgccaccatgaggcaggcagagggtaagagcagagagaaggtgagacctgctttgtgggagtgggaggagcctacaggatctcagccaggcagtagaggctcaggaggaagctcatccacccttggacagagggagggggcctccaggctccaaatacagcaagagaagccaagtcgagtcaagggacgtgaatgcaaggtggggacagggggcagaatttgtggccattttcacagactaccacagaggatgatgataatcgtgcccacttcatagagctatgaggattgcagcagtgtttttctattcttctcctgttcccacgagctgtgatctgcctagtaacaggtcctcttacttggcatggggttctgccatggagagctgaaatcactggtgtccacttagttcgatttactatctcatccgaggggacagagccatcccccccgccaccatgtagaaacaagtgaggcgccctggctcatgcctgtcatcccagcactttgggaggtcgaggcaggcagatcacttgaggtcaggagttccagaccagcctagccaacatggtgaaaccttgtctctactaaaactacacaaagtagccaggcgtgatggtgggcacctgtaatcccagctactcagggagcctgaggcaggagaattgcttgaacacagaaggtaggcattgcagtgagctgaaatcacctcattacactccagcctgggcaacagagcgagactccttcttaaaaaagaaaagaaaagaaacaagagtgcatagttacctctccctggtcctgctgggcctcctcccttgatgcacaaagttatacacacccctctgtgcacccgctcagggggctgccttcagggtcttcttttgtttctgcccaagccctgaaatatccttgtttacaccttgcgagatctttgttcacacatcacacgtcccttccttcttcccaaggccaaacctctgcccttcccaaggctattgcctgcttccccattcagtaatcctgatcaagagttgatgggaagggggcatgggaaggggagacaacgaggatcctctcctagtatcaggggtcggcgatccctggtcggctaggaagtcggtaacacttgtcagatttaatcctcgctacatctacagaagacaagattggatctcggagagattcattattttcccaaggccacatagccaggaagtagctgcaccaggatttgaagccaggtctgacctcaaagcctggttttccattctccctgttccctctcttagcgaaggccctggaatgctttgtgacatttacaagcttggactgcagctgggtctgagcagacccagctgggagagccaacagttctagaagcagggctgagaccccaagagcagaggatccccagacaggagaacccccagagagagcctacatatatacaacatacagcaggtacatagcccttttctggcataaatggtagcacagcacaaactctgccctgcactttgctttatcagttaaaatatatcttggagatggtcccacatccgtacgtacaaagtcacatcattctttttaatcacagcatggaatttcactacatggacttaccatcatgtttttatccatcgcctattatgagcagccagattgtctccagtgtttgctgtaaacagggcagcagttaacatcccccagtgcgtcctgagacccagcatattatctgtagcttaacttccgaaaaatggaactgctgggaaaacgatatgttgctaattttgccctctaaaaaggccctaccggccgggcacggtggctcacccctgtaatcccagtactttgggaggcctgggacacagagtgagaactcgtctcaaaagaaaaaagaaaaagagaaaacagatagacccaggtgtacaagtgggacattgagtaagttactcatcaatgtggacagagtgaggggactggatcagtgtgaatcacacaggattgagaaagggtaggtgctggcatcctgaggggttccgtggctgcaagaggaaagtgaaaatctctcaggttaccgcaagccaggaaagtttgtatcttctctgcatgtcatcccagaccctcaaaaggccacagatgctgagaaggaagatcagaccctagttaccctgaagagcgagcccttaggacaatgacctgggctggcgtgtatctttcctgcaggctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggtaaggccctgtgggtcccttctgggcagagggaagagggttgggggggtatcggacaggggatggaaaaaggactgataaatgcatagccaacccaagtttcttaccagctctaccacttacactgtgtgacttggacaagtcgctgaattctctgggactctgtttcctcatctgtggaatgggagtatcatacccacttcatggattgtaatgaaataaaatgtatataaaaacaaggacaggcagggcgtggtggctcacgcctgtaatcccagcactttgggaggccgaggcgggtggatcacttgaggtcaggagttagagaccagcctggccaacatgctgaaaccccatctctactaaaaatataaaaactagctgggcatggtggtgtgcacctgtaatcccagctacttgcagggagaatcacttgagcctgggaggcagaggttgcagtgagcttagatcacagcactgcactccatcctgggcaacagagtgagactcagtctcaaaaattaattaattaattaaacaaataaaataaaaacaaggacagtgctgggaagagagtcgggcatgatcaaatgataactattactgaggctgcatgctctaggggacgctcaggttcccctcactccagggcagcgcttcattcattcatttactcattcattcattcactgagtgcctcccgtgtgtaagcaccagaccaggccttggggtacaatagtgaccaaacagacatgggccctgccctactgaagcttctactctagtggggaagagacggacactggtcacctgtaaatgcacaagtctatatttatgagctctgtggagtgaaaggaaagtacagggtattatgagaatgtaatattgagggaggatgggatttgatcaaagggccagggaggacttccctgagacagtgacgtcaggctgaggtctgaaggaggaataggtacccaggccaagttggggagagtattctaggcctagggatggtgtggggaaaggcccagaacaaagaggcacttgagccccggagaactgaaggaccctgagtggagtgagcccccagccctcatttcccatcccgtaggccccagagattcttgcccttccccgaggagccacccccacactatctctgggccacttctgctcccctccacctccctgggagcaagcccatgagtggcttctgtcttgacacttacccacggctcctgccaggggccctgccacatctcagggagcagacaggggctccaaacccccacatccagagccttctcagagggggtccgggaagcctgggcctcgggctttcctcagccaggcctcccaaacctaaagaagtggtcaaggcagaataacagaaataaatagtctacatttgggttctcctgtagctgacactggctatctacaaccatgggaactccatcccaagggggcagcacctttgcaccccagcctgctgctccccactgagtatttttggctatcactacctcccttatgctgaagagcctttccccagagcttggccatggcaggcagatatggcttcaggccccagctcaacacttacctgtcaaacctgggctgcttctgagggggtttgctctctagagtcccgagtaggtttccacctccttccctcctggagccgggacttagttgagaagaataaccttctacttcaaggtctgcgctcctccccaggggcagaacagctctaacagcagtaggggaatgaatgcagagcccttcgcagaagacagggtcttttcaccgcctccttgtctgggcctcagaacaggcagggcaggattgattcatcctacgtggtagatggaggacacagagacccagagaagacaatcagcatctcacatctggcagaaaccccagaccacaaggcctgggaggatggaaccaggactctctcttcccagcaaaacttccgaccactgggaagaaaatcccaggacccaggcctgaggtggtcattttgaggccatggggaaatccctggcagccggctgtagagacagcctctgccagtgagagccacctcacccaaggccacatctccttcctggggaggcccacatccgatgactggccaatgttggggtagaaaggcccagcccctcaacccaactcctttaaacagctctaaaggatcatctcccagagttggctgaggcctccattggagactgcctcacagcccacgtctccccgattccctcccttcccttgccctggcattgacccaagaacacaccctaatgaatctcctcactgtaccctcctcctcagagcctggcttccagggaacccaccctgcggccgctgcctcagaaggtgacaggtcccaggattctgggccctggggacctggggaccacatgggggatcccaggaggacccggctccctttgtgctttcaggctggaccagacaactctgagtgatgagatgaggcaggaactgagggccctggagcaggagaaacctcagctgctcatcttcagcagacggtaaggggggacccagaactccctctggctgacccaggcccagggctgagcaggagacagggaaagagccatggggtgagagacaaacacagccagggagaaacccagacaccacagcagccagagtgaggtgcacttgtcagtgcaagtagaatcaaatccccccttgcttcaactcttaacgttagacaaacaaggaaaggaaaacatgaaaaagtaagtgggctaaaaaattagccaggcgtggtggcgggtgcctgtggtcccagctactcaagaggctgaggcatgagaataacttgaacccaggaggtggaggctgcagcgagccaagatcgcgctactgcactccagtctgggtggcagagcaagactgcatctcaaaaaaaaaaaaaaaaaaaaaaagccgggcatggtggctcacgcctgtaatcccagcactttgggaggctgaggcaggtggatcatgaggtcaggagttcaagaccagcctgaccaacatggtgaaaccctgtctctactaaaaatacaaaaattagctgggtgtggtgacgcacgcctgtagtctcagctacttgggagtctgaggcaggagaatcacatgaacccaggagacagaggttgcagtgaaccaggatcacgccattgcactccagcctgggtgacagagcaagacaacatctcaaaaagaaaaaaaaaagaacaagaaaaagtcagtgggtgggtgagccagcgaatcccctggacccagcacagcatgataccaaatggcctctagtccaggaatccttccatgaagaacagagaaggtttggaacaatgaaagcgatgatcacaagagggagataaagacagagagagagagcgcctgtgccctgggaaaaagaccatcctcgccatcaccgtcacccaccaccctcaccaccaccaccacacacacccctgacttgaggggcaagccccggggccaggaaagtccatcttcccttccccgaggaatctgctgcagctcccacattctcccagttgggtgcatttccacctgaccatgaagctcatctgtccccaggttcctggctgctgtggctcacctgaaatggaaggaaaacagctcctaggcttaagaggagccatttattcattgaacaaacattccctgcagacccactatgtgtcgggcactgtttggggatctaaggacacagcagtgaacaagaaagacacaacccaacctccaggagcttagtccagcagggagacaggcacaggttatcccagaagtgtctgcgcaaatgcacctggggtcagtgtgagtgcacctatgggcctatttgacctggtcaagaggatctgggctgaggtctgaaagacaggacaggttggctgggcccaagaaggggtggagtccaggcagaagtagaggctctgagagagaaaagagtttagcctcctggaggaatgggaggccaggcgtcaggagcagctactcaaactgtggtccgtggaccagcagcatgagcatcaccctcactgggagctcgatagaactgcaaattctcaggccccactccagacccactgaatcagaatctctggggtggggcccaggaatctgtgtcttttttttttttgagacagagtctcgctctgtcacccaggctggagtgcaatggcatgatctcggctcactgtaacctctgcctcccaggttcaaaccattcttatgcctcagcctccagagtagctgggactacaggtgcatgccaccacacccagctaatttttgtatttttagtagagacggggttttaccatgttggccaggctggtctcgaactcctgaccttgtgatctgcccgcctcagcctcccagagtgctgggattccaggcgtgagccaccgcgcccggctgaatctgtgtcttaacaagccttccagatgattgttaagcgcacagtttgagaaccgatggactagaggtcagtgagccaggaaaaagtggcccaggtgacattggagggtgacagaggccctggcaagcccttttggactatgttaaaaactttccattttcccccagaagcaatgaagcgacattacagggttgcagcagccaagtgatgggtcaggttcctatttcaagattggctgctgtgtagaaaatgggcggcagagggacccgagcagaagcagggagacctttcagaggatgctgcagtggtgcgggccacagaggccagggcctgggactcaggtggaggtcatggaggtggagagaagacaatagaaagaagagctatttgagaggtgttgtcaaggtgatcagctcttagggtgggcgaggaaggagttgggatgacaccccagctctagcctggatgcatgggtggatggaggctgctcacagagacagggaccacagaagaaccacaggattgagttcaaattcggatggagtttttttgtttgttttgttttgtttgagacagggtctggctctgtcacccagactggagtgcagtggcacaatctcagctcactgcaacctctgcctcctgggctcaagtgatcctcccacttcagccttccaagtagctgggatacaggtgcatgccaccatgcccagctaatttttgtatttttggcagagatgaggtggggaggtctcactatgttacccaagctggtctcgaactcctgagcttaagctatccacccatcccggcctcccaaagtgcgaggattacagacatgagccactgcacccgacccgaggaggagttgaatttttagtgggaatgtcatgtggacagccctcgcttcctccaagatcttaggcagaatgaacaattctttgtccaggaaaccaagtgtgatgacccctactgagggcctggatacgggagagatgagtaatagcacatcctcactcaagcggcagagactcggatcaggtagtttgaaggggcaaggctgggagcatcgtgacaggggttgggggaggtcagctgtgggaggtcattccctccatccctctgcccctgatgtgggacggggcaggtttcctacccaagagggtgctacccccacgagagagctcccactcctaggaactggctggatttccgttaccctctctccgagacccaccggctggtgcttcccctctccagaacgtctatggcatgtatcaaaccctgaaccggggtccggcctcttccattcttggctgctaaggcctgggaatcacatctccatctttgccctgccatctaaaaaaaaaaaaaaaaaaaaaaaaacagagtctcactctagtgttcaggctggagtgcagtggcatgttcatggctcactgcagcctaaaccttctgagctcaaacaatcctcccacctccgcctcctgagtagaactgggactgcagatgctcaccaccatgcctggctgatatttttcttttttctgtagagagggcggcttcccatgttgctcaggctaatctcaaactcctggacgtgagcaagatcttcccaattgctgagattgcaggcaagagccacggtgcctggcccctttcatcttttgaaccatgttctctctcaacctgcccacctgggcatgctggggagagtggcacttctattccagtggggaaggggagatgggcggaggctgggctggaggcactggagtggggctccccagacagcaggcaggcagccatggagcaggagcagaagctgcagacacactccctgccatggtccaggcaggccagccttgggaagggccccttacagtgcagccataggggctaggggaggccaggcgggagaatctggagctgaccgctgccttgctgtttcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccggtgagtgagggggctctgctggtcccaggctggcctcccgcaccccactgcccatcctgggtccccacagacagtcagcgccaccccctacccccaactcacactcaccactgggtcccctcctcttgccaagacaacaggcagagacagggctgagacactgggtgtctgcttttcatatggaaaaagatgttttcttatgaaacttaaaattttcaaacatatacaaaaatagtacaaggagcttccatgtacccatcacccagcttcagccactgttttgccaaattcgtttcagctgttcactttccccctctttgttattgttacagtattttaaatccaagacatcgggtgattttacccttaaatatttcattacgcatctcaaaaaacaaaaataaaaaccttttcttccataacataactacaatgccaatatcacatctgacaaagctggcagtaagtctttcatttcatctactccccaatccatattcaaattgctcaattgtctaaaacatgttcttatagttggtgttgtggtttggttgggtttggtttgatttggttttgagacagagtcttgctctgtcactcaggctggagtgcaatggcacaatcttggcttacctcaacctccacctcccaggttcaagcgattctccagcctcagcctctctagtagctgggactacagtcacatgccaccacgtgtgaaaaatgaaaattgtatttttagtagagatgggggtttcaccatattggacaggctggtctcgaactcctgacctcagacgatccaccttcctcagcctcccaaagtgctgggattacaggcgtgagccaccgcgcctggccagttggtgtgttcttatcaggatccaaacaaggtccactcattttattttctttgttatatttcttaaatctcacttaactctcttaatctgtatgctcctgttttattaacagccactaatgagctaaggactgtactagtagctggggaccctaagatgaatatggcagccctgccctcccagggcttacagtcgcactagtagtaattctctatagtcatactcatgatctcttatataacatgttaccactcaccaaacactgccacagacatcatctcaaccaggagacagcgtcactcccagctcacacctacagaagctggggcatcccgggacccactattaacccacctgaggagccttgggaaaatcacttctgatctctataaaagtgttgtttccaattctaagggtttagcattaatattagcacatacggccaggcatagtggctcatgcctataatcccagcactttaagagaccgaggcaggaggatcacttgagtccaggagttcaaggccagcctggacaacatggcaaaaccttgtgtctacaaaaattaccaaaaaaattagctggacgtggtgacatgtacctgtagtcctagctactcagggagctgaggtggaagaattgcctaagccagggatttcgaggctgcagtgaaccaagatcgggccactgcgctccagcctgggcaacagagtgagaccatatttccatagattagatagatagatagatagatagatagatagatagatagatagatagatagattagatagattagatagatagatagatagacagacaagacaagacagataatcttagcacatatattgttattaattattgctaaataggccccttacatatacgaacacttgttatttcatcattaccatcattgccatcatcaacatagtagaaacagttcacagctcccaggcgtgtactaagctgtgagcatgcattaagtcacttattctcgtaactaggagatgggagctataattactcctacttacagatgaggaaaccaaaaacaggaaggttaaatgacttgctcagggatccacagtcaagagcagaagagccaggactaaaatgcaagtccatctgattccgaagtctgggcttgaagccactgtaccgtatccgcaagcccctgcatggggtctggcatccagcaggtgctcagtgagttcgtgcagtaagtgtctgcctctccctcttcttcccagagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaaggtaaacaacagggaaggatagggaggaaggtggtggtaattatgggcctgaaagggagtgtagaatgataatctcctgggagagggtgttgtggcttccttagaggggccgagggggggttatggagatggggactaagattttcctgcattccactcttctctggacttatctttttgaaacacatctcccagcctcataattatatctgcctaaacttacttgaaagtttttattaagtgtcatttatatagactgtatcactcaaggtcccagcaggaaagagatgatatgctcagttgagatttttgaagaagcttttcaaagacaggaccatttacaaagtaaggctaagtgaactaacgaagaatgttggggcaacagggactagcaacaataggaagccatcactactcctacaggcagggagaagaaacagtgtcatcagacgccatctgagagctggagccatgaaacaggggcttcccatagaagatagtaatcacaaagtatgattttatgtcacctccaaagacttcccacagagttccaagaaatatcagctaacagtcaaaaatctcacaaaggggaaacaaggcaccagaagtaagagccagcagaaacgacagataccagaatcagtcccttaaatccttcagatgctgaaattatcagaaaaagaacataaaataagtgtgtataatatgaccaaaaaaaaaaaagtaaccttaaaactatcagcaaaaagcaatgaaccattaaaaatgacaaatcaaagttggaaactaaattgactaaaaaaaatgaaaaaacaaggccgggcgcagtggctcacgcctgtgatcccaggactttgggaggccgaggagggcggatcacgaggtcaggagattgcgaccatcctggctaacacagtgaaaccccgtctctactaaaaatacaaaaattagccgggcgtggcggcaggcgcctgtagtcccagctactcggaaggctgaggcaggagaatggcgtgaacccaggaggtggagcttgcagtgagccaagatcgcaccactgcactccagcctgggccacagagcgagactctgtctcaaaaaaaaaaaaaaaagaataaacaatcaagtaacttgtaggataccatgataagtcctaatatatatctaaatggaattccagaaagataagatagaagggaaaaaaatagaatattcaacaagacaattgcaaacaaatttctggaagtattgagacatatgagacttctcagaatgagaatccccaaaactgcaatgcaggaaagagagagagaagggagagaaaaaatcaagattagtctcattaatgtgaaactacagaataagaaagtatgagggaaagccttgacatcagccagaaagaaagggttataggtgtgagccactgtgcccagccaatgtctgtcaatttagtgagcaagttagaagaatctgatgtgtccccatgtcaaatcatgactccaatagaagcttcatttaattgctgataaaatgatttgataaacaatttatgttatagcttacatcagttataagcacttttatgatttgtacagtttagctagatattaaatgggtttttaatattttttcttgtcttaatttctttatttcccaggaatagaggtaaatgagaatttatttttaatttctcatttgttagttgatatgttgtagtatcatcccagtagttcaatgtatttttagtatcacctcaaaataaaggtattaactttacagtatgcatatattaaggtaatcaaggcatatatataagaaaaattatttagaagctagtagaaagagaaaaatcaaatgagaaaaataaaaagcagggaactgctcagtacccagaaccaggaaagtcttgtttgttgaggccacaaaagttcagtaaacaattcaagctgcacaccaggaggagagcatggggcagggaaatagagtcccgggggcctcaggatccctggggcacctggttgaacagtcagggtcatatgggcattccctagggaaggtcccagactaaaacagaatagagggaagaggtgcaagacagctctggaattgtagaggtccatttagaaaggaagagattgaggagaggaaactgatggctgaaacaagaagctgggacaagttacttgttcccaccgggcaatctatagagtaatgaacacagccactaccacaaccagcctgcctcttccacaagtgagaccgtggccagggatccccaggtactctatcaagaagagaggggcctggctaatagagtcagtgggctcagctctgtcgtagctctgcccatgaccagcagcaaaagaacttggcttgccccaacctgggatgctcagggctgcaccaccactccctgctctaaccagggtattccaggagaaacctcatgcagctaaggtctggagccagaatgtaccaccagggcccgaggggacaaagtctgccttcaggtcctgctccagcgccccctcattccccactctcagaggtggatgagctggccctccccattgtgaggactcccaggccatgccctgctcagtctcctgcgtgcatcaagtgggcctgggagacgggatttgtccaaggaattgggtgaccctccgagtgcacaggcatctagctgaagcctgccaggctgacagccaaatcagaataggaatgaattcactgtgcttgtggcactgtcctttgtggcactggaacttggccaataagaactgtgaacaataactgagcatcctgtgcctggaaccatgcaaggtagttccgtatatattaatatcatctcttttttcataatgaaccgggaaattaggcactacagttttcccttggtgtaccagtgaggaaactgaagccgagagaggtgaagaccctcttccagagttgggattctatcccaagtcctgtttatcccaggctaagagctacacccctacccctccccagtcctgcccaagcccatgtcccactagccttctctagaccaaattctgagcctcaccttgtggccagataggatttactccctttggactccgtacacaagcttgtacaacctgcggcctgtgggccacatgcggcccaggatggctttcgatgaagcccaacgtgaattcgtaaactttcttaaaacattatgagactttcttgcgaattttttaaagctcaccagctatcattagtgttagtatattttacatgtgtggcccaagacaattcttcttcttccaatgtgacccagggaagccaaaagattggacacccctgccacagaacaagaggcaaaatgcacagaggctgcttttagctagctgtgaccagccaggaaaccaatccctggggccgggcagggccccttccagaaatgcttgctgcctgctgtctgggctgcagctgttcattgccctggaaacgatgacctcactgcctgacacagggtctgatttaggacttgggcactggtgcttcatcactgtcgtcgctgaacgggtgatgagtcattaactttccatggtgagttttctcccactatagctagagcttgaggctttcagcctctcagcttcatcaccgtggcaatgggcattctcaccctcctgcaggaccagctccagcagtcatagggcccagcacaaaatgaaagcgcggagctcttcattcaaaaatgattaagaatgtcaagaccaccaaacatgaaaccaagcaccaagccctgctgagctcaggaccctgtgtgactgcacaggccacacatccatgaagctggccttgtccttcgggtccttcgttcccccacccacccatctccttcagcacacacagacctctgctctccacacaaccctccctccaagaggaagtgagttccctcatttttgtcacacttgctcctctctgtgctgcctgtgggaacaagaacacttcacacagacacctgagtggggtctcgccccattcccactccctccccctgcccacctactcaggagttcaaccagatgagatggctggaaaccacagtggtatccctcaggcctcaaaactgttgtcttcctggaaccaacacttactgaatcgtataacaatatagagtcccaaaactcagattaagcaaaatggatattcaaaataccttagtggctgggtgcagtggctcacacctgtaattccaacactttgggaggcagaaacgggaggatgacttgagcccaggagtctgagacaagcctgggcaacatagtgagaccccatctccacaaaaaaatattgaagaattagccaggcatggtggtgcgcacctgtagttccaactactcaggaggctgaggtgagaggagcacttgagcctggaaggtcaaggctacagtgagtcatgatcgtgcactgcactccagcctgggtgacagagcaagactctgtctcaaaaaaaaaaaaaatttagtagctttttcttcccagaccccaagagttaccaagaggactgggccgagttgtttgaggaagaaacagaaggaaccaccacagccaggtggatagattggtcaagctgcattttatctgtaatacgagcaagtggtccttattatccccagggctttatagacacaaacccagtcaatctgcacagtgacaccgggagggggatgctgttatcagccccactttacagatgatgcacagagagggcaagtaatctgctcagagtcccacagttggtaagaacccttgctgggagtcaaagccaggcagtccctatcatttagctgctctgctagacaaccctctagtgccctaccttcatgtgatgtgggtcccactgtccctgcttgagtaggagagccactgtgcccctcaacagctcacctgagcctggaaggtgctgaccacacacactcagcaggaagggcacggccaggcatcaggccacaggcccaagggcagcatctaaaggagggagagtccccaggctcctggacagcaggagcagcaatgtcccaaggcaaacaccgggcatgcggctgggaaaggaggaaggagctgacaggcttccattggcggagcacttgtcatgctttgagccattgttctatttgctgtctgtattccccattgggccacaagctctggaattgcagtgcccatgtctttcctgttcacagctacatccacaggggctggcacattgtccgtactcagtaagcttttgtgtaataagcagatgcaaagccctggaccccagacccacagaaacatgcctacctcatgatagctttttctaaatttttctggtgcaaccagccaaaggcagcgtaggtctttctgccagtgagacttcctccagtcaacactcaaccttcttctccttcagaccacagtcttccccattgcttcccttctctctccaatctatcagcacaaatatactgtcaggtttggatgaggtgactctaccacaatctatggaaagggcagtatgtgcaagaaggggggtgaccagctcatcttaacactgacagtcctgcacccccaggagccctctcggtcctgggcaagcatggacagttggtcaccctagcaagaaggtaagttggagacacccagcaccttctggaattcagcaaaaattcaagtggcaccgagcgtctgttagtgctccagactgtggtcagaatcctgggatctggtcctaggaccatggctggttgtgtggccttggaaaaagcactttcctcccaggatttcagctccctcaactgacatgtgaagacattccagtgctttggaggtcaggatgagaccatccatttagtgccagtgatggcaacgcaaaccagcatcgcctcttggagaagcaactggggagtgaaggaggtcataccatctcacacgctttcctcatcccttggtactgattgatttcaaggcaataacacaagggaaatagaagctttctgcagaatatgtgcattgcaggtgctatttatcatggtgaaaagttggaagcaaactcaacactgaaatgagaaacaggctgaatcacagggtggtgcatccactagcagggatcatatactgtggtaattaaatggtctgacatccttgcagcaagttaaactgtcacaggaaacaagagacaaagtatcatggactacaataaaaataggaaaaggtgttgccgcagagaaagactgtaatgcaggcgtcccatgctaagaatagttatactgtggccaggcgcggtctgggaggccgaggcaggtggatcacctaaggtcaggagttcaagaccagcctggccaacatggtgaaaccccatctctactaaaaagccaggcgcagtggtgcatgcctgtagtcccagctactcgggaggctgaggcatgagaatcacttcaacccaggaggcggaggctgtggtgagccaagatcacaccactgtactccagcctcggtgacagagctagactccgtgtcaaaaataaaaaaagaatagttgtattgtttgattggtaagattcataggtgaattcttcctcattttttcagatgatagataccactgtgactttattttcatcccaaaaacgcagttaaatgacaaaacttaagtaatggtcttcatggacccttctgggattgacatctgactaagggctttgtccagcttgctggatgccttgttgcccagaaaccacttgcattgcagcagttaccaggcaatgcagggatggagctgggacctctgatccctaggccagtgtctctcccattaccagtattcatccctcaagctctcttgtaacttcaatgtccttgcctggcgctggtcagagactgcaatcaaaggtaccaattctggctgatttaagcagaaaagggatacattgaaaggttattgactaactcatagacttagcaaaaggttatgcaacaaatctaagcgggggggaagatagtgacccaatgactcagagaaaccaagggcagagccaaggtcacatcaggaaaatacggagacaggcggcagaaaatacggagacagctactgtaggaccctcctgcccaggagccactgggctctttttctttctttctggtattttgttttttgttttttgttttttgtttttgagacagggtctcactctgtcacccaggctagaatgcagcagcacactcatagctcattgcaaccttgaacttctgggttcaagtgatccgcccacctcagcctcctaagtagctggaattatgagtgtgcaccaccacacctgcctctcactggactcttcacccaactgctactgccagaattctctctctctgcatctgtttcacccctctagacttgaggtcccagttagagacaaccacttagtcaagtcttggtcacacacctgtgtccttgctgccagggagtagtagcatcctgagtggggggcttggcttgcctcctgccaagacccacacagtgctggaggaggaggctcttcctaaaaagaagagtttgaatagtgagtggccaaacaccttggtcactctatgttcctactgccccttcctcctccttgttctctacctgcctagtcaaaccttccagcatcactcaatggtctctcatagagaatccacaccagcacaggcaactagaggttctatatctttcccagctccagggccaggggctgggtttgcgtataagtttggctcaagggtgatccttgagctccacttaggagttcagcactgctaagtgctcccacctggtggcacaatttcccacagcctccaaaggccccaggcctagaaatgccctcttccccatgctgggtgtcttagcctgttcaggctgctataacaaaataccataaactaggtagcttgtaaataacagaaatttgtttctcacagttctggagcctggtaagtccaagatcaaggcgccagcagatttggtgtgttggtgaggcccattcctcatacatggagccttctagctgtgtcctcacagggtggaagggacaagcaagctcccttgagtctcttttgtaagggcactaatcccattcatgagaattccacccccatgacctaatcacctcccataaaagcttcacctcttaataccatcaccttgggggttagaatttcaacatatgaattgtaggaggacacagacattcaagaccatagcactgggctcccccaagagggtacctgagcctaagccctgggatcctacagtgccagcaaatcctgactcagtaacaacactaaatctaggcctcttgggctggatgcagcggctcacgcctgtaatcccagcactttgggaggccgaggcaggcggatcacctgaggtcaggagttcaagaccaacctggccaacatagttaaaccccatctctactaaaaatacaaaaattagctgggcatggtggcaggcgcctgtaatcccagctactcgggaggctgaggcaggagaatcgcttgaacccaggaggcggaggttgcagtgagccgagattgtaccattgcactccagcctgggcgacaagagcgaaactctgtctcaacaaaataaataaataaaaataaacctgtgcctcttcaatccattcttttacagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggtgacactaagagccagaaaggctgggccacggtgggttgacggtaaacacaaaatgcagccagagagccccctagagggtcttcaactgggaccaaggatgggcctcttgtacaggagaaccttgaagtgggcaaacaattcgtcccctctcagtcttggactggtctcctgcctctccaaggtatccccctgctaggttcattgatcaatcactgatctttggacagtttcttacggcccctgtccaggaatcaaaggattggagtcctccatgcctaaaactgtagcctttcctcattctaacttccctaacaataaccctattcctatcctgaagacatcaaagaccaagtgcgggctgtctctgtagcagtgcatggggggagggaggcaggggtgatatagccccactctgtccacacaaacacacagatgcaccatcccccctattcaaaccacattccacggggcagaagcctcccttaatcattgttccctatgttctgtaggccatagatgatctagaaatgaaattccagtttgtgcgaatccacaagccacccccgctgaccccactttatatgggctgtcgttacactgtgtctgggtctggttcagggatgctggaaatactccccaaggtgagcagcccagtgtctgcctcttcactgcgaacagaagtcctacctgggaatgaatgcctgtggggcaggtctcagggctttctcagggacaggataaatcgaggttgaacagaaagtgagtgggatttagagaaagtgggaatgcttccaagactaggagaaagaaagttcggaggagggaggatcacatgcaggatgtgaaggatgatggggtttgacttgggggcactgggaagtgtttgggctataggtcatcaatgtccttcagtccagaccaccaggaacaaacctgtagttgaacatactggctttattaatcattgcagtggcagaacacatattatggggaaccatggggtgtctcagtaaagggtgtttgaaagaatctgctataggatttgggccttggttgcatacatttgaggaagatctaaggaaacgaagattttctttagattgggtgttggttcaggccacacggagatttgtggaagaacatttcaggcagaaggaatgtgtgcagaggcatagaggtgggagcaagcttgacgcctccagatgacaaaaaagaggtcagtatagcaaaagatgagtcagattagaggcagggtcttaccaggcctcatctgccctgttggccctggtatgcactttgcactttgttctaagtgcaatggcaagcttttgagggtcataaacagctaatacaagacctgatttacagccaggcgcggtggctcacgcctgtaatcccagcattttgggtaccgaggtgggcagatcacttgaggtcaggagttcgagaccagcctggccaacatggtgaaaccctgtctctactaaaaatacaaaaattagctgggtgtggtggtgtatgcctgtaatgccagctactcagggggctgaggcaggagaatcacttgaacctgggaggcagaggttgcagtgagccgagagtgcaccactgcactccagcctaggtgatagagcaagactctgtctcaaaaaaaaaaaaaaaaaaaaaaaaaagacctgatttactttcataaagatgcctctggctgctgggtgagaacgaatgataagcaggcaagagtgaaagcagagagacaagtcaaaaggccattatgggccaggcgcagtgggtcacgcctataatcccagcactttgggagaccaaggcgggtggatcacctgagatcaggagtttgagaccatcctgaccaacatagtgaaaacctgtctctactaaaaatacaaaaaattagtggggcatggtgagaggcacctgtaatgccagctactcgggaggctgaggcaggagaattgcttgaacccgggaggcagaggttgcagtgagccaagatcaccccccctgcactccagtgtgggctacaagagcaaaactctgtctaaaaaaaaaaaaaaaaaaggccaggtgtggtggctcactcctgtaatcgcagcactatgggagttcaaggcaggcagatcacctaagatcaggagttccagaccagcctggccaagatggcaaaacccagtctctactagaaatacaaaaattagccgggagggccgggtgtggtggctcaagcctgtaatcccagcactttgggaggctgaggcgggcggatcacaaggtcaggagatcgagaccatcctggctaacacagtgaaaccccatctctaccaaaaatacaaaactttagccgagcgtggtggtgggtgcctgtagtcccagctacttgggaggctgaggtaggagaatggcatgaacctgggaggcggaggttgcagtgagccaagattgtgccactgtgctccagcctgggcgacagagcgagactccgtctcaaaaaaaaaaaaaaattagccgggagtggtgatgggcacctgtaaaccctgatactcaggaggctgaggcaggagaattgcttgaacctgggaggtggagtttgcagtgagccgagatcgtgccactgcactccaacctggtcaacagagcaagaccctgtctcaaaaaaaaaaaaaaaaaatgctgttgtggttgggtacagtgactttcgcctgtaattccatcactttgggaggccatagtgggagaatcacttgaggccagtagctcaagaccaacctgggccatgtagggagacctcatctctatgaaaaatgaaaaaatgagtatggtgatgcacgcctgtagtcccagctactcaggaggctgaggcacttgagcccaggagttcaagtccagcctgggcaacatggaaaaaccccatctctctttaaaaaaaaaaaaaaaagaaacaaaaaagaaaaagagaaaaaaacaaaaggctgttgcaatactgcaagctacagttgaaggtcacttgactaggaaggtagcgagggagatggagaaaagtatatgaattcagggttgattttgaaggcagagccaacaggacctgctggattgcctgtgtagggaaggacttaagcatgattccgagtttggagcctgcatgctcagtggatggtcctatcctttactgagtttggggaaactggaaagggagcatgtttggaagacagtggggaatcaagagttctgtcttagctgggatttaggaaaggggatggatataaatttttgtcaatcgacagtgggtggagtttagggtccattgggaagacaggctttgggctggagaaatgagggtttggattcaagatgggggaggtgaaggaagaaggatctggcttaggattatgagcactacgtttaaggacaagccctgacttacccgtgaggtactcagttgtgtcctcatccttctgtggaaaattgggaaaagagcaatgtctgaaggtgatggttgatttcagtacagggatcatcagagtgtccttatggagccaagcagggccaagaaggtgtcaggtggggaaagaccttccatgcaagatgaacagggtggcaactcaactctttgcctcttcaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggtaaatccaggacaattccagagaactcagaggtgggaggagaaagaaaatcaatgaaggagctgggcacagtggctcacgcctgtaatcccagaactttgggaggccgaggcaggcagatcacaaggtcaggagttcaagaccagcctggccaatatggtgaaaccccatctctaccaaaagtacaaaaattagccaggcgtggtagcgcgtgcctgtagtcccagctactcaggaggctgaggcagaagaatcgcttgaacccaggaggcggaggttgcagtgagctgagatcgcaccactgcactccagcctggacaaaagagcaagactgcaatccaaaaaaaaagaaaaagtcaatggaagaaagtctgtgtatgtgggaggggggggggtgcagagtgcactatcacagtttattgatgagaagaaatagcccacaggaggtaggaggtaggtggctttctcaagttacataacagttgttatgactagaatttaaacttgactcaatctgaccctctaaaatttatgttctctcccatgcacaatggtgtcttcacagtgcccttgaattaacagatgtcgacatacacaaagcttttagctaagtttctcatgatagtttgggtgtgaggtggaagaataagacctagatagtcatatggtcgtatgggttaaaccgatttggcaatttcagatactctcccctgtatcgctcagtatttttgaggtaggcaagaggaaatcaaataataaattttctgggatagagaaaatttatggactcttagtctagtaccaacaatctaagaacccaaacccccaaacagtccttctaggacaaccatccctagtcagctctcaaaaaatggtgaatctacctctgagctgcaacaagctggcttcacagtgtagtggaaagaggatgggctttactgaatcctggcttgggtgcaaccacagatggagaactaaccagccccagcttcagacctggattcaaatcccactctggcacttacttgctgagtgaccttgggaaaattacttaattcatttgagtccctcgtctgtaaaaagaggatcataatgactaatttgtaggaatgctggaaagattaaacaaagcgatgtctatacatgcctcatgcagtaatccttaacaaatcgtagcaatgttatctttttcctcatgttaagccaatctctgcctcttatcagtcttaattctgtcccttggaactcatagaaaaagtctatctccttccccttaaatctaaaaagccatttagattctcaaagactgtggtcatagcattcctgatgactcttgttatgcaagttagacatctcagctccttccatcattcctcttctattttggtttgtaaattctttgccatccagtcacctccctcagtagatgctccagtgtgggaatgagtcagaattgacccctggactgtccagtcagcagagagcatgtaaacaccctcctttctccacctacatggacccggtgctcctggtaccacaacctgaactccctcccctgtgcccacctccctgaactgtgagatcacactgaacttagagcctgctcagactctcaggccttgtacatgcgagctgctgtgaacttcccctttctctcctttgcaaagcaatttttaagtcccttcatttttgtcgttgtctgttttttctgttaaaattaatttgttattcccatgtcctaagattgcttgatcttgattctagattctgacatccaaatccagaacgtacacctttggttggtgccagtctagaaggctaaacaagaacaaggaagtagatttctgctcagacaaggaggtgctaaatagttcaagctatctagcaaggggtttggttagttcaccagggatacaattcaggccaacacgggattaaaaccaagtctgggatgttataggagaaattgctatcgctcatttggatgtcttctattactgtatgatcacagcttctgagcctcagtttccccatatgcataaggaagggattcacctaaataacctctaaggacccttccagctcttactccagattctaccagaatttgtctgtggcttttttctaaatcaaagaatctcagaagtgagtgggagcttggaggtgtaccatgtgtgttaataacttagcactgtttcagatgcatcttcatctctgttttcctccaggagatctcatgcctgcaactactctgatccctccagcccgcataggtcagtaacagctctcagagaccacaggaggcggtggcagttctggggtactgtctggttctgggggaagggaagagagaaaggaagggactcatcactgcaaacctcacaaagagtcaggccctggagagcggtgcatggtcgctccccatacccccttgtcctatccacagagaccctagaattccttatctgacagcctccaatgtgcccagcaggaaccccactcccgatccccactctggcagaatgccaagctagatgctgccatgagggaggacacaggtgcatttctggaggcagaaggaagcgagggatgcagagatgagagaggaaagcactgaaggtggggattggaggtggaggctgtggttggagcccttctttgttcgttgccagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccataggcacagcagtcccgactggctgctggttggctatttttgtggttatttcttgatcgtgtgctaaacaaggagtggattattcatgagttttccagagaaaggggtgggaattcctggaactgaaggttcttccccctttcagactacttagggaaacttccagatgctgccatggcgttcgtaaactgtcatggcgctggtgggaatgtcttttagtatgctaatgtattaaaattagcatataatgagcagcgaggacaaccggaggtccctttcatcaccatcttggtttgatgggttttggcttctttaccacatcctgttttatacgaggagtctttgtgaaaccagtcctgccaacctcctatcttatccccacctcagacattacatactcgtccttaatcttaagaggttgtagaaggacagagatctatcttctgtcactgcttcatgctgaacaggggccatcatccctacctgctctggaggcatagaaatgtcttcgtacctgatcgaatgacttatagggactccatcttttctgcagtggcacaggctggaacactggactaattatttttctctgaaactgttgtagcctggaagacataaacttgaaccgtccgaacacctgatgaatataacaaatatttttaaaatcaaatagcacctagtgataattcataaaatacttaagcccagttttaaagaagagatcaaagccaagcatggtggctcatgcatgtaatcttaacactttgggaggccaaggcaggaggatcacttgagctcaggcttttgagactagcccgggcaacatagactttgtctctttaaaaaaataagaaagaaaaaaataagagatcagatgccatttggaatctaagtgaataggctggaaaactagtcttctgttgtctgaaatacaaagccaaacagatttttaataagagagatttttatgagaacagaagaaaaaaaggttaatgctggacacagtctatccaggtattagactcaaaagcatctttagttataaagcaggaaagtggtggcaatctgacacgcctgtatcacaaggtataagctttagcttgcagggcctcaggagaaagctagtagtaattttactgtatgcagatctctaagctgggggtgacacaggaggtgggcaggactggcttcacaagatgcaggtcacaaagactccactgataagatgcggtaaagaagctggccaaagcccaccaaagccaagatggcaatgaaagggactcctggttgtcctcactgctcattatatgctaattttcaccctcctgtaggaccagctccagcagttgtgggacccagtgcaaaatggaaacacagggcccctcgttcaaaaatgataagaatgtcaagacggtgacaacagaacatgaaatcaagcgccaggccctgctgagctcagggctctgtgtgaccgcacaggtcacacacccatgagactggccttgtctttcgggtccttcacgccccacccacccatctcctttaccacatgcagacctccactctccacacaacccttcctccaagaggacagtcaatgggaagtaagaagatttaaaagacaaggggcaaagaaaaatgcaatggtgtgtttccattgtagaaaacctggtcgtggaattgcggattgccctgccgcccttgaaaatcaagatatgggcactagaagatgttacaagtgtgggtccacagatcacgaaataaccaagtgtaaggctaaagtagacccgcctcttggcgaatgtccttttgcagaatgttttgtctgtggagaaatggggcacctgtctagatcttgtcctgataatcccaaaggactctatgctgatggtagtggttgccaacttcatggctctgtggaacatttaaagaaagattgccctgaaagtgagaattcagatcgaatggccacagttggtctgtgggcaaagggaataagtgcagactatgaagacattgtggatgcaccaaaaccacaaaaacccaaaacaaaaatacctaaaggtgttaatttttgataacaactagtactgtcattagttaccacctcattgttactttctaaaccaggcccacttcacaagttacagctgggctcccttgtagccaggactatactgtaaatatcagtatgatctgggtgtggtcaaaaacaattttcaacagagagaaagaagaaagaagagagagaaagaaaaaggaagagaaagaggaagaggaaggaatgaagaaaaagaggaaggaaggaaggaaagagagaaaggaaagagaaagaaagaagaaagagaaagagaaagaaaaagaaaagagaaagggagggagggaaagaaggaaggacctacgcgaggaggggctccgccaaccctctaagccccgcaacccccgcatgccccgcctccttctgcagacctccccgtccctcatcccagcaagtcctcacgttagttgccggaagcctaggaaatgtattcctaaatctggagtcgtctccatggcagcgagccccgaagtggagccagtcttggagtaggagaaaggccagacacaaacaagtgtgtggggatgggggagacacacatgcatgtccgctttggatccagattctcttttttttttttagacggaggctcgctctgtcgcccaggctggagtgcagtggcgcaatctcagctcactgcactcactgcaacctccacctcccgggttcaaacgattctcctgcctcagcctcccgagtagctgggattacaggcgcccaccaccacacccggataaatttttgtatttttagtagagacggggtttcaccatgttggccaggctggtctcgaactcctggcatcaagtgatccgcccgcctcggcctcctaaagtgctgggattacaagtgtgagccaccgtgcccggcctggatctggattctaatagcaacagctagaattctgagggacaggcagtgagctgggaatcaaattcttggctctaccacccattagatgtgtgatcttgaaacaggttttcagatgtgtaagaagggaatagcaaagcttgcgtcaaacggttgtttgactaggtgagctcatgagtgggaagttgttctgggcgagctggtacacaacactaggcagacagtaaatcttagcttctttgagcctgaggctgttgtaggtgccagtgataacagaggccagagtatctattctcaagcaatttatattctagtggcaaggagatacgaaatacgcacccatgtctgtaatcccagcactttgagaggcgaaggcctgaagatctattgagaccaggagtttgagaccaggagttcaagaccagcctgggcaacatagcaagaccccgtctcttaaaaaaaaaaattttttttcatttttttggccagatgcagtggctcatgcctgtaatcctagcactttgggatgtcaaggcggacggatcacctgaggttaagagtttaagagttcaagaccagcctggccaacatggtgaaactctgtctctacaaaaatacaaaaattagctgggcatgatggcaggtgcctgtaaccccagctactcgggaggctgaggcagcagaattgcttgtacgtgggaggcacaggttgcagtgagccgagatcacgccattgccctccagcctgggcaacagagcgagcctctatctcaaaaaaaaaaaccagtttttttaattagccgggcatcgtggtacatgcctgtattcccagatactctggaggctgaggcagaagggtcccttgagcctaggctccagtgagccataatcatgccactgcactccagccctggagacagagcaagatcctgtctctaaataaaaataattggctgggtgcttacctataatcctagcactttgggaggctgaggccaatgaattgcttgagtccaggagtttgagaccagcctgggcagcatagtgagacactgtctctatttaaaaaaaaaaaagaagaagaagaatagaagaaagatctttttgaatagagatagatggcaacttcctcagaatggatgtgacggttgaacagcacatggagatgatgggaatgagaagtgcagggcagcagggatcattctcaacaatggtggaaaattggagtcttccaggatcactgtgttcagactaatccaccctacatgaagttttctttctctttaaagtgggccacttggaacagggacccctgtcaaagaatgcattcaagaatcatggatttggctgggcgaggtgactcacgcctgtaatctcaacactttgggaggctgagacggatgaatcacctcaagtcaggagtttgagaccggcctggccaacatagcaaaaccccatctctactaaaaatacaaacaaaatgagctgggcgtgctggctcatgcagtgagccgagatcacgccattgtactccagtgtaggcaacaagagtgagactccatctcagaaaaacggaagaatcatggaatgcttccaccaggcactctgatggatggtgggagccctgggctgagcttaatgcctttcctgaaggagtcactctcccaaggagtaggatttgccaggtgctagaatccgatagaggccatgagcaatacttgtctcaatggtgggataactacagatttaaactttgagccatgcacacactctggtccaggccccagtcctggagcaagaaggaagcaggggaaggaagaaggtcctctggaacctgtgattacctgtgttgtgtcaggttgtatgattgtggggaccccattgagtgctactcacaggttagccccaggcaggtaggaatgagaaggaggagaataggagaagaagaggaaaggctagacaggagcatgactgttggagagaacttgaagggaagtctagcagtagtatggacgctgtgctattggtcaggagtcctgctgtgttcttggtttcctagcaactgctgttaagcaggtagttgctaggcaatgcggggccatctaggcggttaggtaaggacctttgtctgcgtgggcatgaatcagaccatcacagagtattgttaatcctgaaaatggccactgggtccattacttagatttttttggccttgttgcacagaaactaatataaccatggtgcacaagttctggtcaaatgagaaagaagtcaccccatgatctcattatccaaacaatacaaaaattctgtctttcctctttccattccagtctttctctgcaggaacacattttcatcttgttatcatcctagtacatggggttttaaaccttgtttttttgactttgatttagatcatcacaagcatccctcaagctacttaagagttttcaggataatcttcccctgcatgactccttgcagtagatatatcatttacttaactattctcctcttgttctgacattgagtttgcttccaattttttgccacaataagcagtactgcaatacacgtctttctgcagagagcttttcgttatcctttagatcactgtcttgaagtcaatactaagggatagtatcaaagggcataaatagtctcatgactttctatattttgcaatagcttccctcatgctgggtgcagtggctcaagcctgtaattctcacactttaagaagccaagaaggaggatcacttgaggccaggagttcaaggccagcctaggcaacatagcaagactctgtctctacaaaacaaatttattttaatttttatttttcttttgagacagagtctcgttcggtcacccaggctggagtgcagtggcgcaatctcagctcactgcaacctcggcctcctaggttcaagtgattctcctgcctcagccatctcagtagctgggattacaggtgcacaccaccatacccagctaatttttttttttttctgagaccgagtctcgctctgtcccccaggctggagtgcaatgacacgatgtcagctcaccgcaacctccgcctccatggttcaagcaattctcctgcctcagcctcctgagtagctaggattacaggcgtgcgccaccacgcctggctaatttttgtatttttagtagagatggggtttcaccatgttggccaggctggtctcgaactcctgaccttgtgatccgcccacctaagcctcccgaagtgctgggattacaggtgtgagccactgcgcctggccgctggctaatttttttcttttttgagacggagtctcgctttgttgcccaggttggggtgcagtggcgcaatctcggctcactacaacccccgcctcccgagttcaagcgattctcctgcctcagcctcctgagtttccagtaactgggactacaggcacgtgccaccatgcctggataattttttgtatctttaatagagacggggtttcactgtgttagccaggatggactcgatctcctgacctcgtgatctacccgcctcggcctcccagtgggattacaggcgtgagccacaacacccagccaatttttgtagttttagtagaggcagggtttcaccatgttgcccaggctcgtctggaactcctggactcaagcaatctgcccacctcggcctcccagagtgttggagttacaggcttgagccaccatgcccggctgaatttcttgattctttaatggctggtttttgttttcttttgattttagaaggccttaatttgaagacctttaatttaatttaatttaattaatttaatttatttgaagacagtttgagggagaacaaaatgtcctcacagttattttttcattattttagttgaatatatctataatatagtttatgattacaaccatttttaagtgtaagcacattcacctcgacgtgcaacgatcaccactgtccatctccagaattttttcatcttccttaattgaaattatgtacccattaaataataattccccattcctgcctcctttcagcccctgggaaccactattctactttctgtctctttaaatttgaccactctagaaaccttatataagtggaatcatacaatcattgtccttttgtgcttgcttctttcacttatcacaaagtgttcaaggtttatccatggtattgcatgtgtcagaatttttttttttttttttttttttttgagatggagttttgctcttgttgcccaggctggagtgcagtggtgcagtctcagcttactgcaacctccaccacccgggctcaagccattctcctgcctcagcctcccaagtagctgggattacaggtgtcgaccatcatgcccagctaatttttttttttttttgtatttttagtagagctggggtttcaccatgttggccaggctggtctcaaactcctgacctcaggtgatcctcccgcctcggcttcccaaagtgctgggattacaggcgggagccacctcacccagccagaatttccttccttttaatgttggaaaacatcccattgtatgtctatgccacattttggttatctgttcatctgttgatggacacgtgtgttgcttccacctttcggctattgtgagtaatgctgccatgaacataggtgtacagatatctctttgaaaccttgttttcaactcttttgggtatatacccagcaggggaattgctggattatcctcacagttcttaaccatttagtgtgggtcagcttctgggtggatagagtaatggaaggagaagaatgatgttgctgaattggctgtttgatgatttttttttttttttttgagacagacttttgttcttgttgcccagactggagtgcaatggtgccatctcggctcactgcaacctccacctcttaagttccagcgattctcctgcctcagcctctcgggtagccgtgattacaggcgcccacccccatgcccagctaattttgtattttgaatagagacggggtttcaccatgttggtcaggctggtctcgaactcctgacctcaggcgatccaccctcatccgcctcccaaagtgctgggattacagacatgagccaccacacctggccctgtttgatgatttttgttctataggagcggcacaaagagaagaggacagaacaaaagtaaccaaatctattctctctgaggaagatcatatgtagagagcagaggtctgtgtgtgtgaaagaaaacggggaagaggatgaaaatgtccagagtggtgagctctgctaggccctggaatgaagctgagatgctggaagcgctaagttctctctagtgggagaaaacccactgtggaaagctaatcatttgatgtagaacctcaccaacgaccaggaagaagcaatcagtgcccagctaggctaaactgggcctgcgatagggtgtgagtagggccagcttcctggaagtgcaacctgtgcaatggcagtaggcccccatgcttggggtttaatgcgtggcagtcagtgccttgaaactcttaataattgtatctttgaatttgtgctttgtaagtgaagtttgatgggacctggagcatgcataggggcaggaagggagggtaggggggcttggagccacagctcatgtggaatcccacctgccaggtgccacctcacagcgcccagacaggttcttagcttcccactgtctgccccgtggagccccaggctttactcagcctccccttctctgccttgctcagcaaccattgctacccctaaccccagcaggggattgagtggagcacggggatgatcagcattggatgtgagctcccagaagcctctcagggtggggcaggcagctgaccctgcattgggctagaagtgccacagcaccttcagcaggtgactaggcttatccaggcacatcctagtgtagaggttgcaatacacttgcaggtttcccatcaactgtgggtttgggtagaggacctgtggaaaggggagattcctggcttgacttcccttctcccagccagggcacgcatataaattagaagttggcaggagaggaattcggcagccatggtttccaggataacaaatagctatagcccaggcagcagagattcccagaaggtccttctctcccacccacccactgacacatacaccccaccaccaccaccaccaccaaagcctgtttcctcagctgggcatgaacacttcgagctaaaagtggcctttgtgaattttgcctcttgctctgtgtacacattctaaagggaacaagtctgttttgctgcagggtgaggcccagaatgcggcctgggaaaggctaacagggcacagtctttgatggtgagcaagcctggggtgggtagctgaggggattgggaggtatacctcttacccttgggtcagagagatgtgggttagaaccccagcagtcagtgttttattctattctattctattctattctattctaatttttttgagacagagtctcagtctatcacccaggctggtgtgcagtggtgtgatctcagctcactgcaacctccgcctcctgggttcaagcgattctcgtgcctcagcctcccaagtagctgggattacaggcatgtgccactatgcccggctaatttttgtattcttagtagagagggggttttgccatgttggccagactggtctcgaactcctgacctcaggtgatccacctacctcagcctcccaaagtgctgggattacagatgtgagccaccacacccggcccccagcagtcagtattagtggcagattttagattccttcacctctcagcctcagtttcctcattggaacattggagaaaatactggtgcctaatttagggggtcatgaaaattaagtgagaccatctctgcagaaatgttgagcacagttcccagcacacagtcggtggccagtgattggctgctgctgctgctgctgctatcatccatgtgtgtcctaggattcctcatagagggggtcaccaacatgatcaactggccattgtccagatccaggctttggcctggcagactcaaatctctgattcctattgactcagacagtgtatctttcttccagaggcaaatacccctaaatggatgaaggaaacctatcaaagtatagcaccggagaaaagatccccctagaagaggcctctctcacctctgagaggggtatgtactctgggcaggtcccagaagcaggagctaaaggtagcctttgtccattcagggtttttttttggtggattctggctccaggccctggactcatgaggtttttcctggaacgctctggtgtcgagcagagtgtgaagttgtagcttgggatcttccagtatctgtcctgtcagggatgtctagtggtcctgaagtccctgggctgggacgaagttagctcttgttgctgggcataggcatagcttgcaccaggatgaggccatggagtcagccaagctctctcaattcctgacagacagagcccccaggggtcacctgggctgggaccagcactgttttgtgatatattcatttctgtacaggtagaccaggtaaaaaataataaggtgtcctagagacacctgggcctctgctgtctgagctccggatttagcctcacatcttctcaatatgcaaaggaccctgcagttactaaagcatttttaacacctgcactcctcactgacacccagctcctccccaataagcctttgcatggttctgcccgagaccctcttggttactgagacttccccactacctactcccacttaagctgcataggtaggtttgggtgactttctcaatgccacagccttacataaagctcttccatcccactctacacacccttccattccaccttgaaaaccctctcattgcaccctacacaccctttcattctagcctcacatccttccaatcatccatcacacaattccatttcacccttcacacccttccattccaccttgaaaaccctcccattgcaccctacacaccctttcattctagcctcacatccttccattcatgcatcacacaattccatttcacccttcacacccttccagtccattattcattcacaccatttcattccattcttcacgccattccattacaaccttcatattcttccactccaccttacacaccttatattccacccttgacactcttccagtccactacatgtccttccgtttctctcttcacatcttccatttcaccctaagcaacctcccatttcacccttcacacccttcaattccacccttcacacccctccatgacatccttcaagctcttccgtgccacccttaacatcctctcattccacttttcactctctggtccttccatgtccttccattctgccttctgcaaccttccattccattcttcacattctttcactccacctaaaccatccttccattccaccctccacacctttcaatttcacccttcatatacttccacccggcttggcgcagtggctcatgccagtaatcccagcagtttgggaggccgaggcaggtggatcacttgaggtcaggaagttcaaaaccagcctggcccatgtggtgaaaccctgtctctactgcaaatacaaaaaattagctgggcatgatggtgtgggcctgtaatcccaggtactcagaggctgaggcaggagaatcgcttgaacctgggaggcagaggttgcagtgagccgagaccgctccactgcactccagcctggacaacagagcaagaccccgtctcaaaaaaaaaaaaaaaaggaactgcaccattttacattctcaacatcacggatgagggttccatcttctcctcatccagccaactggaagcccttttagctgaggtggttaagctgtgagaaccagagtttgctgctgccgttattcactgcatcattcattcagcaaaaacctgagtacctaccactacctagtaggctctggccatgcaagaagtccctggcaacgctgtaggatagagaggaacagcaccctggttacagcgtttcagcatcctggccttggttcaccccggggcctttcacttgcaggaggcagggagttctctgatggcagtttgagttggatttgctgcaactaacaaagccggccagtggacctctccaatctactgggactcaaataaatccaagtgattgttctccctccattccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcggtaagtggcgttcgtcggggtgtcgtgctgcgcccccaggggctccggctgaccacgactgtgtgtttttcctgccttagactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctct

SEQ ID NO: 38360 - DNA, 9664 bp, Homo sapiens
ctagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccgggtgagagctacgggggccgccggggatcacgccgagagggccacagccaccgcctacaccccggctacggaggccgccgggggccatgccgaaagggccgcgcccactgtctgcacctcggctacgggggccactgggtatcatgccaagagggccgtgcccactgcctgcacctcggctacgtgggtcgctgggggtcatgccaagagggccgcgcccaccggttgccctcggctacgggggccactgggggtcatgccgagatggtcacgcccactgcctgcacctcgactacgggggccgctgggggtctagccgacagggctcgcccgcctcctgaaccccgcctacagtgggtcccgcaggacctcactgcgccctctgcctttatctaggcagggctagaaatggtctacttgcagtccgtcttcctgcttcatccggtggccaggcagagggaacggcacgggcaagggcctggaagggaatccgagtggcccatgtcaaacgatgcccataactcagccccgtagcggacgggggcacgaggaatcaggtgtagagcctgaatctcagggtcctgatctctaaccccagcgagttctcggggatccctgggcagctttgccgctctgatggctctgcttccaggctgttcatctttggctttgagcctcaggattctatagaatcagaggagcgcgctcttttaaagacagggtaactgaggcttggaggagccttggcctggccgagggaagagtgggaggggcgggctcaaaggccaggaacctcaagtcacttgagtctggcagcgtcaagggacaccccatgctgggtgtgccgtcttctctttgcatagaatcttgagctgatgatggttttgtgggttttttattaagagaaaaggcttactgaacgctttatatgcatcaattcatgagtccgtaccacagcctatgagatgttacactcatttcacagatggagaaactgaggccagaagaggtgagcttacctgcccaaggcatctagtgaccagaggggcagccagggtgtgatcctgcctcatctgacttcgtagttgggtacacatttaacttccgccttcctgtgtgtgttttccaagagcatcattaaaaagttttggccgggtgcggtggctcacgcgtgtaatcccagcactttgggaggccgacgtgagtagatcacctgaggtcaggatttcgagaccagcctggccaacatggcaaaactctgtctctactaaaaaaaaatacaaaaattggctgggtgcggtggctcacgcttgtaatcccagcactttgggaggctgaggcgggcggatcacgaggtcaggagtttgagaccaacctgaccaacatggtgaaacctgtctctactaaaaatgcaaaaattagccaggtgtggtggtgcgcacctgtaatcccagctactcgggaggctgaggcaggagtgaggcatgatcagtgaaccgagatcatgccattacactccaccctgggcgacagagtgagactgtcttaaagataaaaaaaaaaaaaagcaggtttttggccgggcgtggtggctcatacctgtaatctcagcactttgggaggccaaggatggtggatcacctgaggtcaggtgttggagaccagcctagccaacatggcaagaccccatctctactaaaaatacaaaaattagctgggtgtggtggcgtgtgcctgtaatcccggctacaggggaggctgaagcacgagaatcgcttgaatgtgggaggcagaggttgcagtgagctgagatcatgccactgcactccagcctgggcgacagttgagactctgtctcaaaataaataattgtgaaatgctgcagagtgctagggaatagggagtgagcattcgtcaagggctatggggtgggaggtcctgagaaggtgccatttgagctgagagctggagcatgtgcaggagctggccatggtcaagctgtggcaagagggctcagctaaggccaaagccgtgtgatgggagcaaacctgaagccaggacttgctccttctgccggttctctgtgaggggaatcatatcggttccctagggctacataacgaatgaccacaaactgagcggcttaaagccacaggaatttattctctcaccgttctggaggccagaagtctgaaatcaaggtgttggtggggtcacgccccatctgaaagctctttgggaggatccttcattttctcctcatcttctgggggctctgggcgttccttggcttggggtcacaccattccaattcctgtctctgtctgcacatggccttcttggattctgtgtgtcttctcatcttatataaggacgccagtcattggatttagggcccacactaatccactatgacttgttcttaactaattacatctgcaaagaccctatttccttccttccttccctccttccctcccttccttcccttccttccttcctcccttcctatactttcttttcttttcctttccttttctttctttttttgagataggatcttgttgtgttgcccaggctggagtgcagaggcatgatcgtggcttactgcagccttcagctcccgggctctatcaatccccctgcctcagcctcctcagtagctgggactacaggtgtgcaccaccaggcccagctaatttttttttttgagttggagtttcacccttgttgcccaggctggagtgcaatggcgcgatctcagctcaccacaacctccgcctcctgggttcaagtgattctcctgcctcagcctcccaagtagctgggattacaggcattcaccaccacgcccagctaattttatatttttagtagaggtgggatttctccatgttggtcaggctggtctcgaactcctgacctcaggtgatccgcctgccttggcctcccaaagtgctgggattacaggcatgagccaccgtgccaggccgctaattttttatttttggtaaatacgaagtttcactatgctgcccaggctggtctcaaactcctgggctcaaccgattgtcccacctcagcctcccaaagtgctgggattacagccgtgagccaccatgcctggccattttctgttgtttataagcctcgagtttatggtgttttgtgatagcaggctgcatagattaacacagggaccttggacaaagcagagtggtctttccaactatggatacgattgtgtccctccccagctcacacaccctccttggctccccaatgccctcagtgtggagctcatactcctcaggtcagcattcagggcagtcagcccctgcgtttacttcgtggctcaccttagcattgcctcagctcactgagctagactctgcacaaacacgaggcaccgagacatggacgccatctcagagcagaccagggcccctggggcgcctctcagtgggatagggctgcagctttctccttgatccaagtgcttttgagttaaatctgctgccaacgactccaccattcacaggccagggcatctactgtgcgctagccacaggtgctgggcctgggcaagcctggcccccactccctgtagtggggcaggtgcaggcgggggtggctgctcggaggaggtggcctgagggatgtatatgagtttcccaggcagccttaggagggagggtggggatggagaaggttacccttctccatggagggtggtgaggggctgagttttatcccaagggccgtgggaccctggaggctttgaaacaggacaatgggctggctagacaggtgcaggctatggccaggaaaccccccaaatacaacggaattgaaagactcctgttggaatgctggcccccgcaggaaccaccatgatcccgattcacccaggagggccaccctcccgtccagccccccaagagcagcagggctccctcttgcccttgaacctcctctgccctgacaggcggcgtcacccagggctcaggatcctggcttccagcattccagaggtgactcaccaaccaaagtgtcactcaccaaccgaaggaccttgcacaaatgcaccagcctccccatgcctcagtctccccatctgtaaatgagtgttatgacggtactgtcataaactccctggaggatccaggtggtcacgttactgttggtgacattgtccctctgttggctgcagacgcatcttctctccagactgccgatcccagaaagccaggtgatcaccattaaccccgagctgcctgtggaggaggcggctgaggactacgccaagaagctgagacaggtgagccccgaggagcggccgcaagggagtcacatccacgaagcggccacaccccgggcaacagagcggccttctgattgtcaccagcaggaactgccccagggatcactggcagatccctttgaggaatcccctcttcgaggccacagccctgccctggggagcctgaaggccactcggcctctgttgcccaggtaacaggcctgggtcctcacatcttggggaaatatgatgggtatggctatggctttgatcacaggctacattgagcactgtttcctgcgttacagctacttgtatttctttttttttttttttctttgagacggagtctcactctgtcgcccaggctggagtgcagtggcgtgatcatggctcactgcaagctccgcctcccgggttcacaccattctcctgcctcagcctcctgagtagctgggactacgggtgcccgccaccacgcctggttaatttttttgtatttttttagtagagacggggtttcaccatgttagccaggatggtctcgatctcctgacctcgtgatccgcccaccttggcctccaaagtgctgggattataggcgtgagccaccatgggccttttttttttttgagatggagtcttactctgtcactctgtcacctaggctggagtgcagtgatgcaatctcagctcactgcaacctctgcctcccgggctcaagtgattatcctacctcagcctcccaagtagctaggactacaggtgcctgccaccacgcctggctaatttttgtatttttagtagagacagggtttcatcatgttggccaggctggtcttgaactcctgacctcgtgatccacctacctcggcctcccaaagtgctgggatttcaggtgtgagccaccatgcccagccacagctacttgtatttttttatctgacaactgtttctgtgtcctctgagtctcccctgcccctgccacctacaacctctcaaggctgtcttctccccacgcccaggcattccaaggggactccatcccggttttcgacctgctgatcctgggggtgggccccgatggtcacacctgctcactcttcccagaccaccccctcctacaggtgagcacaccaatgcggggttccaccctagtcctgagcccagtccctaacatctgggacttccagagggagagccacctgccgggtggggtgtctagagccagggttcaagtcagcctccaccaacatacctgcctgctgggctcaatcctttcaggtctcagttgagccccttaaaacagggaccttaaactacccaccatgggattgttagtaggatgggatggaacagtggctggaccaggcctggtgtgtgtaagtgtccaagaagctgaagtgacattgtccttctgcctccatccctgggcttcctccccaaggagcgggagaagattgtggctcccatcagtgactccccgaagccaccgccacagcgtgtgaccctcacactacctgtcctgaatgcagcacgaactgtcatctttgtggcaactggagaaggcaaggcagctgttctgaaggtaacagctgagggttctagtcctgggaagttcatgggcatgtgggccccagggacagaaaatggccccagacattattgtgctgaagcatcagatctgaagaaaactcagtcattcttgggttgaaaggtaacttgaaattgcaattagaaaaaaaggaaaaaaaaaaaaaaaaccccagaaaattgcaattaaaggctagttaggtattaaccgctatgaaatgaaattgatgagatgaggccaaagctgcattcagaggtaaattaatagcattcaaatgcatttaaaaaaaattattaagtagcaaactattgaaataaatcaagtgctttcctgtagaattagaaaaaggacaataatataaatctacaaaagtcagtggcaggactaagtgaaattaaagtcagaaattaatgagttggttaatatattttaaactttaatggtaagtagatctaaaagatagaaaagctcctgacaaggctaatcaagagaaaaaaaaatcacgtggtattatgaataaaaaaaggtactgttatgtaaagtattttaggaaaatacaaattcattacagcattaaaaataaactaaataattaaaaaggttttagttgccttcattgaaaagaccaacaactacagaagaaactggaaatatatttttattttttttttgttttttgtgttattgttgttgagacagagtctccctctgtcgccaaggctggagtgcactgatgtgacctcagctcgctacaatctctacctcccaggttcaagcggttctcctgcctcagcctcttgactagctgggattataggcgcctgccaccaggcctggctaatttttgtatttttagtagagagggggtttcaccatgttggccaggctggtctcaaactgctgacctcatgtgatccacctgccttggcctcccaaagtgctgggattacagatatgagtcaccgtgcctagcctggtttttacttttctaagtggttggaaaaaagtcaaatgaagagccaggccatgcttatcatcccatctactcaggaggctaaggcaggaggattactcgagctcaggagttcgaagctatagtgaaatgtaattgcaactgtgaattaccactgcactggggaacatcacgagaactcatctccaaaaaaaataaatcaggcggggcgcggtggcttatgcctgtaatcccagcactttgggaggctgaggcaggcggatcacctgaggtcaggagttcaagaccagcctggccaacatggcgaaaccctgtctctactaaaaatacaaaaattagccaggcgtggtggcgtgcgcctgtagtcccagctactcaggagcctgaggcaggagaatcacttgaacccgggaggcggaggttgctgtgggccgagatcatgccattgcactccagcctgggcgacaagaacgaaactcagtctcaaaaaaaaaaaaaaatcaaatgaataatactccttgaccttgtgaagattctatgaagttcagattacagtgtccagaaattgttttgtttgtttgtttttttgagacagcttctcaccctgtcatccaagctggagtgcagtggcgccatctcagctcactgcaacctccacctcccgggttcaagtgcttctcctgcctcagcctcccaagtagctgggattacaggcacctgccaccacgcccagctaatttttgtatttttagtagagacagggtttcacaacattggccaggctggtctcaaactcccaacctcaagtgatccgcccccctcggcctcccaaagtgctgggattacaggcatgaaccaccgcacccggcccagaaaagttttattggaacatagcaacacccgcttatgtatatattgtctgcagctgttctggggccagaactgcagagctgagtggttgcaatagagactggatggtctgcagagcttaatctattgactctggtcttttgctgaaaaagggtgccaaccgcagtattaaacagttacagaccaggcacagtggctcatgcctgcactttgggaggctgaggcaggaggattgcttgagtctaggagtttgagactagtcttggcaacatagcaagaccctgtctctacaaaaaataaaaaattagctgggcacagtgccatgtgcctgtggtcccagatacttggcagactgaggcaagaggatcacttgagcctcagagattgaggctgcagtgagccttgatgccgtcactgtactccagcctggatgacagcgcaagaccttgtctcaaaaaaaatgcaaatagttacagtgggcggggcatggtggctcaacgtgggagttcaagaccagcctggctaatatggtgaaaccccgtctctactaaaaatataaaaaattaggccaggcgcggtggctaacgcctgtaatcccagcactttgggagacctaggcgggtggatcacctgagttcaggagttctagaccagcctgaccaacatgatgaaaccgtctctaccaaaaacaaaaaaattagccaggtgtggtgggaggcgcctgtaatcccagctacttggggggccgaggcaggagaattgcttgaaaccgggaggcggaagttgcagtgagccaagatcgcaccatcacgccatcacactccagcctgggggataagatcgagagttcatctcaaaaaaaaaaaaaaaaaaaaaaaaaacttagccgagcgtggtggcacttgcctgtaatcccagctactcaggaggctgaggcagaagaatcgcttgaaaccgggaggcggaggttgccgtgagccaagatcgtaccactgcactccagcctgggagacagagtgagactccatctcaaaataaataaataaataaataaaaatagttacagtggatagaaaggaagggactcttgtccctgctgtttggcactaggacagctgagctgggcattgtcacattttgaggatacaagagtcttatttatccttggttggggagccaggagagtgccgaggggcggtgcctgggccgcaggcagggccttactcttctgccctcttcttcagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctgg

SEQ ID NO: 38361 - DNA, 9664 bp, Homo sapiens; identical to SEQ ID NO: 38360

SEQ ID NO: 38362 - DNA, 3611 bp, Homo sapiens
ctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggtgagtagagggcccgggagacgcgggagagcgtcgaagagagaggtgcggaaggggctggaggaactggggcaagcctgggagcctgaattggggacgataagtcggaggtgaagtttgggcggaggtgaggggttgggtctgggagatttgtcctttcccgcagttggtttccaccttccaaggatctcacagattcctcctatattcctcccagcgacgtcagagaaggcccaaggccgagactcgtgagggggctgtgctgacctaggcaggccgagtcaggtgccttaggggaggatccaggaacggatacctcgcccttccgtgctcgcacactctggctgtcatcgctctgaagactctttaattagatttctcccctttccagtgcgttcacttttctacagatgagtctcttggtggagacagttaccctacctggtccatgtctccctaaccatccggaaggctaacttccacttttcaagcagctttggctggtttccctccttgatttctctggctcccactactattgcttgtctcactgcccctgtcttttctcagggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagtaagaagatggagtggtctggaggggagaggggcaaaggactgcactatgggaagtggggcagcccctgggtgctggtttggaagaggaggcactaagggaggacattagagggaaaggagcatccctgccctccctcatgtttcccctaccccaccccaccccaggaaggcagatgaggggttagcatcgctgagtgaggacggaagatcacccatctccatccgccagatggcctatggtgagccaagggagagggactggaggagggagttggacagccccctcctctagggaagtctctaaatatccacatgttctaagtggcttcttactttccttcatccgtcacttccaaagaaagttggtctggagggagagtagatgtgaaagaattgtaaccgggaatggggaggggtcagtggtgaacaggcaatagtgtgatctctgacattgatgagatcctcccttcccccagtttctggtctctccttcggtatcatcagtggtgtcttctctgttatcaatattttggctgatgcacttgggccaggtgtggttgggatccatggagactcaccctattacttcctgacttcaggtaagatccaccttctatctagcctttaccccccatccatccttgtccctgatctgatttattggccttccctgagagacttctttggctcaacatctcaggagcctgggagaagatcagggatgtatctcctccccatctccctccctgcagcctttctgacagcagccattatcctgctccataccttttggggagttgtgttctttgatgcctgtgagaggagacggtactgggctttgggcctggtggttgggagtcacctactgacatcgggactggtgagttggagacaggggcctgagttagggagaaaagcatttaatggtgagtgggatgtgggggaaagggtatcctcacttcttaacatttttaacttacctgggaggaggaggaaaggtgagtctttcaaggtctctcacctcagcatcatttctatcacctgctctggggaggaggttgaaaggattagtcaaactgtaatgcagagggcctgaggtgagcaggagcggcagaaacctttgagtttctgaggagctgaaaatcaaaagtccccttaaccacaagatgttggtgctctgaagggaaagactggagaatttgagagagatatctgggagtcagaaaggtacagagagaatatggggattaggtcgagggagaatctaatctctttcctactcttaccctccttcctagacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgt

SEQ ID NO: 38363 - DNA, 33263 bp, Homo sapiens
agacgctcgggcggcgggacccagggaaggcagcggccggagcgcgcaaggcgagtgggacccggggctgggtaggggttcaagtctggttcggggatcgagtgtgcaccccctccacacacacctactaccctaccccccgcctccaaccctgggacacgacctcgctggtctcaacgagccgctgcctccaactccaccttctgtgcccaaactttccagacttggagtgtctgtccccgcgtccctgccccctcctcgtctttgaccccatacccccatcgattcctcccagtaccccccatcgattcctcgtgccctgcccgtttctcctgtcttggctcccctctgcccgctctcccctgtctctgtcccactttctgcctctgttcctccccggctctgccctctccccgcactgtcccccctcgccctcctccgcggccatgccccagacggcgggaaggcggccgggcgtccggccgggctgggcctgggcttggcggctgggccggcgtggggagcggcagctgtttgccattagcccgggatcccacaggccccgccccctctctgcacggggcggggtccttctcgcctccccccaccccgagtttggggcgggaagacccccccccaccaccaccaccgacctccgcgatgtgcaggccggtcttgggtggtgggttggggagacccgcgccccttccctgcgctccctacctgtcccctcttataggctccagtctctccatctctgtcttatcctgtcaccccttccccattccccaggggtcccatggcgagagaagggtctcagccacagacatccatctcccccaccacaccccctcgtctcctttctcttccccttactcgggacgtgctggtcctcatcgagggcggtgagatgactgagtaccctcagacctcagtctccgtatctgggaaacgggtagagatatctgatgtggagtctgagggtggtggcttggtgggcagtggggggatccaccaggcttaggttcatgttcaggcccagccacttccccatggccccagtgaccccgaggaagccactgtacctttctgtaccctctgcatcccctgtctgtgaaacggggcgataagtgcccatctcatagaattgtcatgacaattaaaagagttgatgttaggctgggtgcagtggctcatgcctgtaatcccagcactttgggaggccaaggcgggcggatcacctgaggtcaggagttcgagaccagcctgaccaacatggagaaacaccatctctactaaaaatacagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgttagtattactgttactatactatttacccagcagcaccctcacttcccccacccccagcccaccccgctcggctattccaatcctgctccaatcccgcttgctccctgcttctccatctctctttggtggccagaaaatattttcaatcaactttctgttgctcaggggtgagcctccaggcaaatggaaaacggaatttcctgcaattggtgaccatgtgttccaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtacctgccggccccagcactcaaaggccagaaaggatttactctgatggtgggatgggctggggcctctgcagcatgatggctggaggtcagataacagaaaggaccagccaagttcagatgggttatattggggacaaaagagccctggccggcctccaaggctgaggggggtttagtgagaggctctgactgtccctcccttttgcagcctccaggcgccccctcttacttcctcccctccacccccaggacttcctgggcctccacccggccctctatccctactgcgcccctgggcccggacgcatcctaggcgggcaggaagttctgtgtagcccggcagtgaaactgtttatttttagagaaaattgtttccataaaggggaaaggcttcactcctagctgcctccccaactttccctaccccttccccccgacccagtccaggcctgacccagctctcagctttggggtcactgggggtccccttcgccatgctttgcctctctttgtccccctgcgtctctgtctcctcagatccttgcaggaagacgaggttcccttcttccccaaccccttagcgcctcaacccccatccttccgtgtggccagctccgggcctgggctgaggggagggggtgcaggaagggtggggcctgttgggcttggggccccccagccccagggctatgtggaggctgggctatgggaacagctggagcctgtccagggcctggacagatgtgcaagcaggcagtgaggtttggtttctttgttccagacctgcgggggggagggggtcggggggggcccttccgcagccaggctgggtgtgcgtctatgagtgggtcccagacctgggttggggggctgggtgaaccagctgtggagggggctggcctcatctcctcccctccccctacagactcctaactcccggcgccgtggttctctttccccaggtaagcctcagccggtgctgcaggcagtctgactcgcagtccctcaagtgacttccaaggagcatctgtagaaaagaagatggcccaggtcctgcacgtgcctgctcccttcccaggtcaggggactcagggaagagggccctgccccggggagcttcagttctggaggcctgagggggctggggaccttgccctggggactttgagggtgggacacagcccaacaattagaggtctgagggaggaggcagagtcctgccctgggagggtctgaagggggaggcagagtcttaccggaaaaagggggtagtctaagccgagggatagagccctgtcctgggggatttgagaggcgacatagcctagcgccgggagtctgaaggggaggcatagccctgctctggagggtctgagagcagacgcggttgagtaccaggtgggctcccatctcttcggcaaataaaccccaactctccccaggcatcagtcttcaccctgagaatggggacaagaggattcaaaggtcctggtgtttctcccatccccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggtaagcggtcgcaggcaggcaggggagaatggcttggggggggggggcctctttcttcccatggctcatcctggactctcagaacgccagggtccaggcagggtgcggtggcgcatgcctgtaatcccagcactttgggaggccgaggcgggcagatcacttgaggtcaggagttggagaccagcctggccaacatggtgaaacccatctctactaaaaatacaaaaattagccaggtgtggtggcgtgcgcctgtaaacctcagctacccaggaggctgaggcaggagaatcgcttgaactagggaagcggaggttgcagtgagctgagattacaccactgcactccagcctgggcaacagagggagactctgtctcaaaaaaaaaaaaaaaaaaaaagaatgccaaggtccagccccagcccccgaccttccaccagacacatcagtccaactcttagagtctctgtcttatcatccacaaaaggaggagaattgtgcagccaaccctcagggctgtagcaaccatgcagagaaattaggtgactgccactttgtcagtatccagaaagtgggaggtatttgggggaaagttccccaaggctgttggtttaccaggcagaaacctccctgtttattcagtaagtggcaggaatcaatctcggagctgttcaagcagtgaaaaggaaatgtgttattacgtaactgatgacagcttcaggcatggctggatccaggtgcacaaatatcttgttcttgttgtcgttattaagagatagagtctcgctccattgcccaggctggagtgcagttggtgtaatcatggctcactgcagccttgacttcctaggctcaagcaatcctcccgccttagcctcccaagtagctgggtctacaggcatgcaccactgtgcctcgttaattttttttattttttgtagagacaaagtcttgttatgttgcccaggctggtctcaaacttctgggctcaaatgatgctcctgtcttggcctcccagagtgctgggattacaagcatgagccaccacgctggcctcagtgctcagatatcatcaggaatctaacttggtgcctttctcttcttgttttccctgggagcttctctttcaggcaggcaagggaaagtgacctcactgctccaggcatctgtctgtccagtttagtggagagggagatccttaatccaaagagcaccagtaaaaatcccagagggggccctcattggctggcctgggtcatgtgcccattgctgagccaatcacggtgtccctgtctgcctagccatggacgccgggggtaggggagccccacccaagccctgtggcctttgagggaggaagggggtgcttcccagaggaagtactgagtcctcatgccaggaaaggggatgccggctgtgcagaatgtcagctgctgggttgtcctgaggtccctgggagaagccacccaaatgactcataataatgacagctgggccgggcgcagtggctcacgcctgtaatcccacactttggaggccaaggcaggtggatcgcttgaggccaggagttcaagaccagcctggccaacacagtgaaaccccatctctattaaaaatacaaaaattagccgggcgtggtggcgcacacctgtagtcccagctactccggaggctgaggcaggagaatcgcttgaacccgggaggcggaggttgcagtgagccaagatcacaccactgccctccagcctgggcgacagagtgaaactgtatctcaaaataattaataataataatgacagctggctgggcacggtggctcacgcctgtaatcccagcactttgggaggcagaggcaggcagatcacttgaggccaggagttcaagaccagcctggccaacatggtgaaaccctgtctctactaaaaatacaaaaattagccgggcgtggtggccggcacctgtaatcccagctacttgggagactgaagcacaagaatcgcttgaacttgggagccggaggttgcagtgagctgagattgtgccactgcactccagcctgggcaacagagtgaaactgtgtctcaacaataataatgacagctgttcttctggaaacatggtcagggaggctctgccaggtgcgttcaaactcatgctgtgtgatactggtgagcaacatcacctctctagccctaaacgtccctatctgtgaagtggcatgataatgctctccacctctagagaggtggagaatttatgaattaatgcacacggttaagtactggttgctgcttctgctgataatgttctggtcaacctgttcatacctggggaaactgaggcttagggaggagattcatttgtcctgtgtcacacagccaggaagtggctcaactgagccagtatccaaacccagaacatcaggcctgtaatcctagcactttgggaggccgaggtgggtggataacctgagctcaggggttcaagaccagcctggccaatatggcgaaaccctgtcactactaaaaatacaaaaattagctgggcgtgttggcacacgcctgtagtcctagctaggctaagggaggagaattgcttgaacctaggaggcggaggttgcattgggccgaggtcgcaccactgcactctagcctggatgacagtgagactccatctcaaaaaaaagaaaagaaaagaaaaaagaaataaataaccaggacagcttgaatctgcagcagggctcgaaggtagggcccaagttctcatcccagcctcaaatgtcaggtggccagagcccctaccaacagactggagggcacaggctggagggcagggacccagctgtgttttctcgccggcccgtgttgttcctggccagctctggacaccacccgcctgttctgtgtctatcccaaacaccaggtcctgaggttctggccccctgccagaggctccgcctggcccagcctcggaatctctgagaggcaaccaccattccagacgtgcctcccagagcagctgagaggccttctgcctgcaggacaaacagacatagcgatgtccaccttctttgcattcaagctgctgcctgaaagttcttcctggagtctcattttattccctcttgctgcagccagccccaatctctgccttgcttgagccaagctggaatgtcttaattcatttctatatcttcctttttttttttttttttttttttttttttttgagacagagtcttgctctgtcgcccaggctggagtgcagtgatgcaatctcggctcactgcaacccccgcctcccgagttcaagcgattcttctgcctccgcctcccgagtagctgggattacaggcatgcaccaccatgactgactaatttttgtatttttagtagagatggggtttcaccatgttggtcaggctggtctcaaactcctgacctcaggtgatccaaccttctcggcctttgagcaagcgatgaaatctctctatgcctcagtttcctcatttgcaaatcgggggtcctgatggcacagtgtcactggaataatgtgaggctttaatatgtcaattcagccaggcgcagtggcttatgcctgtaatcctggagctttcggaggccaaaacaggaggactgcttgagcccagggggtcgaggctacagtgagttgtgaccacgccactgtactccagcctgagcaagaccaatcttgtgggcgggggtggggggggagagaatcaattcatgtcaagtgttcatcatggtaccaggcatggttgatacttggtgcccaaggtcagctcttggccctatagcctctcaaaggagcatttttttttttttttgagatggagtcttgcactgccacccaggctggtgtgcaatggcgctatctccgctcactgcaacctccacctcctgggttcaaacgattctccttgcctccaccttccaagtagctgggattacaggcacccaccaccacacccagctaattttcttgtacttttagtagagacggggtttcactatgttggccaggctggtcttgaactcctaaccttgtggtctgcccgcctcggcctcccaaagtgctgggattacaggcatgagccacggcacccaccctccaaggagcatctttgaatgaagacatgaaagaagtcaccagaagaggtggaaaaaacaatgttccagggaggagcacagcagggacaaaggccctgagataagcaaaggctcgggcttatcaaggggttgaacaaactggaatgagctaccgcacccagcctaaattaaaaaaaaaaaaaaaaagaatttacatgggccgggtgtggtggctcatgcctgtaatcccagaactttgggaggccaaagtgggcagatcacctgaggtcaggagctcgagaccagcttgggcaacatggcaaaaacccctactaaaaatacaaaaattagccaggtgtggtggcacacacctgtaatcccagctacttgggaagctgagacaggagaatcgcttgaaccggggaggcggaaattgcagtgagctgagctcgcattgctgcactccagcctgggcgacagagtgagagtgagactccgtctcaaaaaaaaaaaaaattattttggccttcaggagtccaaaactgagttcatctcattcctcagctcctgacaaccatccacgttagcctgtgcagaccacttctcttgtattacttattattttttcaccttcagcctccaccttcaaccttcaatgctaagggtcagtaaatattttcacttttgcaggtcatacggtctctattgcattgattcaactctgcctcagttcttttttcctccccactttatttttattcctttcatcctttttattgagatgaggtctcactatgttgccagatgaggtctcactatgttgcccaggctggtttcgaactcggggactgaagtgatccttccacgtcggcctcctaaatagctgggattgcaggcgtgtgccaccgtgcccagctttttctgattttattgacgtatacttaatatgcaaaaaaatgcacatatttaatgtatacctttttgaatttggtgcttcagggccttcattttgcagttgcaaaagcagccgtagacaatatggaaatgaacgaacgtggctgcgttccaataaaactttatttgcaggaccctgaaatttctatttcacatacttttcatgagtcccaaattaaattcttctttcccatccatttaaaaatgtaaaaacagcacccacagactgaagctcaccaccctccgctctccaccgtcagtgccacccccaccccatctaatcccattccttacaaaccaccttccagaaacttatttagacatttgagtgtccttgaaaaatatgccttgtgcgtgtttcatttccttaaatggtgttgtgcttcagaaaaaaatctctttctgtttcttattttttcctctccttacactatttttgaactctccacactgaggtttgtaaatctgatttatcactttttattttcttttttttcttccttttttcttttgagatggaatctcgctctgttgcccagggtggagtgcagtggcgtgatctcagctcactgtaacctctgcctcccgggttcaagcaattctcctgcctcagcctcccaagtagctgggattacagatgccctgctaccacgcctggctaatttttgtatttttagtagagacggggtttcaccacgttggccaggctggtctcgaactcctgacctcatgatctgtccgccttggcctcccaaagttctgggattacaggtgtgagccaccccacccacctaccctcttctctaatcccttcacagtaggtatctggttacttctaatttccggccaccacgaacaatgctggagtcatcttcacacgaccccttctgtgggactgcccattcctagaggatttgcaacttcactccaagtcctgtctgatcctttccaaaaaaggctgtccctatccgcactcctaacaccgtgctccggttcaagttgtccattttctcatatcctcaccaacatatggctttatctgtctttctaatttttcttctttttttttgagacagagtttcactcctgttgcccaggctggagtgcagtggtgtgatcttggctcaccgcaacctccacctcccgggttcaagcgattctcctgcctcagcctcccgagtagctgagattacaggcatgcgccccaccacgcctgactaattttgtagttttagcagagacggggtttctccatgttggtcaggctcgtctccaactcctgacctcagttgatctgcccgccttggcctcccaaagtgctggaattaacaggcgtgagccaccgcgcctggcctcttctttctttctttttttatttgttgagacagagtcttgctctgtttctcaggctggagtgcggtggcgcgatcttggctcactgcaacctccgcctcccaggttcaagcgattcttgtgcctcagcatctctagtagctgggattacaggcacccgccaccacacctggctgatttttgtatttttagtagagacggggtttcaccatgttggccaggctggtctcaaactctcatccttaggtgatccacccgccttggcctcccaaagtgctgggattgcaggtgtgagctaccacgcccggccctgtctttctaattttttttatccatctgacagctgctacataatggtatctcctcattgttttgtttgttttttgagacagggtctcattgtgtcacccaggctggagtgcagtggcacagtcacagttcactgcagcctaaacctctcgggctcaagtgatccctccacctcagcctcctgagtagctaggactaaaggcaagtgccatcccattcaggtaattttttgtagagatggggtcttgctctgttgttcaggttggtctcgaactccagggctgaagtgatccacctcagcctcccaaagccctgggattataaatgcgagcctcggaattcagccctccttattgttttcattggcatagctctgataggcagtgagagatagggcttctctgtgtatgcctaataaggttcctctgtaagtcaattacttgtagcctttctccattttttctctgagcagtttttagaagttgctggtatcttccagagtcaaaactggcaaactacggcctgtgggccagatacagcctgaaacctgtttttctacaacccacagctaagaatgatttttacgtttttttttaatggttgaatgattttaaaaatatattttgggccaagtacagtggctcacacctgcaatcccagcactttgggaggccaaggcagaaggatcacttgaggccaggagtttgagaccagcctgggcaatatagtgacaccccatctctactaattaaaaattagtttggcatggtggcgtgcagctgtagtcccagctacttgggaggctgaggcaggaggattccttgagcccaggaattttgttgttgttgttgtggagatggggttccaccatgttgcccaggctggtctcaaactcctgggctcaagcgatccacccacctcggccccccaaagtgctgggattacaggcgtgagccaccatgcccggcaagcccaggattttgaggctgcagcaagctatgattggactccagcctgggcaacagaagttgcctgaagtagactgggcgtggtggctcaactgaggtcaggaggtcgagaccaccctggccaacatggtgaaacccatctctacaacaatacaaaaattagccgagcatgatggcgggtgcctgtaatcccagctactcgggaggctgaggcaggagaatcacttgacctcgcgaggcagaggttgctagtgagctgagatcacgccattgccctccagcctgggcaacaagagcgagacttcatctcaaaaaaaaaaaagaaaaaaaagaagttccctgaagtcactgcctgcttctctgttggggcagaatgggatttaggcgctgctctagtttatttattgatttttttttttcacattaaaaaaaaagtagagtcttgccctgtctcaaaaaaaatatttcttgacatgacaagattatgtgaaattcaaacttattggatacagccacgcggaatcacttacatactgtctgtgactggttttgtgttagaactatgccacagttgagcagttgcaaccgagtccttatgtgtgacgtaaccaaaaatgtttgctatctagcccttcccaggtttgttgaccctgttctagaagattatcccttgccaatttttgcctgtgccaaactccggcactcccccaccgcacccatgaggatctcagaggtcttcatttttgtttttgtttttgtttttgagacagagtttcgctctgtcatccaggctggagtgcagtggcacgatctcggctcactgcaacctctgcctcccaggttcaagcaattctcctgcctcatcctcccgagtagctgggattacaggtgcctgccagcatactctgctaatttttgtattatcagtagagactgggtttcaccatgttggccaggctgatctcgaactcctgactcaagtgatccgcccaccttggcctcccaaagtgttgggattacaggcatgagccaccatgcctggccagaagtcttcattttgaatataggtaaaaccattatattttgcatatgtggattgtgcttggaagaatttttaaaagaatcttaactgggcacattgactcacacctgtaatctcaacactttggtgggaaaattgctttgagcccaggagttccaggccagcctaggtaacatagtaagacccccatctctacaaaaaatacaaaaattggccaggagttcaagaccagccttgccaacatagtgaaaccccatctctactaaaaatacaaaaaaattagctgggcatggtagcgggcacttgtaatcccagctactcgggaggctgaggcaggagaatcacttgaatcagggaggcgaaagttgcagtgagctgagatggctccactccacttcagcctggggtgacaatgcgagactctctcaaaaaaaaaaaaaattagctgggcatggtggtgcatgcctgtagtcccagctactcgggaggctgaagtgggaggatcacttgagccgaggagttcgaagctggaatgagctgtgatcacgccactgcgctccagcctggacaacagagtgagactgtgtcactggatgaatgaatgaatgaatgaatctttccctttcctgagtccctgatagtctgctacattatctccctttagctttgtagttgtaccttcatcttaattcttcacagtttctttcttgtgtatgctatgagatagagatccagcttggctcttctcatgtaaagtaagctgcttctcctaaaaccacaccacagaatccaccgtctcccactggcttggggaaaccccctctgtcttaccctcagtgcccagagattggagcctgtcttctctgtcccattggtccatttattaatgcaaaaatgccctgctgttctcatggttgtagctttgaaatatgttttactctctcacagaccaactactccatctgtgctcttgttttgtagaattgtcttagcttatcaatggactttagttcttttgtgtaaattttagtgtcagttggccccattccccagtgggataacaataataagtatcatcaattttattattacttcttgttatgctagcattccaagtctaaccttcaattccttagactggaaggagccatcccaggttttgaagtcactgcctgcttttctgttggggcggagtgggctttggttctgctctagtttgtttgattttttttacttttttttttttttttttttttgaggcagtctgactctgtcacccaggctggagtgcagtggcataatatcggctcactgcaagctctgcctcctgggttcaagcgattctcctgcctcagcctcccaagtacctgggactacaggcacgtgccaccatgccttcctaattttttatatttttagtagagatggggtttcaccgtgttagccaggatggtctcgatctcctaaccttgtgattggcctgccttggcctcccaaagtcctggggttacaatcgtgagccaccgcgcctggcttttttgttttgttttgtttttttgtttttttttttaaagatagggtctcactccgtcacccaggctggagtgcagcagtgctgtcatagctcaatgtaacttcaaactcccgggctcaagcaatcttttcatctcagccaagtatagtcccaagtagttagaactataggcgcactccaccacacctggctaactttttaattttttgcagagatagagtcttgctatgttgcccaggctggtcttgaactcctggcctcaagcgatcctcctgcctcagcctctcaaattttttcgccatttacaatattgtggtaacatagatagaacataaaatttggcatctggccgggcgtgttggcttaagcctgtaatcccagcactttgggaggctgaggcgggtggatcactggagattgggagttcaagaccagcctggccaacatggcaaaaccccatctctactaaaaatataaattagccaggcatggtggcacacacctgtaatcccagctactcaggaggctgaggcaggagaatcgcttgaacccaggaggcagaggttgcagtgagccaagatcgcatcactgcactccaacctggatgacaaagcaagactccgtctcaaaaaaaaaaaaaaaaaaattaaccatcttatccatgtttgagtatgtaattcagtggcattaagtacatttgcatcatttttttgtttgtttgttttttcttgtatttgttggggataggatctccctatgttgcccaagctggtctcacactcctgggctcaagtgatcctcccccttcagcctcccaaagtcctgggattataggtgtgagccactatgtccagcccattcacactgttgcgcaactgtcaccatcatccatctttagaactttctcatctttccaaactgaaactgtccccattaaacacacttcccattctccttcccccagcccctggcacccaccattctattttctgtctgtttaaatctgataattctagggctgggcgcagtggttcccacctgtaaccccagcactttcggaggcggaggcagatggatcacttgaggtcaggagttcaagatcaccctggccaacatggtgaaaccttgtctctagtaaaaatacaaaaattagccgggcatggtggttggctcctgtaatcccaactattcaggaggctgaggcaggagaatcacttgaacctgggaggcagaggttgcagtgagccgagatcacgccactgccctccagcctggacgatggagaaagactgtatcaaataataataataataataataataataaatcttgacaactctagggaactcctgtgaatcaaatcatgcaatgtttttgtcccttttgcatctggcttctttcacttagcataatattgctccacctcattttttggctctcccagaattttttttttttttttttttttttttttggagacaagagtctcgctctatcccccaggctggagtgcagtggcatgatctcggctcactgcaacctccgccttccgggttcaagcgattgtcctgcctcagcctcccaaatagatgggatcacaaatgtctaccaccatgcctggctaattgttatatttttagtagagacggggttttgccatgttggccaggctggtctcttaattcctgacttcaagtgacccacccacctcagcctcccaaggtgctgggattacaagcgtgagctactgcgcccggcctctccaggatttcaagttaggcgccctgcattttgggcagagattgagattgtgaatctgtctcctggccatgcagtatgtttgtttgtttcacgtgaatttattgccaagtttaaaaagaaaaatcatagagggacatagcaactggcgtttgctctcgctcagttccccactcatgagttcaagccttggctctggcatggtttttatgttttctgtggtatgagctggccacaccctggtctggggatgctgttggccatgccgatgaccgagtgtctcatgcagccggccctgtctatgttactctttgcctatgtccagcatttggtcaccgttctgtactaaagttgaatattgcctgtgggcctcaggaagtcactgtatatggcaaaaaaaaaaaatttaaggctgggcatagtggctcatgcctataatcccagctatgcgagaggctgaggtgggaggatcccttgcgctctggagttctagagcagcctggacaatataacaagaccctgtcacaaagaaaaaaaccccaacaacctttttagccattaaagggaattcaaattaattggtcttcagagttggcgccccgggggacaggaaggggaacccccgaggaaatgctgacacagaaaccatgcatgggctgggcggtgctgctccggaggtaatcccagcactttggaaggcggatcacttgagctcaggagttcaagaccagcctgggcaatatagtgaaaccccatctctacaaacattacagaaaattagctgggcacagtggcatgcgcctttactgcctgccgctcagggggctgaggcaggagaatcacttgaatccgggaggcacaggttacagtgagccaagatcgcatctctgcactcaagcttcagtgaagggagtgaaaccctgtcttacaaagcagccatatgtggcccagggggacctgagtggattccaagacattggtggctacacaaaaaggaaactggacttttattccacgctgttggctggcagtccaggacctcagcatccaggaagtcacctttgtcctcagaccaacctgggtgggtgttttttgttgtcttttgttttcttttgtttcgtttcgtttttttagtcaggatgtgttttttttttttattttttattttcaggacagtctctctctgttacccaggctggagtgcagtggtgtgatctctgctcactgcaacctctgcctcccgggttcaagcaattctcctgcctcagcctcctgagtagctgggattacaggcatccccccaccacgcccagctaatttttgtatatttagtagagatggggtttcaccatgttggccaggctggtcttgaactcctgacctcgtgatctgcccgcctcagcctcctaaagtactgggattacaggcatgagccactgtgcctggccaccaagacgtgtttttatctctgatttttttttttttttgagaggcagggtcttgctctgttgcccaggctggagtgcattggcgtgatctctgctcactgcaacctccgcctcccgggttcaagcaattctcctgcctcagcatcctgagtggctggaacgacaggtgtgcaccaccacgcccggctaatttttctatttttagtggagacgggatttcaccatgttagccaggctggtctcgaacttctgatctcaggggattcgcccgcctcagcctcccaaagtgctgggattacaggcatgagtcaccgtgcccggccaaaccttatttttagcgatcactcaggctcgagccaggaatatggggccacagggttgtccctgtccctgactagctgctgggcaggcaccaaactggattctgccacctgctcaaggggttaccttggcagctctgtgcctcagtttcctcatctgtaataatccgatttccctccaaggggcaggaagactggatgtggtaacacaaaaatcagccctgttacagctcctggcccagggtgtatgacccgcagggctgtggtggtttggcttttatgaccaagagcagacactcatttcctgtccctccaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggtaagtggtgggtggccgccaagagggacggggcaccgggatggcgccagttcggagtctggccctgaaggactctcacagcacctccgctgtcctcccctccaggcgggcccccggcaggcgtgcgatctatcatgaaacggaaagaggaggttgcagaccccacggcccaccggaggagcctccagttcgtgggggtcaacggcgggtgagaggagaagaccccaccccccaccccatacttcccgcccctcctccattcatccacgcacgagagcctcctaattacctcattctgagctccttgctttggttaattcgtttaatcaaaccacaacacagagatgaggaaactgaggcataggaaggctaagcgcatttctggagctcactcagtgacccaggagtcagccctgcgtgccctggctcaagagctcaaggtgtaaccactgcacagctctaccccacagaaggtgccggacgccgcttcctgccctgatagagctcctggtccagtggggagctgggtgctgatgggtggttggagccgtgatggggaacactcaggtggtgcaggtcctcaagaaagacacaggtggccctaggggagtcccagaaggaggagacacaggtggtacgggagaagtaggagctagcaaggtgaagagagggtgtggggagggctcttctggcaggggcacagcgtgggtaaaggctcagaggtgggaaagcagagtgacacgagaagtgggaggtgcagggagtgatggttggtttggggccttgaatgccgagcctagaagcttgattaggttttgtccagagccagcaagaaacacgagagagccctatttgcagtggaacaggagtctgaatcacctgtgttaaaagggctagaagtggccgggcgcggtggctcacatctgtaatcccagcactttgggaggctgaggcgggtggatcacttgagttcaggagttcgagacaagcctggccaacatggtgaaactccatctctactaaaaatacaaaaaatagctgggtgtggtgggtgcctgcagtcccagctacttgggaggctgaggcaggagaatcgcttgaacccaggagacagaggttgcagtgaactgagattacaccattgcactctagcctgggcgacagagcgagactccgtctcaaaaaaaaatggctagaggtggctgtgcgcaatggctcacacctgtaaacccagttcgagatcagcctggccaacatggcaacatggcgaaaccccgactctactaaaaaatacaaaaattagccgagcacagtggtgcaaacctgtagtcccaggtatttggaaggctcaggcagaagaattgcttgaacccaggaggcagagtttgcagtgagtgccactgtactccagcctgggcaacagagcaagactccatctcaaaaaaaaaaaaaaaaaaaaggagggtgagtatgctagaagtgtcaaaaggcaggaggtgaaaagcagtgcccctccccccgagcatgatcataatcactgctaatgtttattgagcgcttactgtgtgccagttgctgtaaaccacatcccacaaccctggaatgtcaatactgccattgaacagatggggaagctgaggcccacagaggtcagatcaccagatccctgccttcctttcccaccatttctcatcccacctgcagcatctccccctccccgctcgttcctccccaggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggtcagttttctgggtaggagggattcaggcagggccgggggtggatgacctctgcctcaaacccccaccgttcaagccctttgaaggaccctcctatcagtcatgcacactttagtctgaattagcaaacgagcacttgctccttctgggcatctgaagttctggaggctttgctaaagggcctggtggaactattttgggctgccggggttaggatttaggggaccagccaaagtttatcccaaaatcacccacctactttgggacgtttcctctacctgtctgttctatttatgtctcttttttattcccctggtgaaaaaatttgcccttgggaaatattttccatctgccagtgggcatttggaataaactttggcttgtgtgtccactctcccttgggggtctgcatgttccccacagctgccccttggggtgcaatgtaaatgtgtgtcccgggtgaaggagggtctgagatgccaccattcaggtgaccctattgtgagtgacgtggtgcagaatgtcaagtcccttcccaggcaccgcagcggggcttacttagttccccgctttgtctgttcctggcaggatggagctaagccctgacctcatctcagcctgcttggccctggaaaagtacctggacaatcccaacgccctcacagagcgggagctggtacgatctggccctgggcctaggttggccaccccccggacccctacctccaccccacccgtggcctctcctcatcctcagtgacttcctgctcctgcctagtggggaccctgacactgaagcccagagcatgggggtggtggtgctcaagtcatgggcctcggagagaggccagggagatggggagaggctggaggatgaacactcactggccaagcctggccttgggttcctgttcttcctgggggcttcaggggcggggcacccagatttccctttttgggcatctacacttgactttggcgattataaccagggctgggcgcagtggctcatgcctgtcatcctggtgctttgggaggccaaggcaggaggatcgcttgaggccaggagttcaagaccagcctgggcaacatagtgagaccccatttctacaaaaaaattctttttttttttttttttttttttttttttgagagggagtcttgctctgtcacccaggctggagtgcagtggtgcgatctcagctcactgtaacctctgcctcccaggttcaagcaattctcctgcctcaacctcccaagtagctgggactataggcatgtgccaccacgtctggctaattttttgtattttgagtagagatggggtttcaccatgttgggcaggatggtctcgaactcgtgacctcaagtgatccgctcaccctggcctcccaaagtgctgggattacaggcgtgaaccactgcactcagcctctacaaattgttttaaaaattagctaggcatagtggtgcacgcctgtggtcccagctacttgggaggcagaggcgggaggatagcttgagcctaggaggttgaggctgcagtgagtcctgatcatgtaactgcactccagcctaggcaacagagcgagactctgtctcacaaaaaaaaaaaaaaaagagagagagagaaattatatccagggtggaggtgctcacaccttccttggggaacgtgttggggattgcaaagtccacacctcactccaagggtcttattgggacagagatgtctacacttccctttgggagggtctgcacttcccttgagatcgttttccaggacaagggcaccacgctttgctccgggggcgcatctggggtggggggtgtcccagtgggcctcccccgccctcacatcctctcccacctgactcgcatgcagaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgagcccagcggggaggacgaggcggctctaaaccagccagctgtccgccatgcccagtctgatagggaagacactgccctccccatctgatggggaagatgatggaggagacgcggccttctcagtataatagagggaacacctctctcccagtctgatgtggcagatgccaccttccgattggatgtggagggacaccagccttccagtttgatagaggagacggcaccttcccagttcaatggggtggggtatatggccctcccagtctgatggaggagatgccgccctcccagtctgatggaggagatgccaccctcccaggctgatggaggagacaccttcccagttcattgtggtggggatgtggccctcctagtctgatggaggagatgctgcctccccagtctgatgggggaaatgtgactttcccagtttgatatgggagatgccacccttccagtctgatggggggggcaccaccctcccaggctgatggaggagacaccacctgcctagtttaatggaggagacatcatcttcccggttcattgttgggggaatgtggccctcccagtctgatagaggagacgctgtcttcccagtcaaatggcagagacaccaccctcctagtctaatgagtgagacaccaccttcccagtctaacgagggagacatgactctcctagtctgatagcagagactctaccctcctggtcttatgggggagatgctgtcctcccagtctgatggaggagacacttccttcccagtctggtgggggaggcacgggccctacctttagccagcataatggaaaaggcagaagtgatgttagggaaacgtgtgaacctaacacgcctgcatgatggaggtgacatctctggagccctggtctaagagagggatgcgtcctcaagtctggggcttggaaagaagacgtggtcctcagttagtaagaaacttgcccttccctctcctactgggggagacagcctcccgggctgatgaaggactcagggcccacaatctgatgggggagacatgggccagtctgagggtaaatggctgttccaaaattaacaggggagacccagtttctattctcagccctaaatatagatgccagcatcaggggccccaaatctgatggaggaggaactgtctccaactttaggagccccaggtctaatggagatggagacctctagggcagagtggggtcctctgagaaaagggagggattagggcatgcctagactgatggacgagacgtggtatccacgttccttggggcagtccactagcagcgatccctggtctgagggttcacaccatgtctcttaggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggtatggggaccccggctgctgcagatccaggtggctcttcctactttatgacatcccagctgagtgacaggcccaaacccaggtggtctaactccagagccctgctcttcatggccaggctgtctctgacacaggaccttcttgtggaaactagaaggagtagaggatatgagggtccttacctttcttaatatgaccccatcccacatcctgctggacagttcattgagcagcagctgggttccctgggccgaaaactggggactgaaatggcgaacaagcaggcatggtctcctgaagctcactagcccgttcttcaagccataagcattttagggagcaccgggactcaagccagtttggactcagggctgcaggaaaccgccaggggaatttaggcagggaagtggcgtggcctgattcctggtttgagcgctcccttcagctgtgtgttgggaagcagaaacaggcactgtggaggtgactggggcttatgaacaggtgtctgggcaaaagagcagggaagccaggacccactgaggacagtgaggaggagagggatcgtcaacagtctgaagacagcaaaggaacaaaatggagctgtgacggggcataacaggcatgatcctgccttatctttattgatttaattttgttttaatttccaagaaatttttttagtggcttcattttcaaaaaattaaggccaggcgccatggctcatgcctataatcccagcactgtgggaggctgaggtgggtggatcacctgaggtcagaagttcaagaccagcctgaccaacatggtgaaaccctgcctttactaaaaaattaaaaaattagctgggcgtggtggcacgtgcctataatcccagccactcgggaggctgaggcaggagaatcgcttgaacctgggaggtggaagttgcagtgagctgagatcgcaccactgtcctccagcctgggctacagagtgagactctgtctcaaaaaaaaaaaaaaaaaattagccgggtgcggtggctcatgcctgtaatcccagcactttgggaggccaaagtgggcagatcacgaggtcagtagtttgagaccagcctaatcaacatggtgaaaccccatctctactaaaaaaaatatataaaaattagctgggcatggtggcatgtgcctgtaatcccagctactcaaggcaggagaatcgcttgaacccaggaggcggaggttgcagtgagccgagatcgcaccactgcactccagcctgggtgacagagtgagactccatctcaaaaaaaaaaaaattaaggtgaggctcaccaaggtggctcatgcctgtaaccccagcactttgagagaacaaagcgggataaattgcttgaggtcaggagttccagaccagcctggggaacctagagacacccccccacccccacctcctctctattaaaaaaaaaaagaaggtgaaattcacaaaacataagattaactcctttatttctaactttttattttattttatctctattttttatttttttgagacagggtctcactgtgtcacccaggctggagtgcagtggtgcaatcacagctgactgcagccttgacctcccatgctcaaacagtcctccaacctcaggccaccaagtagctgggactgcaagcgtgcggcaccatgcccggctaatttttttttagagttggggttttgccaagttgtccaggctgtattttattaattttattttttactagagacatggtctcgctatgttgcccagactgatctctaactcctggggtcaagcagtcctcccacctcggcctcccaaagtgccaggattacaggcgtaagccacagtgcccagaattaacccttttaggctgggcacgatggctcacgcctgtaaacctaggcgggcggatcacgaggtgaagagattgagaccatcctggccaacatggtgaaactctgtctctactaaaaatacaaaaattagctgggcgtagtggcacacgcctgtaatctcagctactcaggaggctgaggcaggagagttgcttggacccaggaggtggaggttgcagtgagccgagattgcgccactgcactccagcctggtgacagagcgagacgccatctccaaaaaaaaataattaacccttttaaaggaacaattagcctgggcaacatggcaaaaccctatctatacaaaagatacaaaaattagccaggcattgtggcgcatgcctgtagtctcagctactcgggaggctgaggtgggaggatcacctgagcctggggaggttgaggctgcagtgagctgcgatcgtgccactgcacgccaacctgggcaacagagcaagaccctgtctctaaaataaagcaaaacaaaaccaaaagcactactggcatgaaatacattcaccctgttgtgcaaccaacacctccgtctagttccagaacgttctcttcacccccaaaggaaacctgtatccatcatttcctccgcccccgcttctcccagcctctggcaaccactcatccgctttctgtctctgtggatttattactcccctggtgacgggagggttgtttgagattcaggaggagatcagcaagttgagggtacatttcaccatcagagtatgtgggagctacagcaggttctagaccagggggtgtcctgccctggggcctgcatgaaccataatcctgttccttgccctccccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgtgagtctccaaccaggtgcaccccggggagggcgggagcacagcatggggacgtcattcatagcaccggatactttgcaggatgggagcacagctctgatggtggccttggacgcagggcagagtgagattgcgtccatgctgtattcccgcatgaacatcaagtgctcggtgagtctcaatccggccgggtaggcacgggatgggtgggtctctgaaaggacagagatttgttgtttttgtttttgaggcagagtctcactctgtcgcccagggtggagtgcggtggcacgatctgggctcattgcaacctccgcctcccggcttcaagccattctgctgcctcagcctcctgagtagctgggataacaggtgtgcaccaccacacccggctaatttttgtatttttagtagagacggggtttcaccatgatggtcaggctggtctcaaactcctgacctcgtgatccacctgccttagcctcccaaagtgctgggattacaggtatgagccaccatgcctggtcttgtttttgttttcagactgggtcttactctgtcaccaaggctggagtgcagtggcacaattaaagctcactgcaaactccacttcctgggctcaagtgatcctttcacctcagcctcctgagtagttgggactacaggcgcacgtcaccacacctggctgagttttttttgttttgttttttgagacaaagtcttgttctatcacccaggctggagtacagtggcacaatcttggctcactgtaacctgtatctcccaggttcgagcaattctcctgcctcagtctccaaagtagctgggattacaggtgcacaccaccatgcccggctaatttttgtatttttagtagagatgggatttcactgtgttggccaggctggtcttgaactcctgagctcaagtgatctgcccgcctctgcctcccaaagtgctgggattacaggcgtgagccactgcacccggacattttttaacatcttttgtagagactgggtctcactatgttgcccaggctggtcttgaatacctgagcttaagccatgcttcctcttctgcctctgaaagcgctgggattacaggggtcagccactgtgcctggccagaggagacggatgtttatgaagagctgattgtgcatggggttcacgctaaggataaagtcagaatatggtcagctgcttgctgaaccttcatagtgccccagtgaggaaattagtcacagagaggctgcatggtcatggttggcataacagtattcacgcctgggtctgtctggttccaaatgcgtgtcttagtcaccattcactcatttgaaaaatatttattgagcgcctgctgcatgttaggcccagttctaggtagtccccagtggtcacagcactgatcaaaacagaaaacagtatccacccttatggagtgagcattctggtaagagacacaatcaggctgggcgcggtggctcacgtctgtaatcccagcaccttgtggggccgagatggaaggattgcttgaacccaagagttcgagaccagcctgggcaacatagggagatcctgtctcccccaaaaatacaggtgcatgcctgtactcccagctactcgggaggctgaggcaggaggatcacctgaacccaggaatttgaggctgcagtgagccatggttgcatcactacatggtgacagagtgccgccttgtctgggaaaaaaaaaaagaaagaggccaggcgtggtggctcatgcctgtaatcccagcactttgggaggccaaggtgggcggatgatttgagataaggggttcaagaccaggctggccaacatggtgaaactccatctgtactaaaaaaacaaaatattagccgggtgtggtggcgcatgcctttaatctcagctattctggaggcttaggcgggagaatcacttgaacccaggaggtggaggttgcagtgagccagagatcatgacattgggcaacaagagcaaaactctgtctcaaagaaaaaaaaaaaaaaaaaaaaacaaggacgtgggatggcgagtgatggggaagctattggagtccctcagagaagagatgacatttgagtcaacacctggagaagttagggagtgaatcacatggtcttccgggcagcaggaacaagcagtgcaaaggccctgaggcaggggtgtgtctgacgtgtttaaggagcattcaggccagactcactggttcacgcctgtaatcccagcactttgggatgccatggcgggcagatcacctgaggtcaggagttcgagaccagcctggccaacatggtgaagccctgtctctactaaaaatacaaaaattagctgggtgtggtggtgggcacctgtaatcccagatactcgggaggctgaggcatgagaattgcttgaacctgggaggcagaggttgcagtgagctgagatcgcgccactgcactccagcctgggtgacagagtgagattccgcctcaaaaaaaaaaaaaaattagctgggcctggtggtgcatgcctatagtcccagctactcgggaggctaaggcaggaggattgcttgagcccagatagtcaaggctactgtgagctatgattggaccactatactccagcctggcaacagagcaagaccctgtctttaagcaaaaaaaaatctaggccgggcacggtggctcacgcctgtaatctcaacactttgggaggccaagatgggcggatcacctgaggtcaggagtttgagaccagactgaccaacatggagaaaccccatctctactaaaaacgcaaaattagccgggcgtggtggcgcctgcctgtaatcccagctactaaggaggctgaggcaggagaatcacttgaacccaggaggcagaggttgcagtgagctgagatcatgccattgcactccagcctaggcaacaagagtgaaactctgtctcaaaaaaaagaaaagaaaaagccagggtcctctccaaagcccaccaggccctgcacaaccaccctcaccttccccactactgtttctctccccctctagccacactggccttattgccacacccctctgcacttatcccagggcctttgcacgtgctgtttccgctgcctggaatgctcttccctgctcgctggctccttgatgccgttcacagtcagctgagaactcaccctccctgaccagccactgtccaccctcattcctttgcatccctcacccccggtgaacatcctcaaccacagtcatgagtttgcttcttcaaggcggtgcccccagatcgccacctccttggggccaggggccacgcctccctcctgcttacccatcatatctaccaggccagccaccacgttggcgcctcgggggattggaaaggatcccaaacaaaaagaattctgcttctctgtttcagtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgtt

SEQ ID NO: 38364 - DNA, 53845 bp, Homo sapiens
cccgccgcccgccgcccgccgcccgggccactgcaggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcgggtgagtgtcgccgccgcccgggttcggccggacctggccagggagcgggggcggcttgggggacccggctggggggaccgggtgcagggagcgagcggctgtggtaaggccgggggccctgggagcgcaggcgccagggaggggtcggggcaggcgggagggaggccggggccaggggccgggctgtgcgccgccgtctgctccgggaacccgaggacaaagcgccgcgcagtggaggggaggccggcgccccatccccgcggggaggtgggacccggggcgcggggtcgtggcccccggtgcggtctgtccgcagggcacctctggacaagacggactgtggatggatcccgagggggggtgccaggcgctccccaccgcgcgcattgcagtttactccaagaacagatgcttttctttagcagggatccgaaacctgagaggcgcccttgcagggtgaggacttcctgttaagaagttaaagaaggggcccctgactttctgtggggtgtgctccctgctcgggatgggggaattggtttccgtgccacgggttggctacttgccccgcagaggccctccggatgaggagaagagtgactttggtaaacatggaggacgcatagcccaccctggagagagccctgcaggaggacagagggtttgtttttgttttttgttgttttttgtttgttttttgtttttttttttttttgagtcggagtgttgctctgttgcccaggctggagttcaatgccacgatcttggctcactgcacctccgcctcctgggttcaagcaattctccctgcctcagcctcggagtagctgggattacaggagcccgctactacgcccggctaatttttgtattttagtagagacagggtttcaccatgttggccaggctggtcttgaattcctgacctcaggtgatctgcccacctcagcctctcaaagtgctgggattacaggtgtgagcaaccgcacccagccttttttctttttaattattggggtgggtgtggcagaggccaggattcatgctggatgtgcggagctggaatggggtgggtgtggcggaggccaagattctctggtggatattcggagcctgggatgacacctttagaccctgtgggcagtcgaggtcaggagttcttctgggcgctttctggtgctgagtggtgaggatctgtgggttgggttctggtggggacagagttgaacgttaggtggggccaaggtcgaggggtggtctcagacccatgaccaacacttggtttccagccctggggtcacctatctgtggctgggcatctgagacttgactttcctaaggtatttctcatgtcccctttggtagaaatgtcacaccccaaatatcacccaccagggcccacacacaaggagaacaggtgcctgacctgggcccgaagggtttgtactttgttgtaaatccctaggcttcaggaagatgactgcctcccccaagcacttcctaagtgcgggccactgggcttcaaaccggatgggttcctgagaggcagctgctcccgtcctagggatgcaggggccgatctgcaggggctggaagtgactggcccaattagctgctgtgcttgtagccactgggctgtaaggcttccctcaggctccagccgccgcagagacgccagacccttacagggcatctgtgtgggaggtcagtcatcactgctttctgccttggcgtccccagccagctcccattatggtttctggtcccccaggtcagggcttggtgtggtgtggcgtctgcttttgtccagcctgctggggtttgcctcttggcatgctaattgcttcactcttgctaagccaaggtgcttttgtgcgggttcatcctgagctgcctgactggcctgccaggagcttggtccctcttggagagggagggccctggtttgtggggccatggatggtggggccctggctggtggccctggctggtgggcttcctccaggaagcagcctgccctctccacccaggagtgctctcccatgcaatgggaaaacatcaacaagttgggaaacgctaagttgtgaatgagttcaggaatacagccacactgtctctagtttttttctcatagctttacagtccccaaaaggaatcaggcccaggttcgattcttctatgcttgaggtcagtagggccatagtagggcagaagaatgtgaaccagctcacaggacatttaatttggtcagcaaggtggcattgcccagccctccccattcccccaggtgtatctgggcacactgggattgattaggttgaggaatgatgagaggtggagaattgtgcaaaaactggccctaggaggacctgtgagatgaggcaggagcagccctggagctccaggtgaccaatgggctaaagacaaagccaaggccactgtgtgtgccctgctggggtggccgcttagttattccgactcctttgttttctccgtagcatcacccctatttcagatgtggacagtaggagtgggaattgactgggcccagaggcagtgatgtacagagggagctggctttgaacccaggcacgtgcactttcgtcagtgggtcatcatgctgggacagtgactgactgtacaagagcacagacaaggactagcaatttggatcgctgcagcttcctgggcctgggtgaggtctgcacctgaggaagccgcgacagcaagtgccctgggccgccagcctggtgggaagtagggcaggacgaaaacaggaacttgaagtgggtcatgctcgttgaactggaaacactgagttgatatctgggttatttcccctgactgtcgcaaaacacacttagacaaaccctgcatttattcctttagagttgggaatgggaagagtgtgtgtgtgtgtgtgtgtgtgttggggggtgaggggactactgcccaggctctacctttgtgggaggatcctccccttccttccaccaaccccacttgggatgtcccaggctggtggtgaactcgttgggcaggtcagtactgtgtttataaagcgtgtcctcagcacaccctgcaaagtgcctggcaaaacataggcatgccacagatactttaaaaaaatgtttttcctgcttacaaaagtaagtcatgttgatttaataatatcgagaaaacacagaaaagcatacacaaaaagtcactcttcgacttagacgtgattaatatttggtatttgtgtatatgtaaatatgcatgaaagaaaagctgagaaaacatactgcagagtgttttccacgctactaattcctctcctaagacatgatttttaaaaatcgattttatcaaggtctaaattgcatgcaataaaactcagacattttaaggcacatagttggttaaattttgataattgtgtgcacctgtgtaaacatcacccggatcgcagcagcccagcaccttctcctgggccctgggctgttttctcaccagggacaggcacgatgctaatagagtttcatgtaaatggaatcatgccatgtgcacgtctttgtgcccggctgctttatctcatgtaaatggaatcatgccatgtgcacgtctttgtgcccggctgctttatctcatgtaaatggaatcatgccatgtgcacgtctttgtgcccggctgctttatctcattttgttttttttaagattcatcatgtcagcagttccttctttctggttactaagtcatattgcattgtgtgggtgcactagtgtatccgttcacctgctgatgggcttctggacagtttgcagtccattcaccttgactatgtggataaagacaccctgaccctttaggggctatgcttttgctcctcttgggtgcatatttaagagtagaaagctggattataggaaaatgtatatatatatatatatatatgtatgtatgtatatataacatattttattatatttttggagtcttcctctgtttcccaggctggagtgaagtggcaaggtctcggctcactgcaacctccacctcccgggttcaagtgattctcctgccttagcctcctgagtagctgggattatgggcacctgccaccagctaatttttgtatttttagtagagacagggtttcaccatgttggccaggctagtctcgaactcctgacctcagatgatctgcctgcctcggcctcccaaagtgttgggattacaggcgttagccactgcacctggctgtaaattcttacaagaaaatagaggacagtttataatattggaatgggaaaaggctctcctaaccaagatggaatccagaaagaataaagaaaaagctagattatttgacgaaataattttaaaatttcttttgtaagatatcataaatttaaaaaaaaagataagggccgggcgtggtggctcacacctgtaatcccagcactttgggaggccgaggcgggtggatcacttgatgtcaggaggtcgtgaccagcctgcccaacatggtgaaaccctgtctctactaaaaatacaaaaattagccaggcatgttggcgtgcgcctataatcccagcctctcaggaggctgaggcacgagaatctcttgaacctgggaggcggaggttgcagtgagctgtgattgcaccactgcactccagcctgggcaacacggcgagactccatctcaaataataataataataataaaataaaaataaaaaatgatgggggtgatatttgcaacaaataggatagagaaagggttaattttttttttttttttttttttgagacagagtcccactctgtcgcccagggctggagtgcagtggcgtgatctcagctcactgcaagctccgcctcccgggttcacaccattcacctgcctcagcctcccgagtagctgggactacaggcacccaccattgcacccggctaattttttgtatttttagaagagatggggtttcactgtgttagccaggatggtctcaatctcctgacctcgtgatcctccctctttggcctccttaagtgctgggattacaggcgtgagccaccgcgcctggccaggttaacattttttgaacattttaaacttacataaaaattgataggaaaaaaggcagacaatccattagacaaatggcaatggatataagtaggcgattcacggaagaaaacattcggaagtggatgctgagcgtctgagtagatactgacccaaggcaatgatgagatgctgctctcaaccagcaagggatggggaagggcgaaagcacagctctgtgctggggaagtttcaggacgcttctgggctggcagacccggtgaatgggaagtgggaactgctagggtgtttttggaaagtaatctggcagtgttttcaaactgtaaaaaaaaaaaaaaaaagtgatatcctttgacccaacaattccatttttgattatctatcccagagaaattaaaccaccagtatttaagaaactttcatactcgagaagatacactttctgtgtgtttaagaaactcctaatgtgttttacttcccgtcccccccacccaatttatttttcttctctaacagtctagatttttgcataacagcgttttctatgagaaatgcagctgagtcctgccttttgagggttatctcaggaacctgtagctggtccaggatgcatctcaacttaatggcttcagcgattagcccagcgtggacttccaggcacgagttctcctctgtcctggagacagccagcctgtcacccgcatacaagctccagctactcggcctctctcctaggccagtggcccaccctcaccgcctgctgggttctcgattcggctgtccggatcccacacgtctgctgggttctcgattcggctgtccggatcccatacctcttctctcctttctcgctgaccttggtcccctttttgccacagactgggtcagatgacttctgcctccagctggccccggtcttcccctcccgacccctcctgctgccttttgaatttctttagggagcaccccggcggctgaaccctggatgatggggattggaagtttagagagcaccctgagggtcactaatcccttctccagtgccgttggcccgtcctgacagccagcctgtgtgccccattgatgtttagacaccctgccctgctacaaagttcttccaggcactgctcgcccatgcgtgcctgtggcctggcttgcattcctgacctcccccgatctggccctgcccccacctgctcccggggcacacgtgctcaccagcccagccgtcattatctcccgcatgccctgtgcctccccaggtgccctctgccctccctgcctgacatgttttcctctatcctcagcctcaccaaggcccagccctccttcccagactcacctagcactggttattttgcagtatgttccaagactgggcagcgtttacaccttctgtttagctggtttctctggcactgctccagcagggaacggcgctggtactgccaggtgggggtggaagcccaggttcccctcagccttgttggcagcggagtcaggggctgcttgtcattgccgggtgggtggggggtacagctcccgccaggcctctgctaaggccaccttggcggggggtggaggtgcttccttgccgctccccacatgcactcccctaacagcacgtgggtggagtgtgggcaccttgcagctcagtggcagtgaaagccctgtctccccaccaggcctcctcttactccactccagcaaggaggaaggggcacctcgccagtgcagggtgggggcccgggctgggctgcccctttgtctccaccaatgcctagtgggcatgaggctttttaccagctggcgctgatgggggttccagcttcctgcgtggcctcccctgtacagccctggcagaggttgtggggtgcctgctcacagcctctcaagggtggaagtctaagctgctagttggccacttgggcttggttggagggctgggcccgtttttttctggggtaggttgttattgtctcaaagttttctgtcttgcaaagctgccccttccctggctagactgagttggctttcactggggctctgcgtttgtacctgttggcatttccaggtttcaggctgctccagttccaaatccaagatagacgaggcaaaggaaacccccagggggatgccgtgtgtctttctcagatcccaggccctgaacagctgccttttctctgcctgtcagagtcttcttatatttgtttcatgtgtgacgtccagggcttcacttaataggaggagtaggaaaagcacagctaatccatcctcccagaagcagaaggtgcttgtgcattaaaacaatttctttctctctgctctttagaatagattctttctgctgacctattttcaacttcactattcctctatctaattcattctgctgctaagcctatctggtgatttttaaatttcagatactgtactttccagttttaaatttttccttttggttccaatagtttccatttctttcctgaaaacttcttttttttttgagatagactgtcactctgttacccagactggagtgtaatggtgtgatctcgactcactgcaaactccacctcctgggttcaagcagttctcgtgcctcagccttctgagtagctgggattacaggtgcctgccaccatgcctggctatttttttttttttttttagtagagacagggatttgccatgttacccaggctggtcttgaactcctgagctcaggcaatctgcccgccttggcctcccaaagtgctaggattacaggcgtgagccaccactcccagcctctttcctgaaaacttcaagtatgttcaactgtgtctcagtgagcatggttataacagctgctttgttttttgtttgtttgtttgtttgtttgttttgagatggagtctcgatctgtcacccaggctggagtgcagtggtgcgatcttggctcactgcaagctccgcctcccaggttcacgccattctcctgcctcagcctcctgagtagctgggactacaggcgcctgccaccacgcctggctaattttttgtatttttagtagggacagggtttcaccgtgttagccaggatggtctcgatctcctgccctcgtgattcacctgcctcggcctcccaaaatgctgggattacaggcatgagccaccgcgcctggccaaagactactttgaagtctttgtctgataacatcaacatctgggtcatctcaggtttgacgtcttttgattattcccttgagaacgttaacatttcctggttcttggtgtgctgatttattgtgggttgtttcctggatatttggtacattattttgtaaggccaagtcctgttaatgttttttggaggctgggtgttgtgcatgcctgtagtcccagctactcaggaggctggggcaggaggagcatttgacaccaggaattcgaggttacggtgttccatgattgtaccactgtactccatcctgagtgacagagcaagaccctgtctcttaaaaaaaattaataaaaaataaagtcatttggacaatttttctatttaattaaattaattaatttatttatttacagtctcactgtttcccaggctggagtgcagtggctcagttttggctcactgcagcctcttgagcacaagccgtcctcctacctcagcctctcaagtagctggaactacaggcatgtaccatcattctccctaatttttaaaatttattttgtagagacagggcctcactatgttgtccaggttggtctcaatcttctggcctcaagcagtcctcccgcttcagcctcccaaagtgctggaattacaggcatgagacaccagacccagccaatttttctttttcaaaagcaggtgctcagcctggctgggtacagatggcaggtctgtctcatgtggcgagggaggtgggccctggctgtccagcctccgaggccctggctgccctgttttggcccctcaggagtgaggctggactcatctggtcattctcagagccaagtattcctgctccagccccctctcctctgagcacccctctgccctcagcacaccctggcttctctgggacaggggcctgcacccaccctgctgccccatagctcagacgtccccgaggccagagctggagataaacccagctcccagctgctgactctgcacgctggcctctccagccagcgggcctgctgctgtggatctctggtgtccccggttcactgcctgtttcttgtatcttgtccagagctatcagtcatagcgggtgggagagacaggcggtcgggcttggttcattctggccagaactagatgtctgaatgctgctttccatttaggccagcgtgtactgtgccctgcagtgctgcgggcttcacacccaatgggatcctcatagccctctgagacgccccttgttatcttctcagaggtggagatgtgggacttagagctgagctcacaggttggggagtggggactcagagcgaggctgctccagaatctggggtgagctccctcttcaaaggcagggactctgggatttgtttaagtagcccccgtggcctttcatagcagggtgcacggggggaagagcggggttcctggagcaaaatcagtccagttcccatgacaaagttccctgaggcaccgtacggtccctggagcccttggacaccccgtctcatccctaggacgggaggctgatgcaggtttcccgcgacctgacagcatggagtggggacggcgggtgttctgtgttgagatgccagctggtatggacttcagttctgcgggtgtcgtctaagcaggtctaggattagtctgattcatttcctgaacccacacacaggggctgcgcaggtgtgtaattccaccctgccctccagaacctcctggcttaacaggaaaagcaaagtcctgtgtgttggctgccacgtgggctgtgcaggtgacatgcccgtccacatgccacagccctgtttcctgagaggaatgatttggcatcctcaggtccaggcctcctgtgcatgctaagggagcatccatgctaaggagccgcgggggtggcagggccggggggggtggctgggccaggggagtgttggggcggcatgtgcaggatgttcagaagcccatggaccttgggtggtcaccgggtggtcctgtgggatgctgaccaggcccctgcctgagagtggggcacgcggaccacagcacccttaggctggtatcgggacgttaggacgaggaaggatttctggggtgggttccacagggaatggacactgtttacttgagatgtgtccctagaactaagaagactgggcacagtggctcacgcctgtaatcccaacactttgggaggctgagtggatggatcgcttgagcccaggagttagagagaccaaccaggtctctgagggcaacacagagagaccccatctctcaaaaaaaaaaaaaaaaagaaacagctgggcatggtggcacacacctgtggtcccaactacttgggaagctgaggtgggaggattgcatgagcctgggaggtcgaggctgcagtgagctgagattgcacccctgtactccagcctgggtgacacagtgagacctgtctcaaaaaaaaaaagaagaggagacattggtggctactaatggtgtgctgacaagggtcaaaggtcacattttatggcatgaaatagcagtaagttatgattggcaggtaccttatcccagcatcatgaactctgggggcttgctgtgagattttcttcatcatccgtgcggtcagaaaaaccacggctcagcctcactgggttgcagagcagaggtctttgggctaaatttggccacagatttttttctttgttagatttgcatggtgagtttttctcttccttttaaaattgtagctaatgttttacaatcagaaggtttcccataaaagacgaaacttgggcgcatccctgtatgacagcagcagccgcagcggaggcaagggctggggacacgcagtcgcgtctggataagtcgcagctcagggctgacctgtgggcgtcacgtgggttctggcttcccccaccttccatctgtgtatcagacccatcaagggctgtgtcagggtggacgtggtgggcggggaggggcgggggacagtttgaccatctctgagtttcctgcacgtgagatttctggactctccctggcagtggtgggcagggctggtttttggtcttccttggcataggcaagcactcacctttaatttttaatgaagatcagatgttcacacagctcatgtttactgagcggcgggttgccagggaaatgcgtttgcattgcatgtcattgcagggggaatcaggcctcccagccactcggatctcttgggtgttcttcctctggggtgacccttactgcttggactctaagcgggccgggcatgtggaggtcagtgtggcccgtgccacttctgggcctcagcatcccctgcagtgtgtgtgggtgtgatccacagacttccacactgtacttggcactgctccagtgggcgcagtgggcagcggcctgctctctcaccctgttccctctgccggtcctcacgtggcagcttgcattagggagagtcccagggaccgctgtgctcccctgtgctcttagctgggaactcgctcttgttctcgttgcatatgcccaagaggcgaaagacatctggggcctcccgacggctgcgtgaggtctggagcggcatgttctgccaccttgaccctgccctgccatgagcgtgcccacacacgtgcacccatgtcactggcagacactcagtgccccgtgacacacgggaaacccgtgggccctcctgctggatgggaggccactgcgcgtggctcagtttaatccgggaacttctagtatcaaagctgattgacagcaggcactgttttcatctgtaagtcacaagcatgaaataaatttaattctagtggatcacaacaagcactaaaaagcacagagaacagaatggaaaaagaagcagctggaagtcagcgtgctctcagctgcccctagcaggcattacccagactgtggcaaatgctgcagtggtctgcagagagggagtcagcaaacgcgtgagccgcacgagaaccaggaggccagcctcactcgctgacatggcatttgatttttctggaatgtgatggccatttgatcattacctctattgaagagctcactgcatgtcaatacgagtcactgtggtgtctcacgagaattctgtcacgagaatttatctctgtcagcaaaagaatatgaaagtgcccccaattcccaccttccgccctttgcaagatgttcccacagcatctgtccacctgggtcaggtgtgttttctcccgcggatgctgtggcatgtccacacaccacgtgctgtgcggggatgctgcttggtgccggcaatttgagactaaccctcagagggcagttccttctgcttctagaggaccgtccgcattcttctgtgtgccagccctcggtggtcccactgccgtccacatgacctgccctcagatgagcaggcgccagctctccaaccggtggacgctggcaagtgtttcctgagcccccgcagggagctgctctccgtttgctcagattcttggcccggttctttatctcctaattagaaatgagagtatcgaagactagggcgtaatgccgatgacacaccgaggtgaggagagcaggagaaggggtaagtgctgctaggctggaggcgtctcactgtggagttctctcactgtggagtcctcagcttaacacagggacaatggcctgaaggaggaaggaggcagagcctccatcttgagcccagccttctttttcttttttttttgagatggagttttgctgtctttcgcccaggctggagtgcagtggcgcaatcttggctcactgcaagccccgcctccctggttcatgccattctcctgcctcagcctcctgagtagctggggctacaggtgcccgccaccacacccggctaattttttgtgtatttttagtagagtcggggtttcaccatgttagccagggtggtctcgatctcctgacctcgtgatccgcccaccttagcctcccaaagtgcagggattacaggtgtgagccaccccgccctgctgagcccagcctttttggcaagaaaggaagccatcatttatcggacatttttgtgcttgaaactttttcaccctttatcttattccagtttctaatcccctatggggttcatcgctccaccccctttacaccatgctccaggcttagcggcttacccacagtaagactgcagccagatacaggccaaagccacgccaagtccagccactcattgccacctggggaatgtgttcccaccatggccgcaccactccaggtctcctgagtcagcaaggaagcccttgtcctgagccgcacccagtgcagattgaccctcaaacaacatgggggttagcgccccagccccacacagttgaaaacttttgactcccccagcacttaactactaacagcctactgttgactggacgccttgcgataatgtaaatagccgatgaacacatatttcctatgtggcctgatttatatgctgtattattacaataaaataagctagagaaaagaaaacgtggttaagaaaaccataaggaagagaaaatgtgtttactatctggtaagtggaagtggatcattacaaaggtctccatcctcatggtcttcatgttgagtgggctgaggaggaagaggagaggagggatcagtcgtgctgtcttagcggtggtggaggtggagaagacggaggaggtggaaggggaggcaagagaggcaagtgagcttagtgtcacttttattgaaaaatctggccaggcgcggtggctcatgcctgtaatcccagtactgtgggaggccgaggcgggcagatcacctgaggtcaggagttcaagaccatcctggccaacatggtgaaatcccgtctctactaaaagtacaaaagttagccgggtgcggtggcaggcgcctataatcccagctactcaggaggctgaggcaggagaatcacttgaacctgggaagcggaggttgcagcgagccaagatcacaccacacctgggtgacgagcaagactccatttcaaaaacaaaaaaaaaagaagaaaaccccacattagtggacccttgaaggttaagcccatgttgttcagaggtcagctatattcttcttcttctttttttgttttcctgagactgagtctcactttgttgcccaggctggagtgcactggtgtgatctcggctcacggcaacctccgcctcccgggttcaagcaactctcatgcttcaatctcctgagtagctgggattacaggcacacaccaccacacctggctaacttttgtatttttagtagagacggggtttcaccatgttggccaggctggtctcgaactcctgacccgaagtgctctgcctgcctcggcctcccaaagtgctgggattacaggcgtgagccactgtgtccgccctgtgttcttattcttgacgttcctcaataaagctgtgcagacaatattgaattttgttcctctattaacttttctgtccctttttagagacaataattccatttattaatctgtgtgtaaaaggaacgtgtgtaaactaatgaccctgctggcatctttgtctttttctcttgccagaggagcaggtacaccttgctgcaggtccagtgtggcagaaggtgcctggattcaccccagggcgtccttggtcctgttcagtctcttgccctgtcccgaacacttgtagctattcagagtcatacccaagtgggatccttatccctccacccagagtggccaccctctcgcagccgctcgccctttccttcccagcggcctctgcctctccccagctcctgcccctacgtcgccttcctccacccacggggaatcctctgaaccctgaccctgacagtgaggctgtccccaccacctccctgccccagcacctgtgtcgctccttctggcaggacgcacgtggactgcctggtcttgtgctggcacccctggcacggcacggcctgcagcctggctaacatggcaaaaccctgtctctactaaaaatacaaaaatcagctggacctggtggtgggaacctgtaatctcagctacttgggaggctgaggagggagaatcgcttgaaccgggaggtggaggttgcggtgagccgagatggagctattgccctccagtctgggcagcaggagcaaaactgcatctcaaaaaaaaaaaaaaaaaaaagatgggaggcccaggtggggcacaccggagggtggggaccctgagagtcactctggaccccacatcctatacccaggaggaggatgcacacagacacctcctgagacctctgctctccagccagacttcatcctctgtaacccaccccctccccatcaagtctgctcccctggggctggcttcacttcagagggaatcaggaggccccactactggcctttcaaaggtttctacagtgctcaaaggcccagttcagacactaccctcccaggttcctagaacttgatttccatgggccacaactttaaaaatgatgcaaaattaccacaaatgttatagcaattttttttgcatttagctacggcaaaaatacggtattttagctatattgcaggttttatagccaacctaggaagctaaccacaaattataacattcttctgtgtaaggatatatcatacatgcctaacagtaattccagaataagcttttggaagccaccttcctcaaacttggctttgctgtcttcaatcccatgctctcctgggcaagttctttcaggccttggacttcagttacccgtcacctcccacagctctgctgccagcccagaactttctttgatgtgcaagcctgtaattacagctgcccagcagatgaacacgccccaggtggctcgggtggaatgggtccttgctggttcccagggtggagcatgtccggtgctgtcatcccctgggcccctggaagtctcccctgtctcctccccctgcactccagttcgcgccacacttgggctctgcctcacttgcaagctccgtggttccagctgtcccgggtcctgtcacgtgtctccctcccacttggatttctgaaccaggcactgtcctgcagacagaggccatgtctcgagcatgtttccccaaatttcacatggtagctggcccggaatggtccgcatttgctgcttgaatgggtgagcaaatcgtgtgaaaaatcacagcctccatttggtgactcggctgaataaaacatcccgccgtctggtaacattgagctgcccacagttatttatttgtgagtttaaaagtgacctataaccttcctttttgggggagggggtattaaaaaagctgttcgggaggctgaggcaggagaatggcgcgaacccgggaggcagagcttgcagtgagccgagatcgaaccactgcactccagcctgggcgacagcgtgagactctgtctcaaaaaaatatatatatatatgtatatcttttttctttttggagatggggtcttgtgctgttgccagggctggagtgcagtgtcaccatcatagcccactgcaactcctgagctcaagcgatcctccctcctcagcctcccaaagtgctgggattacaggtgcacaccaccacacccagcctgaatttctaatgagaatattaaagcagaatattctcagcttcttggagttggactgattttacctgtgtggattctgacgaattctttgacagaaggacgtggtgtttttacagatgcctgctctgtgcctgtatctgagatcatcgccgttgaggaaacagacgttcacgggaaacatcaaggcagtggaaaatggcagaaaatggaaaagccttacgcttttacaggtgataagcctaaatgtcttctcccacattcttcattaattctatgtagattacacgagagggaacttttctgttacttgtttaacaagctcaatgcattggtttatctttatgaaatcttcctatttttttccccaaatgctacctttagttaatgttttagttaatggtcatttttccccttatttttatttatttatttttttgagacagagttttgctcttgttgcccaagctgaagtgcagtggcgcggtctcggctagttcaacctctgcttcctgggttcaagcaattctcctgcctcagcctcctgagtagctgggattataggtgcccgccaccacacccggctacttttttgtattttaagtaaagacggggtttcaccatgttggccaggctggtcttgaactcctgacctcaggtgatctgcccgcctcagcctcccaaagtgctggattacaggcgtgagtcatcacagccagcccttttcccttatatgacttaaaaggtttgaaagatcggatgtttttttctaatataccttgaaagttactaattagaagggaggagaacccctgggaaattttggttaggaacctataattagctgcatttggtgcatattcacttgaggttttgtcagtgaccctgcaaactttgcactaacgagcatgcttgcttctgtgcagttcactgtgtaaagagagcacgacggcaccgctggaagtgggcgcaggtgactttctggtgtccagaggagcagctgtgtcacttgtggctgcagaccctgcgggagatgctggagaagctgagtacgtgtgtgtttggactgagagacaggatggccgtggtggcatgcgcatgcctgattgggtgatcttcctgaagtgtctccccgtttcgtgcagctggccataccccaggtggacatgatgagtcaggctgacttaatttctcatgagcagaccatcccagtgaatgcaaagggcatgggctccacagcctggaccctggcatggagtccagccccctgctcactggccaggaggcctgggggcgggtcacttacccttctgagcctcagtttctctttctggaagcggagatggtaatagcttttacattcgaggtgaatgtgagaattaaactgggcacatggaggaatacacctcacatctgtctgggatgcgtccatgtcttttttcttttcttttcttttctttttcaagatggagtcttgcttggttgctcaggctggagttcagtggcgcgatctcagctcactgcaaccaccacctcctgggttcaagtgattcttctgcctcagcctcccgagtagctgggactacaggcatgcgccaccacgcctggctaatttttgtatttttagtagagatggggttttaccaagttggccaggctggtctcagacttctgacctcaggtgatctccccaccttggcctcctggagtgctgggattacaggtgtgagccaccacgcccagccagggatgtgtccacatctgaaatgtagtaggagcctggagcctggtgggttagttattgcatgctgagtaacaagactttgtcacccttaaaaagtggtaggatggctagagacataatctgtacaccaaacccccatgacacgcactttacctatataacaaacctgcacatgtacccgtgaacttaaaagtttaaaaaaaggaacatatggtagacacacacacacacacacacacacaaagtggtaggtgttcattcattttgtattcataacactatttcatgttgtttgcttataaccttaataggcaattttttttgagacagggtctcgctctgtcacccggggtggagtgcagtggcatgatcttagctcactgcagcctctaccttccgggctcaagtgatcttcccacctcagtctcctgagtagctgggactacaggtgtgtgccaccacgcctggctaattttttttgtacagacagggttttgccatattgcccaggctgatctcaaactcctgtgctcaagccatcttcctaccttagcctcccaaagtgctaggattacaggtgtaagccactgagcccagccaatacacagtcttgacaactcagcacaggcttcacccatagaatagaaatggcatgtgtttaggttagttttatatatttttgaatgaatttggcacctacatcaagaaagtgaatttcagtttattaaaaggaggcattcccatatatctgcttcagagcagcatcattgcttgaaggagccctcctcttgattacaactggggcaggagggcctgtgcttccatacttccctgtttaatcctgggggacttggcctccaccacctgctgtcgtgaaaagctcatcctgaccgtcctcacatctcaaaccaccacaagccccgttcctctgcatgtcgttccgcactaggctgttcagaagagtgcatctgtttctcccgccttcccctcctctgtttgtctctcgactccccctttccgtccgtcctgctttctccttccctttcctcccatcaaacctgttttcatgagactttggctgactggattccagacctgatcctataggtgcagactccaagagaaagtcctctgaaccctgcctcccactggagaatgtgggttcattttcatctttataattgtgcatttgatatagtctccttgtagctaaaaattgtatatgattctattgtttcagctactctacaattttaacttctaaccctgttatctgttttagtgggtttttttctttgttttgttcttggtttttgagacaatctcactccatcatccgggctggagtgcagtggtgcaatctcggcttactgcaaactcctcctgggttcaagcgattctcctgtctcagcctcctaagtagctgagattataggcacccattaccacacctggctaatttttgtatttgttgtagagacagagtttcgccgtgttggccagactggtctcgaactcctgacctcaagtgatccgcctacctcggcctcccaaagtgctgggattacaggctgttttagtatttgtcatatcacagacccagaggatctcattctgagtgtgcactgggtgaattttcacgctgagcacacttgtgtaaccagcacccagataaaggagcagaatattgccagccccagggtcccccaccgtgcccctgtggtcatgactccccaaaggggaaccactgctgcgacttctaaacaactaggttcactgttgtacttgatagaaatcagatcatacagtatgaaaccttttgtgcctggctctcggctcaacatgacacttgtgaagttttccacgctgttttccaccgtggtggcgagtagtcttgcataaattttccacgctctcgcgtggggctgccgtttgtccattctctaggccgtatggtattccgtgatgtgaatgttacggccatttattcacccatggtacagtggctggtcatttggacagcttcctgatgtgggctgtcatgaacagtagcattgggaacattctagagcatgtcttttgcacccgtctgcatttctcctgggtgcatacctgggaatggagtcgctgggttgtaggtgtttgttgcatgtgttgacttcagaagacgctgccagcctgcattccaccctcagggttcgggagttctggttgccccacatcttagccacacctttacgtcttagccatggtggtgttaatagtcttgcactgtggttgtagtttgcactccctaatggttaatgaggttgagaaacacattcatatgttcatgggccattcagatatcgccttttgtgaggttctgttcaagtcttttgtccatttttccgtttggttgttatctttctcttccttcctttctttcattctttttttcttttttttttggtggggggacagagtctcgctctgttgcccaggctggagggcagttgcgcgatcctggctcactgcaacctctgcctcctgggttcaagcaatcctcagcctcctgagtagctgggactacaggcgtgtgccaccacgcctggctagtttttttgtattttttagtagagagggggttttgctatattggccaggctgatcttgaactcttggcctcaagtgatctacctgcctcagcctcccaaagtgctgggattataggcatgagccaccatgcccagctggttgtatctttttcttaatgatgtgtagaaactgtttacatattgtggatctgaatcttttattgaatttattaattacataaatttatgtaattaataagaattaccaattctgtaatttgccttttcaatctcgtattttttttttttaagagacggggtcttggccgggcatggtggctcacgcctataatcctagcactttgggaggccgaggcgggtggatcacctgaggtcaagagttcgggaccagcctggccaacatggtgaaaccccatctctactaaaaatacaaaacttagccaagcatggtggcacacacctgtcatcccagctactcgagaggctgaggcaggagaatcacttgaaccctgggggtggaggttgcagtgagtcgagatcatgcaacttcactccagcctgggcgaaagagcaaaactccatctttaaaaaaaaaaaaaaaagggagatgaggtcttgttctgccacccaggccggagtgcagtggcacaatcacggttcactgcagctttgaactcctgagctcaagcaatgcttctgcctcagcctcgcaagtagctgagactacaggcacatgtcaccgtgcctggctgattttttgaaaattttttcatagagctggggtcttgctgtgttgcccaggctggtctcaaactcctaggctcaaagaatcctcccacctcagcctcccaaagcattgatattaccagggtgagctactatactcggcctatttttatgattttaaaaaactttctggtaagcttgtgtcctattgaagatatctttgtctactccaaagtcacgaagacgttttattctccaagctctattgttttccgcttcacatttggatctatgtaatccatttggaattcatctttgtgtccagtgtgaggtgagcagtcaagattcattttcctctttctttttatgtattcatttttttaagacagggtcttgctctgtcacccaggctgcagtgcagctatgcgatcatagctcactgtggccttgaactagtgggctcaagcgatcctcctgcctcagcctcccaagtagctgggactacaggcacgaaccactgtgcccaacctagtattttcattaactataaacatctgcttgaccctgtggcatttacgggaaagtctcgttttccctactgcactgtttatttattttttattgtttgtgtatagaaatgtgatagaattgtgtatttcaccttgcattcaatgaccttgcaaacttcacttatggatgctaatagtttgatgattattttagatttttgtcaaacacgatcatgtcagctgtgcataataacagttgtgtttcttccattttaattcttctctcttttatttcttttccttatgtttttgccctggcttggaccaacacaggggtgctagcagcatccttgtctcagtcctgatctcaggggaaagattttagtgtttcaccattaagaatgatgtttcttatgtttttaatagattttaaaaatcagattaagacagaatttccttttaatcctacttttctgagagttttggtttttttaagtggagaatgggtatttaatttgataaatgccttttctgcatctattgagatgactgtatgactttctttttttttttcaattaatgtgttgagttacattaatttctcattgttgcagtcctggagtaaacaaacctctcttggttgtgatgtagtactgtttatgtgtcactggatttgacttaccgatattgtgtttaggatttttgcacgtaggttcaggggagggatgtctgaatatgagcccctttctgataacatctttgtctggttttgttcccaaggtcacagtggtgtgtcatacaaagagttcatacgtgtttgtttttttctgttctctggaagcgttcctataatcttgaggctattttttccttaaatgtttggaagaattcagttgtgaaatcatctgggcttggagttttctttgtgagaagttttcattaatagctttggtgtctttattagctgtcagactattcagattttctatttcttctggtatctctgacaaattttgctttttgagaagtttaaccatttcatccaaattcgtgagtttattagcatgaacttattagtaaattctttcattttctttgtaatattggtagaatctggagtaatgtctcactctgtagcccaggctggagtgcagtggcacgaccatagctcactgcagcctcgacctcccaggttcaagtgattctctcacctcagcctccagagtagctgggactacaagggcataccaccacacccagctaatttgtttgtttgtttgtttattttgacatggagtcttactctgtcacccaggctggagtgcaatggcgcgatcttggctcactgcaacctccacttcctgggttcaagtgattctcctgcctcagcctcctgagcagctggaattacaggtgcttgccaccattcccagctaatttttgtattgttagtagagacagggtttcaccatgttgcccaggctggtttcaaacacctgacctcaagtgatctgcccacctcggcctcccaaagtgttgggattaacaggcgtgagccactgagcctggcctgattttttttgatcgtttgtcgagacagagtctcactatatcgccctggctggtcttgaactcctgtgctcatatgatcctcctgccttggcctcccaaagtgttgggattacaggtgtcagccactatgcctggccaaaatcctaagtttcaatcaatgacttctgaaacacacatacctttgtaactcaaacccatcaaggcttctgtcaccccagaagttttacgtgtgctcctgggtggaagcctccagtctctctgcatactgttttcacattgattcatgttggtcgcacccagtagtttgcttatttcatgactgaaggatgctccgttgatgtgtggactgcgtctcgatttcttcttcaggtgatgggcgttcaggctgttcccactgcttggctgtggtgaagaatgctgtgatgaacatttgtgtctgtgtttttttgtttgtttgtttttttttttttttttttttgagatgaagtctcactctgtcgcccaggctggaatgcagtggcgcgaccttggctcactgccagctccgcctcccgggttcatgccattctcctgcctcagcctcccaagtagctgggactacaggtgcccgccaccacgcccggctaatttttttgtatttttttttagtagagacgggatttcaccgtgttagccaggatggtcccgatctcctgacctcgtgatccgcccacctcggcctcccaaagtgctgggattacaggcatgagccaccgcgcctggccctgtgtctggatttttgtatggacttaggttttcagtttccttgggtagatactgtcttgttacttttattgatttgttagttaaatgtgttcttttaagtagcagagtcacatgaacccaccaaaacagaaatgtggaagttgttataagaaaatgggggtgactctggctaacacggtgaaaccccatctctactaacaatacaaaaaattagccgggcgtggtggcgggcgcctgtagtcccagctactcaggaggctgaggcaggaggatggcatgaacccaggaggcagagcttgcagtgagctgagatcacaccactgcactccagcctgggcgacagagcgagactccatctcaaaaaaaaaaaaaaagaaaagaaaagaaaatgggggtgactgaggaaacccaggcatgggagtttggcggggcccctggagagatggaaacgaggtcactggtttctgtctttccatctctgcaagcatctccctgtgtggcttcttctttccatacctgctggtccgcttttcctaagactcttccctctgtctgcttccttcttcctgctgtctgcacactcacctccttcacctgcagaagaacgaggctgctgcccccagcatgtgtacccgacagcacccttcagagcagagagagcccttctcagtcggaattctgagttcgtgggagtttcatgatgtccgacatgtgtgtatagcctttgcccagttggacaacctgttgattttctcttttcatagatcaggaagctctttgtcattgttctttaagatttaaaaatactttccatcaggtaatactaagcagaattctaaaaccctcatggtttgattttgtccagtaacagagctcttcgttttgattttgttattttcgttgttatttacatgttgttgtcttacagcgtccagaccaaagcatttactggtatttatcaacccgtttggaggaaaaggacaaggcaagcggatatatgaaagaaaagtggcaccactgttcaccttagcctccatcaccactgacatcatcggtaacaaattctatgttaactatgtagaagtaagtttgagaatgattcaagtatagtcactagagacgtttctgctttttctagacggtgtctcactctgttgcccaggctggagtgcagtggtgcaattgtgggtcactgtaacctcagcctccttgactcagatgatcctcctgcctcagcctcccaagtagctggcaccacaccttgtgccaccatgcctggctaatttttgtattttttgtataggcggggtttcaccatattgcttaggctggtttcgaacccctgggctcaagcaatgttgcccaccttagcctcccaaagtgctgggattataggcatgagccactgtgcccagcccaagatttttatcctgtaagattattttaaacaaaatagaacttttttttacataccagaatgggaagaatacaaaataaataacttagtattttccagccaattctcagcatagaaggcaatcaagaaaaacactaggaagataaaagggcaacgattctggacagaaaattctcaaaagaggagacacaaaggattaataagtcttagaaataatctcacatcacacaccggggcctgttgtggggtggggggactttcaatagaagtttacatcaggtatagagactgcactaacatcttcttactacactttggtatagtgtacaattttggaagtaacttgtataataaggaaaaattataaaagagacgtaatctctttcaaagaaattattatttgccggcaattaaataccaggaacgctgcatgtcatcgcgcagactgtggcccgagagaggttcatgttcacgttccctgaggtcagcttgatcccgtcccataagagcgatgtagaattgaagagggaattttatctaggaaatccgcctgaaggtgttacaggaactcattttaaaagaatggatgatttgccttttacgtgaggactcacagatgtgaatataaactgtgtgatgtaatttttccccacagttactgaacatgctaatcaggccaaggagactctgtatgagattaacatagacaaatacgacgggtgagtaagccgtctttcatcgccatcaagtccattgttaatgaaaaagttctacccacctctcagttttgagagctccttttcctaaatccgccccccgcctccacccacgaccaattgtaaaagtaaacatgcttcttacaggaaggcaagaaagaaaaggcagaaaagtgcagtcacacactcctctctggctgggctgggcgagaatggttgtttgctggttctgttccctttcggtctttcagaagatgtgcttatgcggtgctgtgtagacagagaagcaaatcaaccaagcacattatcaagaatgtttagatgctgtcgtttttacagtttgggattcttcttttccccaaaattcctagagatttcccagaactactatttttaatgcccatatcatggtccattatgtgggcatgccatatttatttagcctctcacttgtagatgttcaggctctttccaatttttgctcttaggatagcattgttgtacataaatctctctgcatacatctacatttttaaggtaaattcctagaaatgaaattagtcataggagattaacattttaaaatctctgccgtgtacagccatattgctttcgaaagagattctattaacttacattcttttttttttttttcgtttttgaggcagagtttcgctcttgttgcccaggctggagtgcaatggcgtgacctcggcagcttcggcctcccaagtccaaatgattctcctgcctcaacctcccgagtagctgggattataggtgcccaacaccacgcccagctaatttttgtgtttttagtagagacaggatttcgccatgttggccaggctggtctcgaactcctgacctcaggtgatccacgcgacccgcctcagcctcccaaagtgctgggattacaggcatgagccaccgcgcccggccagtttacattctttcttatagtatattatttactgtctttgtcaacatgtttggtattatcagtataaaatttctctgctaatttgacatgtgaaagtctctaatattttaagaaatatgtttattggctagctggcttcttggaattgatttttatgtctttggcccattttcttttgttggccataatttcagtcatttgttctcttatccaacaaataataggcaattcatatttatattcatatttttgcaaatatttttgctaattttgaaattgtcttttaattttgcttatggcattaattcttcccagtagaagttttcaaattcatgtactcaagtctgtccagctcttctgtgctgttctttatgcttaaaatttcactcttcatcttgagtttagctattcccctgtagttaattgccttgtcattggttggctttttgttttcttctctctgttccatctggagtcggtgagcaatgtgttataaattgcagcggatatttattgaaatcattattcattccacaaacattattgagggtcctccaggtcccagcactctgctggtgctaaggttagaaagggaaataaaaggagcccctgcccccaggtgctgacagggagacccctttgctcccctcctaatgcgggagtgttctgttcatgggctccaggaagcagggggctcctccatgcacatctccccaactccacccgatggcagctcctccatgtacttcttcccaccacctccacccgacagcagcttggcaggaagacagtcgtcttcacttttcagcagggatggggctggcaccttattgcacccaccctagccaagggatcagcctcgcctcttgagggcacgccttctccccaaacccagggacatgccgtgcaggaggctgggaggcctggccagtgagggctgctcttcctgcggctgagctgtctgtctgagtgatctgtctgtctaacacacagatgctacactgcccattcaaggatgccctgtcctcgaaaccacagccccgctgggaaggctgccccggtgcaaggtgtaggctacggggaagggcaaagagccttcccatgggagccgggcccaaagcaggtggcctgagtggtgggtggtgggcagagatcccagccctggagactggtcgcgcctgcacagacagacccactggggaatgggcaggcaccttgatgctgtcatgcttgagggaggcccctcaggctgcaccccctagtcgactcacaccgctcctctaccggcggaccttccccctgcaaccctctcttcccgggtgatgagagctcttgggctgccgtaggctatagagatgtccaggaaacctgagccctgtcctctgccttccctctgggctgcagtgacatgtctgtctccatgcctgcacctctcattctgccacctcagtgttggttccctgtgggttacccccggcataggacagcacaccctgaaaccaacccgtcctttctcccttcagccactgtcccctttctccatctcctctccttagattgtctcatgccccattttgtccgcatttattccgtcccctctgctcttgccttgggtcctcaagaccacccacacggctggtgatttgctgcctgagctagagtcgtgctctcggctgagatttctgacgggacagagcaaggctgcacagccagcttagcaaaggagaaacgtccccgcgcagactgctgtgcctctcccgcagtgcgggtcacctggagtgcaccctctctgctcccacaaatgcagcagcacaggtgtactcttcccgccccgcaaacttgagtcctgagacccagagtgtagtgtttttgagggggtacaggcatgcaggcattctctgcctagccacccaaattccagactcacagaaggaaagccagtatttgccatcaatctcattatttgtacacgtggtctaggccaactggcacagaggcacgaccttatcacttagggacatttcaggagccgcacttctagatgcctgccaagggccaggtgtgcaggctgcccctcctgaagctggaagcctcaggcctgctgcgctcagagggccgcacctgcaggagccctgaccggctgtgttcctcctgcagcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcaggtatggagccggcctggcattctctgttctcttcgttcccgtccttaggaattgttctgcacaagtagccacctcggacacttaataacccaattatactcagtttagttcgtacagatttcctaacattagggccactcttggggggatatcattgagagtatgaccccaatgaaatagacactcgtggaaaggaaagttgcccgactcccccaaaggctgcttcacgcaaggcaggagaaccccaccgctgggggtgcagtcctggagtggggaacccccggtgcccgggagcaggtgggtaggttggcagggggtgcgttctggaagaagtggcttctggacctgaaggaaccgggagttaggggtgggtgtgggcaggaatcgggctggggagttgggaggagactgagtgggaaaggtgggggcggaaccaagggcaggacctagccgagcccgggaacagctgggctgtgtcctgaagtgctggttcggcttggtccattcaacatccttctaggaaccaccttgttctttgaaaaatcacagtgttaagctaagtcaagctgagggcctgagcgtggtgtgttgcaggctttgcaaatgacctggcaggggacgaggtgtctgtcctctctggccctgtgtctggccccgagggtggcggcatggtgcacactttcactctcgtcacagctctgggatgtgagcaccgcagtcatccccattttatggatgaagacaggaggactgggggtgaggtcacaggtcaccggatgggagcgagagttggaggtttagaggccaccttgcctcaaagcaagggaaaggctagccctcacgagggacaggccctgagccaccttctctgtgggtgccgctctcaactctaacctgcctccgacaggtgacattgtgggccagtgtttacttgagggagtcatcctttaaacttaagtcattactccttcttaatgacagagcttgtgaataatggtgtgaggcaaatgttccccacggatggtgacattgcgggtgttttcagtatcaagactcattttagggggatttgtgttagcataatatctcgtgaattactaataattgttagcaacaagttgaccatggtcatggttttaagtatataggaaaggatgatcgtctggttacgatcccttccctttggcttttagggaaggcgtgatgcagttattaatagagaggaacttttcataatatcgcctgatgagttttagaagaatgtcactcacctgagaagagtcctgtctaatgagaacagcctggctccaggctgggagacactaaggggagaaatggttctttagaaatagctcaatagagaaaaagctctcagcaccccttccaataacaagtctctcagataaaccaaagcattatagcaacatcccgctggatctcgggggagcctctgctggatttcctcacatccttctcaggcctcctgtgtgccgccgacctctcggttcctgccaggcagttaggagtggggagagcggaagagctggccgggagcagacggctcgggagggcccctgggccttggctgatgtctgtcttccccacaggcagggaggttggctttcactcatgtgtcctcggtggggcacccagccctggcacccaaactccctcttagatatctgttgaatgactgagcacagctgtgcaaggtcgagctctgtgttcacacacactcagcacactcacacgctccaggctcccagcccctgaaggtgcacagatcacggcttgtctttttgtttgagactgggtctcactctgtcacctagtttggagtgcagtggcatgatcgtggctcactgcagcctagactgccccaggctcaagtgatcctcttgcctcagcctcccaagtagctgggaccacaggcgtgcaccaccacactcggccaacttttttttcatatttttgtagagatggagtttcaccatgttgcccaggctggtctcaaactcctggactcaagtgatccaccagcctctgcctcccaaagtgctgggattacaggcgtgcaccaccatgcctggccagtcacccaccacttgtcttgctggctggcgctggttcaagaggcgttccagttctttgggttggttggttggtttgtttgaatcagagtctcactttgtcgtccaggctggagtgcagtggtgcgatcttggctcactgcaacctctgcctcctgggcttaagcaattctcctgcctcagcctcctgagcagctgagactacaggtgtgtaccaccatgcctggctaattttgtatttttagtagaaacagggttttgctacgttggccagggtggtctcaaactcttgacctcaagtgatctacctgccttggcctcccaaggtgctgggattacaggcatgagccactggacccagcccgttccgattctttgaatgacccagacaaccaatgttgatggccttgcactgtctccctatggccacaagtgcctgagatcaaggcaccgtctcctgctgtcttcaccccaggcccctcactcccatccttctttccatactctctctgcatcttccacactcgtgaaggaccctggcccctgtgcacgtgtggctctcagaggctccaggtcatgatttccttgtggacatcccttgacgtggagtctctgggcccacttaattctcccataaaggccacccacggggctgggagggggagtttccccaagcctggcacagcctggaggtttgtctgtggtttaacttttatcccatctgatagactgagtatgctgccttattcactatctttatttactctctttatttgtatttctttcattatgtgtgaggccacactgcttttcacaggtcctcttgctgtttgcattgtgtgcttttgtaaacttcctttcccttgcttagtccatgttctcatggggaagcaagagggcattgtcacttttttttttttttttttttgagatggagtcttgctctgtcacccaggctggagtgcagtggcatgatctcagctcactgcaacctccgcctcctgggttcaagcaattctcctgccttagcctccctagtagctgggattacaggcacccaccaccgtgcccggctaatttttgtatttttagtagagacagggtttcaccatgttggccaggctggtcttgaactcctgacctcgtgatctgcccacctcggcctcccaaagtgctgggattatagacgtgagccaccatgcccggcctgtcactttctaattgaccataacattgtttatacgttatttgcccttcattggtttttgtgtcttgcaactcttttccaaattaggttttggtcttttaactttgtatgtggtgcgttctggattccatgaattctgtttttctgcattctcatctatgctgtatggttcttaccttgtttgcaagaaacctgtcttttgtcaccatttgccagtggcagtgctaagccctaaaatcctcagctcttaaaatccacaacgacctcaggagctgagacctgcggctcaggagtgctcgtggggatgcaggctgcacttcaccatggtcagggtggaggtgccactgtgtgccctgccccgtggtcagggtgggggtaccgctgtgtgccctgccctcctctaggccttggctgtggcctctgccccaggagaggacagcaggcaccccaccaaatgtgggcataaaagcctttcccagggtgggtgcgcattgtagcaaatgccactgggggagggtctggggagagggtctctttgtggcccctttccatgggtgtccaggaggcctttctgagaggtgacaggtgaggggcctaggccgggagtcagctggtgcagagggcagcaggtgggaggagctgggggtgttcgggacaaggaagccagtgtggctgggggtgggggtggaggggcagggcagggcccgagggagatgccgagttccactctgccatgcagcaggaggtcttggaggcggtggttcggcagggggtgacgtctgactctgctccgatatcgctctctgcgtttggtcctaagagcatgtgggccccggtgagaacgctggtggcttggacggtaagggcgctgcatggggtctgagactccggggtgtagctggtggggggctgtgtggagtctctgctccgcagcatcgccttgagtggaggagtaagggtgagggagacacccaagggtggccctgtaacggtcaccatggcaacctggggagcagcctgggggcacaagagttgtgagtgagacctgacagccacagaccctgtgggaggccgcctggatgcgcacggccggtggtggcagcaggtacctgaactcactcatgctccagggttccagccgctagaaggtgcagaggtcactgcttgtcttgctggctgggggcaggagaggcaggaggggcaggtgggggttggggtcctgagatctggagggtgttgagctgcctcccgtggatggctgcctccgggacagatgtcactggagcatctgaaaggcatggctccggctgctttgagacctgatgtagcatgttttaccttccaagtctcttccacatatgtattagtatagatgcattagcaaattgataggaagaagagatcgtcattcattcggtccttcatcgggtgttagcctgtaactgcatctgctgcttgtaacttcagccagcattgcctgctaatgacttaggcacagagaggctcaaggagatgatgcgcatgtcctgggagcaacccccctggagccccgtccttctcgcgtgaacgggagcatgtggttggtcgttactcgggtggcggcagtgctggccgggtggatgaggaactcccgtattcagttgtgtggggaatgttgagaaccagcacagctactcccacaggtatgggtggtcattgtggatgcaaatcattcttttgagcatggtcctcagagggaaggccgtgcgatcagccggggcagctgcagcttccctttcatctgagccagtgaagcgcaggataaaaagatgcataagccgcagccggccccgttcacggggaacatcgggctgaagcagggacctgagctgcctgtcctggctgtcctggtattaagatctcaagtaatggctgtgtgtgacctttgccgcatccagctgtttcagaagtttacgagggccaggtgtggtggctcacgcctaatcccagcactttgggaggccaaggcgggcggatcacgaggtcaacagttagagaccagcctggccatcatggtgaaaccctgcctctactaagaatacaaaagtaagccagggcgtggtggcgcgtgcctgtaatcccagctcctcgggaggctgaggcagaattgcctgaacctgggagacagaggttgcagtgagccaagatcacgccaccgcactccagcctgggcgacagagcaagactccgtctcggaaaaaaaaaaaaaaattttgttatgcctataattgtaaatgttcacacacacacacacacacacacacacacacacacacacacacatatatatatttttttaactttttggctcctttttttttttttttttgagacgaagtctcactctgttgcccaggctggatagtggcgcgatctcgactcactgcagcctttgcctcccgggatcaagcgattctcctgctttagcctcctgaggagctggtattataggtgcatgccaccacgcctggctaatttttgtatttttagtagagtcggagtttcaccatgttggccaggctggtctcgaactcctgacctcaagtcatccgcccacctcggcctctcaaagtgctgggatgacaggcgtgagccaccgcccggcccaatctcaatattcttgaggaatcaacgctagtattttctatattcattttgtaggtaaattctatttattccttagtgttgactctagggccatggaaggaaaggaatgaggtaccactcactgaattgggaggcgattacaattctgttattctgatgctatttgggaccttctttttccctttacagggtcaacggactgcgtgtgttactccaccgtgggcaccagcgacgcagaaacctcggcgctgcatatcgttgttggtgagcccctcctctgcgcatgcgcacggtggcagccgggcctcctgcgcccccaggcctgtcccactctggtccccgtcgcgtgttccagccgttgccgtcctgtcctggccgtgggtcacgctgtgtcccctgctctgctcgctgcgctgtgatcccactcagcacgcagctccgaggccacgttgtcaggacgggcttcctgggggcacgcccagtgtgggccgagttctttcccacggaatccaccacatgcgcgatgcccgtactcagctcacctgactcttgctcagttcctcctccagaggctgctgccccgaggctcggaaaccacccgcgtcccgccatactgcctgtggcagtgggcacgggcagctgtgcctgggctgccagctgtggaacgcatgcctctgtgaggcctcgaggcttcagtccaggatgcagagccccggtcaggaagagcagaaggggctgcccatggcactcagcacggtgggctctggcaggacagatcttttgtgccttcgcctgttcctcaccccagtagacagggttaccgtgcctcacctgaagtcacagaaactgtatattttaaaatagccacttaggatttttttttttttttgagatggagtttcccagttgtccccaggctggagtgcagtggcgctatcttggctcaccgcaacttccacctcccaagttcaagcgattctcctgcgtcagcctctagagtagctgggattacaggctcgcgccaccacgtccagttcattttgtacttttagtagggatggggtttcaccgtattggtcaggctggtctcgaactcctgacctcaggtgatccacccgcctcggccttccaaagtgttgggattacaggcgtaagccacagcacctggtcaggatatttttttctttgagacagggtcccactctgtcacccaggctggagtgcagtggcatgatcttgactcactgtagcctcgacctccagaactcaagcgatcctcccacctcagtcttctaagtagctgagattgcagaagtgcaccactacacctggctaatttttgtgttttttgtagagacaggttctccctgtgtctcaaactcctgggctcaagtgatcctctcaccttgccctcccaaagtgctgggattataggcgtgagccactgtgcccggcctacttctgattttgcattttattttattctattttactttattttattttgagacagagtttcgctcttgttgcccaggctagagtacagtggcgcgatcttggctcactgcaacctccgcctcccgggttcaagcgattctcctgcctcagcctcccaagtagctgggattacaggcacctgccaccacgcccagctcattttgtatttttagtagagacggggtttcaccatgttgaccaggctggtctcgaactcctgacctcaggtgatccacccacctcagcctcccaaagtgctggggttacttacaggcgcgggccaccgcacctggcctattttattttttttgaaacagagtctcactctgtgtgtggcccaggctggagtacagtggtatgatctcggctcactgcaacctccgcctcccgggttcaagcgattctcctgcctgagcctcgccactagctgggatttcaggcacacgccaccatgcctggctaatttttatatgtttagtagagacaaggtttcaccattctggccagcctggtctcaaattcctgacctcaggtgatctgcccgcctcggcctccccacgtgctgggattacaggcgtgaaccactgcactcggcttgattttgtattttaaaatgccatgtactttttcttcattctaaaaccaccgtcctttcagttaaagatatttcatgagcctcacggatacactcttgttcagtccccacaggatagctccccgagcctgttttagaaatttgagtggagttcagtcatttgaataaaaaatatggcatccaacaccccaagagagagaatccttgcactgaatgcgttctgtttgtttcacactttttaaaagtaactcccacgtttgcaaagtgctattgaaggggatggagtggatggggcggggctggaggggggctgccttccctcacggccgttctctcccacaggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtaactcagaataatgcagactcgctccccgctggtcgtgccccgactgccttcacagatgttacctgactgaatccactgagcaccgtcagaggtgggcccccacctgctcacagacgggaagctaagggcctcatgaaatgtgccggggccagaacgtggcagggtctggactggaacctggattgctctaaaccagatcctgccccctggacccaagcataagccacagagtagacaccatgacggacgcagttcactccagaaccccaggtgctggaaccccaagacgccaggccaccagcctctcacatctggtaggcaggtgacagaggccaccccaaactgttcaagtggaagtattaattggaaaaaaaatagtttttaaaatatattttttaaaaatttttttgagacacagtcttcctccgtcactcaggctggagtgcagtagcacgatcacggttcactgcagccttgacctcccaggctcaagtgattctcccacctcagcctcccgagtagctgggactacaggcacatgccaccgtgaccagctaattttttttttttttgtatatttttgtagacaaagggttttgccctgttgcccaggctggtctcaaactcctgagctcaagcaatctgcccacctcggcctcccaaagtgctgggattacaaccatgagcaaccatgcctggcctgtaaaacaatagttttataatcactctgagcttattagtcaaagtggcaagaactttgtgcagaaattcagcctgggatatctgtgtggaagctcttctgtaacttcaggcacaggtatcctttacttcattcaacaaggttgcgtggttttgttggggttacaccgtagctagccatacaagtgagatacactcagcacgtatttgttgagcccctgctctatgccgggcctggtttttgaggcagggacgtgtccatgaacaaaacaggcaagatcctgccttcctgcggctcggccgcagtgggcacagaggaggaggagtgggagcgaatgccacgccgcactccctgaagcccaaaagctttcattctccacagtgctcttctcaccccagcaggtgctcctgccccactttatagcggagaaaacaggcacaaagaggttgcccgcatcctgcctcactctttcttgagcccagtggtcctcagactgtggtgggcacctgcatcctctggagggcttggtagaacccaggctgcggggaccccccagagcatccaacacggcaggtctgggtgggcttcggaacatgcaggtcctccaggctcccggggctgctgctggggcctcgggccaggcggcggtgacctgttacccgaccacagagtttagaatgaaccagaaatgaaggctggtgccagttcagacacaagagttgcagtctgcacacatcaggcagtgggtgcgacgtcaccagcttttaaacgctggaaaaggagaactttaaaaatacatagaattggccaggggcagtggctcacgcctgtaatcccagcactttgggaggtcaaggcaggtggatcacctgaggtcaggagttcaagaccagcctcgccaacatggtgaaaccctgtctctactaaaaatacaaaataagtcaggcatggtggtgcacacctatagtcacagctcctcggggggctgaggcaggagaattgcttgaacccgggaggcagaggctgcagtgagctgagatcgtgccactgcacttcagcctgggcaacagagcgagacctctgtctcaaaaaaaaagaaaagtagaatttcagcctgggcgacatagggagaccccatctccacagaaattaaaaacaaaattagccgggcaccccagttactcgggatgctgaggcaggaggagcccttgagcacagaaggtggaggctgcagtgagcagagatcaggccactgcactgcagctggagcgacagccagaccctgtctcaaaaaaaaaagaaaagaaagaaagaagaaaatatgtagaccatgaggtgtgccattctcgctgcccggtcgactttcccgcctctttacagttcgctttcagataaatctgtatcaaattaaatcgagtaattcctgatactaaaatcttaacccttatgagagaaagaaatagtgatttggcaaactttacgaagcttgaaaagatttaatgaaattaaaaactagtgtggcttgaaaattaaaacctaagaaatggcaaagtgaggtatttatctaaggcttattaagaaagggaataccgagaaaattagagaagccgcgagaattttaggaagcggtttgggttgtgccattctcccgactgccctttgttgagcccagtgtggctctgcctagaatgcccctgggatgccccctccctgtccctgcctgctggggtggggtggtgggcagcccccctgcatgcctggcccccccctttgccctcagcccatcaccacaggcagtggctgcagctctgtccctcccaccaggatgagagccccgaggcaggagacgccttccgggtctctggatccccatcctggccacagggcctgagatgctctcaggaaagcgggtttgggttctgtggctgtgaggcagaaagcacccggttgttctggagcagcacagagggcatggaaggagaatgagcgtgtggaaatgacacactctgttgagacacgtggagttttaggtgccggtaggacatctggggcccatctaggggcagacagaaaccgggacatcagatgtcggtgaggcgccaccctggaggctgcgtctgggtgatgaggcagctgcccccctgccccctgcacttgagagaggagccggcttggaaggttgctgaccagtgggtcggcctcctcccagggccgtggacacgacgtccttgtgggacccccatgggaggagcagggagagaggccagagccactctgcagggaggcggagctgcagccacctggaagggcccgcccgctgagtgcattccaggcacctggcccatgccaggtgcaagacccacagacggggctgtcctagggacagtcgggagctgactttcaggcacacagatgtcctaggagccagactgctcttgccggcagcttcccccacccctgggcggtgcacacttggctgtgggcttgccatctgcggatgaggatgtgaggcctctgtgtgtcgggggtaaggttgtgtgtgacggccctgcaggccgtcactgccacaccagatgtcatacagggcagcaccagccccagcatcagacacggaggagtgaagtcgccctgagactcacaggacacggcctggctcctggtgtggcccacgacaccctggggcccctctcctgcctcctgcccagtccctgctgtcctgctgggtggtgtttcccagacagcccgggtgccaggctgctggcagccccgtggacagcgcacacgtttgcctggagggtggccccagactttgggtggcagcggccctggcctctgtcctgagctgttcaggacgtcacaggggctgtggctgaccccagtgggggccaagccctgaggcaggtgggggcatcactgaccctcatgaagaggtggaggggatgaccctgagccactggagcccacaggccacatcatcgaggctatgaggggtggctaatggcaaaggccccactttgccagcgtcaagagtggccatagccctggctgtcccagcatcactgggtgtcagaaggcaccagcactatgactagacgtgctgttgtcctgagggagggcagagaccctgccactgccttcaatggtgacatggcctgaagcaggcccggcctctccctcctgcagacggtttaggcagatgcgcgctcagcgacatttctgaagctgcccagcacagcatcctaaccaagcaatgacccttgtggatgttttttcttcactgcactctgttcccaggtttaaagaccttcctctcccaccactgctatgaagggacagtgtccttcctccctgcacaacacacggtgggatctccaagggataggaagccctgccgggcagggtaagtgcattgctttgtgtgtttctcttgcaaatgacgggaaatgaagcaggacggttaggaaggtgaatgcagaagtattttccaaatgtggtggaaggtgccggatgtagcgtgcccagacacacgatgcctatgatgcccatgatggcctaggcgtgcatggggcttgctgtccccatctctgtccccatggcctgcgcaggcagctgctgctgtgccagggatgaggactctgggggagggtcccacacccactgttggagtgggggctgagcacagggtctttccctgctggggttccctttaccccctgcaggggcctgatggaggagaaatgcaggcaggaaaggatggcagacaccttatcagtgactgtgcgtgtgcagggcactggtggcaggaccgttggtagagctggctgaagtgtgcactctcagcagccaccctcctgtccacacccctggctgagaccctcacccatgttagccccatgctccaaggcaggagcccactctaaggttagcagagcccaggccagccacgccttcaaccccacaggaaggcagggaccctcagcaagaaggctcgggctggcaacaagggctggtgccaggggttggggggcagagccagggcagctgcccagggagaggggatgcaaagggaaagaggcgccccaccggggaggggaggctgagtgcagacaacacagctggaaacgctgcgctctccccttacatttggtcccccagtttggccactgcaggctctgcaatggtggctacgccactgaacaagcagggactcctttcacctggcatatctccgcccccacccccacacagtgtattcagtaatatgcgaccagtgtaaatagaaccttaaataaatctaaacatagttgtcccaggccgcatgacctccctagtgaccatggagggcgcctgaatggtcatcctgtctctgctctgcctggggctgaggacacggggctgtggagacagctgcgcctttgtgaaggacactcacgtcctttccttttaagtcatgcagacttcagaacctccttctagctcctttccttttttaagtgaagaattggagaccataaaatcagaatatgtagaggcagatgctgtttgcgtcagtgcattaaagaactcggctgctgatgagcgatttccatcagtgcaaacagtgtcctgtttgacagcgtgaatccggcagcccccaagatcagaaggacgtgctagacgaatgactaagttctaagctgatggttctgagttatttgcttgttattgactgtaacagataaaccctgtatgatttgttttctgaaagtaaatgagtcctcaccccaggagtccgctgggggaaccagtgcctcagtcatttctcccagccaggctatgttagctggagggccaggcagaaaccgtctccaggtggcacctcagcgtcctcatgctgtgcttctcctcatgtccaaaccttttagagaaggacatgttgaatgtgtcattgtaaaagtaggtctcattctgaaacctctaattaatatgccaaaaaatattttgttaagcctttgaaatggaattttttcgtatgtgaaaagaatgtaaatacatctatatgtgccaagcatacgcactgcacctgcagctccatatttaaaaggtgatgatattcttgtctttcagatgctttgtttgcaggcaaagcaagcagcagctggaggaggagcagaagaaagcactgtatggtttggaagctgcgggtaattcctaaaacacaggctcagtgttgtcactgtgtgtgctggagtgcgggtttctgtcctctctcagggcactgcctcttctccctgcccacctgtgcttttcctttttcctgtctggcaccaggcatccatttcttcttagccccaggcagcgtcaggtcactgttacttgccgtgtgtggctgtgtggagcagtgggttttgtgaaaggccccgttaccctttctgaaacgctgttgtggtgctgagtctggactcctgtcccaggtgctctagaatgtgggggcagcagatgtcccattgagggcttgcttggtgaccacctcaggccctggcaaccacacagtctctgtccagcagaggcagcctaggcagtgtacagtgagtgggtatggccatctgccgatgaaactttatttatggacactgaaatttaagtttcatagaatttccacatgtcacaaaatattattattttgatttttttctctttctcttcttttttttttttttttttttggatggagtttcactcttgtcgcccaggctagagtgcaggggcacaatatcagctcactgcaacctccgcctcccgagttcaagcgattctcctccctcagcctccctagtagctgggactacaggcatgtgccaccatgcccagctaatctttgtatttttagtaaagatggggtttcaccatgttggccaggctggtctcaaactcctgacctcaggtgatctgactgcctcagcctcctaaagtgctgggaccacaggtctgagccaccatgcccagtcaataatatttatttatttattgggacagagtcttgttccatcacccaggctggattgcagtggcgcgatctcggctcactgcaacctccaccttctgggttcaagcgattctccttccttagcctcctgagtagctgggattacaggcgcctgccgccatacctggctaattttttttttttttttttttttttttaagacagagttttactcttgttgcccagtctggagtgcaatggcgcaatctcagctcactgcaacctctgccttccgggttcaagcagttctcctgcctcagcttccccagcagctgggattacaggcatgcaccgccacgcctggctaatttttgtatttttagtagagatggttttcaccatgttggccaggctggtctcgaactcctgacctcaggtgatctgcccgcctcggcctcccaaagtgctgggattacaggcgtgagccaccgcgccagacctttttcaaggatttaaaaacgtgaaaagcattcttagctctcaggccacacacagacgggcggcgggccggatctgacacacagccttggtttgctgacccttgttctaaattgtccaaaagtcaccaagtgaggagagggacaacagtcctgccttctgggaggtgatcctttgggtaccacttcctgcggggagcggacagttccgtggtggatgtttttggtgttgagctgaagagtcgattgcatgaagtgtctgctaaatgcatgagcaggtgagagcccgaatggcctcccaccgtcctggtgcagggcgctgcccggcgccattgtaactgtgacatctccgtggttctttgtgcttcagaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccaggtaagtggggtgctcttgcatggagcctccactggcgagtaatttatgttccagcagtccctggtttatgtgttgtaggaattcattatttaattcaagggaaggaagggcaaacttttttttttttaatttcacaaactttaaactcctggttacaactactccttgtaaaatatcatttaaaacgataaatttttgaggccagatgcggtggctcatgcctgtaatcccagcactttgggaggctgaggcaggcggatcacccgaggtcaggagtttgagaccagcctgggcaacatggtgaaacctcatctctactaaaaatacaaaaaagccaggcgtggtggcgtgcgcctgtaatcccagctactcgggaggctgaagcatgagaatcgcttgaacccaggaggtggaggctacagtgagctgagatcacgcaactgcactccagcctgggtgacagagtgagactccatctcaaatatatgtgtgtgtgtgtgtgtgtgtgtgtgtgtatgtatgtatacatgtgtgtgtatgtgtatatatacatatatgtgtatatacatacacatacatacatatacacacatacatacatatacacacacatacatacatacatatacacacacatgtatttgagcacagaaactaagaggtatgaatctttataatacaacttcttacccgttgtttctcttcctatttaaaaacagaacaaagcgacacagtaaagatgtaagtggcccttgcaggccactgaaaatagactctttaggctcccagaaatgggttctgttcggacccttctaccacatctttctgtagcctatgcagaggaagacccgagtctagtcatgttgggggaagcggaacttttggtcacagtctccaaatttagtcacatttctttttttacttaagttctatttaagatctagtctaatgctatttttatgtggctttttaagtagtgcttgttaaaaagagaatacaaaattctaataatcactgctaattatttatcagaattctgtaaaaagcgttcgtcattgtagataagctgtggtttctaaaagcattagaagtcattttgacaagtgccgcggaaggtgggcaccggggaaggtaggcgccggggaaggtgggcgccgggaaaggtgggtgccaggtttcccttcatctctgagctgtcagttcagctggaaagggaactccaggggcctgcacaagcagtcgcatcctccgagaagggccgtgtgtgcacccaggcctgacagcgctcgctgtcaggcctggggtgttctgctgccccacccagacgatgacgtttagagctgaatggtccctctcactgtttcttggtagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcaggtgcgtgcaggggtcctccagccaccagcgccatccccttgagccctgaggtgtctgtcacaagctgccccacccagggtggggggttccctggggctttataaacacaaaacgtaagaatgttttataaatgcacttttctctccctatgtcaaatatcgaatgagatgccgttacccacattctggaaagatgccagggtgccgagtcctcagcattttgttttgcagataattttcatgggtgtttgaagctcctccatttcattcttttcctcttccacaccctgtgctccaggctggcattgggctctttgccctggcattctctctctcttctcctaaataattcaaaaggtgggaggctgaggcgggcagatcacttgagatcaggagttcaagaccagcctcgccaacatggtgaaaccccgtctctactaaaaatacaaaaaaaattagtcgggtgtgatggtgcatgcctgtaatcccagctaccccggaggctgaggcaggagagtcgcttgaacccaggaggcagaagttgcagtgagccgagaccatgccactgcactccagccttggtgacagagcgagactccatctcaaaaaaatttcaaaaggcaaacaaaggaaaccgcctttacaggcagtcctttgtccactgaatccaccagggaaccgctggcctcaagggccacagtcaatcaccaagtgcaggtgctccgtgcagggaggggcaggaggcagcagggctgggaagggcaccccgaggatgggaaggagaggaggagccccagagggacgccccgtgctggaggccacgcagcctaggggacgcggggaggcaggtgtggccacacacggatgttcggtctccctggggcaggtgccacacccctcctctggctggctgggcggagggtgggaagtggtgtcctccccacacccactggggcccattgtatttggaagtctgtgatgtatcacataaccagatggaatctgagtgcaaagaaaattgtttctccatggaaagacccagtaacaagcaagttgattttttcaaaaggccactgaattaggtgtgggcgtgcaaattacatgagactggggaacggtagagctcaggtggattctgaactcttggcagatgttggtaagagctcggtctacttcaaggaagcccagcttgacgctcgttaacagagtgtggctggcgtgagagcgatagcaggctggtcagcaggcccacgcctgtctgcaacgaaagctgggtgtcagatggcccttgggtgccttaagtcacagcatgtaagaggatgcacgcatctctgtggacagcgccccactttcagtgactcctcagccagccagctgcggctctaagaaagcttctcccattcgcatccgaacaagcctaagggaggaggtctctgcccctccccaggcccagggccacgcgccccctttctttctgtcagggcggtggtgatggcaagaggctgtcgaaaggtcccaggaacaccggccaccccaggcagccgtgcacagggactttcctctgtcaactcatttgacaagtttgggaagtgggattatttttaatattggtgtatgtatttattaaagaaatagaataatttgaaaatcaggacaggcattcttgaaatacgtcctgtctatcttgataaatatggctatgccttgagcagcacgtcgcttttaaaaatataatttgtgtgtgtgtgagctcagctccatggaaacagcctgtcacttatttatttctatttttttattttttgagacagagttttgctcttgttgcccaggctggagtgcaatggcgaggtctcggctcactgcaacctctgcctcccaggttcaagcaattctcctgcctcagcctcccaagtagcaggcgcccgccaccacacctggctaatttttatatttttagtagagacggggtttcaccatgttggccaggctggtctcaaactcctgacctcaggtgatccgcccgcctggacctcccaaagtgctgggattataggcgtgagtcactgtgccctgccccagcctgtcacttaatgaaggggtttaggttactgaaatacgtctgaggaggctgtgatatcattaataaatgagataaatagagctgtcctgtgtgggaagatggcactcacccacggactcactgtggccaccgagcccctgggcaggggacctccagggacccccaacttgttcctcaagcccgaaggctcttgctggcgttgggccacctgtccttctcatctgagcattcctcacacatctcttacacgcattgagtcgccccgcacagactcctcgcaggccttgcgcgctcagtactgctgagaaaatggaggtgggtgggtgggtggagtgggcagacactggagcggacgctctgctttccatgggggtgctggagttcgagtcaggtctaccgatgcccagatttcccacctggccattggcaacccctttacaaactcggcatcccgggagtctaagtgaattattccacgcccagggcccgtcattgtgggctggactcctacagcccacggtgacgtctgaccgttccatgggggatggacccccacttcagcccctgtccaagagcggtgctcagggccagctttgagtgagggacacgtggggtttactgcagcccctgtccaggagtggggctcaggccagctttgagtgagggacacgtggggtttacacgtggccgcttgtctctgcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgaggcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccccaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattcagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgagtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcag

SEQ ID NO: 38365 - DNA, 8545 bp, Homo sapiens
cacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacggtgagcggggcaggggccgagtccagcggtccaggtgggcggcggccgccccggcacgcagtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacaggtgagagacgagggcgccggccccggggacgcttccagttcccgcgccacgtgtggcacctccgctgcagcacgagctcgtccattgacccatcaatgtgcagagcgctcactgcgtgccaggcactcggaattcaaaggcggagtcccctgctaggagctcacagtctggttgcggggagacctcccccaagacagacagttccagtacaggatggttagtgcccggggagcacaggagcccgcccgctttcctcgtggggctggagtcggggtgccttcacctagtgggcagtgattggaaaccgagctggagcattccatctgcctccacagccgggcagtggccagatctggttcgtcctcgttctacccaagcagaagtgctgctgggtgcccggggtgtgcaggagtgtttgtgtggttatgccaggatctgaggacattcgggggttgtcacaagacaagaggacgcgcttgccccggctgggcttcaaaatctgctgaggagccgctttcagaccacggacaccagggccagtctgcaagtcaggccatctccagggtcacaagtctgggagcttgtgttttttttaaagttttctcggctgaccgggcgcagtggcttacgcctgtaatcccagcactttgggaggccgaggcaggcggatcatgaggtcaggagattgagaccatcctggctaacagggtgaaaacccgtctctacaaaaaatacaaaaaaattagccgggcgtggtggcaggtgcctgtagtcccagctactcgggaggatgaggcaggagaatggcgtgaacccaggaggcggagcttgcagggagccgagatcgcaccactgcactccagcttgggcgacagagcaagactccgtctcaaaaaaaaaaaaaaagttctctagactgtgagaaccactgcagtggagactccatgtgcaaaagaaaaaaaccaaatgtgaggtcataaagacttcctgccagcatggtgggtgacattgtttctttgcagattttggctatggaaaggggaaatgttctaagcagagcccgtcaggagcccacgggacacattttggaggtagagtagttcagcaaccttttcttcttgtctccatccaacacagtgccaggcacgtgtctggtgggactgtcaatgtgactggctatgtggtgtagctggagcccaaaagagcaggtgggggtgggatttcaagggttcagtcttgatcctagagtagcagcgaggtgacatcagggagcggggaagccccacctggggggctggggccacaggagccagctttacatggggctcacagctgggagggtcgagtgtggctgcttaagtccccggagggtgggaaggcggtggcaagagggagaagggaaaagtgggcgttatttaggctacctaggtaggaaagtcgggaagagggtcagggggcactgggtccccagcgttgcagcacctgaggagctggttgttgttgttgttttttgagacagagtctcgctctgtcgcccaggctggagtacagtggcacgatctcggctcactgcaagctccacctcccaggttcacgccattctcctgcctcagcctcccgagtagctgggactacaggcgctcaccaccacgcctggctaattttttgtatttttagtagagatgaggtttcaccgtgttagccaggatggtctcagtctcctgacctcgtgatccgcccgccttgacctcccacagtgctggggtacaggcgtgagccaccacacctggccacctgaggagctttgagagctcctagcacaggttgacctcacaccagggagctgggtgtgtgcagtggagtggcttgggtcgttttaaagctccccaggggagctttagtgagcagcacagtgtgggagcaggggccgaggggtggaaggagaagattgcaaatgcagacgcacgtctgtgtcactgcccaccttcagccaccttcacacttcctagtgctgcctgagtcatggtagaatgacaagcgtggctgcccgatctcacatgtggccatgctctggaaagacaggtgaacaggaaggttccctttcaacgctcttcagtagactttatgcatttgtgatgtctgttatttcagatgacagatttgaagatctggaagaggcaaatccattctcttttagagagtttctgaagaccaagaacctcggcctctcgaaagaggatccggccagcagaatttatgcaaaggtaaatccacggcactgtgggcgatggctctgtgggacgtttctgttccggcctctgcagcctcctttggaggaatcgtgcatgagtgtggcagagcaggcaggcgtcagtgctggggagcagctctgggctcagaagctgctgggctccttccggtagagagattgggcctttcttcttgttgcgaggcagaacacagaaaggaagatgcgctccgagtcagaagcatggcctccattgttttttttttttttttttttttaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcagtaagtgagcctcacggcgccctctggcacagcgcctgtccgagcggcttctcccggggagaacctggagccatcctacctcttgggtggcctggtttgatttccaggacaaggcgatttgcgtgacagcctgctatccactttccctttgactttgcttctggttacacgtgggaatagaaccggctaaagaggactggtgagctagaagctgtgaattggatgcagttgggcacttacagggctgtaccctcagtaaaggcaggctgcagtcgccagcttgctaagtattccaagaggaggaaaatttttaaaaaattataatcacctaaaaggttataagctctgaataaaaaaaaaaattttttagctgggcgccgtggctcacgcctgtaatctcagcactttgggaggccgaggtgggtggatcacctgaggtcagcagtttgagaccagcctggccaacatggtgaaaccctgtctctactgaaaatacaaaaattagctgggcgtggcggcaggcgcctgtagtcccagctacttgggaggctgaggcaggagaatcgcttgaacccgggaggcggaggttgcggtgagccgaggtcacgccactgtactccagcctaggcgacgggcgaaactctgtttcaaaaaaaagaaaaattattttcttcctgagacagtgtctcactctgttgctcatgctggagtggagtggcacgatctcggctcactgcaacctccgcctcccgagttcaagtgattctcctgcttcagccacccgagtagttaggactacaggtgcccgccaccactgctggctaatttttgtatttttagtagagacgggggtttcaccgtgttggccaggctggtctcaaactcctgaccttgtgatccgcccacctcggcctcccaaagtgctgggattacaggcgcgagccactgcccccggcctctgagtaaaattaactggcatctgtgaccacaggtctttgaaaagtgcctgcctccgtctgtggtctccctctgtagtggctgcaggtggatgctgcactgacccagcatctctgcttatcaggaggctctggagccacaccgcagaagcacacgcccttttgagccagacatgctgactttctaataaggatgttctctctccacagctgaaagatgaaaattctaagctgagaagaaagctgaatgaggttcagagcttctctgaagctcaaacagaaatgtatgtaagcttttagttaggaatgcaatccacaacatctaatacacagggaaatccgtttttaaatgataatgaagtaatcagagtcaaaccagatctgggttttattgtatataaatgttcagcatcaaacacatttctgtgttctgcctaaaagtttattttgagacagtcttgccgtgtcacccaggctcgggtgcagtggcgcaatcacggctcactgcagccttgacctccttggctccagcaatcctcccatctcagcctcctgagtagctgggaccacaggcgtttgccactgcacctggctaatttttaaatcttatttttgtagagacagggtctcactatgttgcccaggcttgtctcaaactcctcggctcaaggaatcctcctgcctcaggctcctaaagtgttgggattataggcatgagccacggcgcctggccaaggtttattttaaactttaggcaaaaagccaccaaacaccttgttggagcagcagtgctgtgagagccgctccctgcacgcctgcctggtggctacaggtccaggcctgaggctgccgctgcctcccctctgtgcctgagacccattccatcacaggctcttagcgggttttatctggctcatgaggtatctttttgtagtcctcttaaaagtagccacagaaattaacaactcgggtttttctttaacaagggtgaggacgcttgagcggaagttagaagcaaaaatgatcaaggaggaaagcgactaccacgacctggagtcggtggttcagcaggtggagcagaacctggagctgatgaccgtatgggtttcttctctgaatcggacgagctgggtggggcaggagcgctcctgagaaagtgctgttgtcctcagcagccggtgcagcctgcccttgggagcggggccatgtggctctctgggactggtgttctttgacgtcgctgtctcgctgtgcctggggatagctggcccacgagggcatccgtggggagtggggggccagagcacagacactgcacgatgagcccttcccaggggtggtctgagagtggaggcgggactgggaggggcacaggggctgtgaagggccacagccaggttgggtgccctcctgctccctgggttggggcccgtgtccggtatgaatgtgaggacatcagtgatgctttttgtggtttttcttttttgggtaacagaaacgggctgtaaaggcagaaaaccacgtcgtgaaactaaaacaggaaatcagtttgctccaggtaattaaaggaagggacttcagtgtttttctttgatttgtggagtcacataatgaattcagtaagaaagaggcgaaagactctgctggggtttcccctgagcccaagcagagaaaggacttcaaatgaggacagcagccgcttcctgtcagggcgtgaagcagagggaggccctggagctctgttgggagtttggggtctggcacggggcatccacttgtaggagtccctattgccatagagctaggtgctgagcatatactggagtgaaggggaagccattaggcccccagtcccagaggcgagcccccagttaggccagagcatgcatcttgagtgccaggcccccacgggtaagccctcgcctcgccaggtggtgactttcagccgggttgcctcggagctgctctgtccttagccgtaaccgtccccccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagtgagtgcctgggaggcaccgggaagcctggcggggaaaggggtgagattggagtggtcgtcagtgatcctgggtgggggcccaggctgatggcaccgtggctggaggaccagggagctgcagggagggacgcgtgctcagtggtcctgttagctctctgggtcactgtgtggacagaccacaggctttctaacctgcctcgcagtgtctgatcccacctgggaggtgcagacagccacagcaccctgcactgaacctcagccccaccccatgtgggcgctgaagctctgaataaaggaaatagtgggggtttccctcctgctgaaaaagccacttcccagaaggcccttactgctgtgcctggctggggacacgccagccaccatgactgtgacagtggtgagtgtctgccacccattgggctgagctctgcagggcggtgttggcccccagagcactccctgtgaacaagggagccgtctcctgtgaagtcaggtgtgggtctcctccaagaggagctaggagtggaaaacctgtggttctcccccagcccctccctttctcccaggaaccctgtccctttcttcccccggcaaaccccaccccttgctcccaggaaccctgtccctttcttccccggcaaaccccaccccttgctccctgggaccctgtccctttctcccccggcaaaccccaccccttgctccctggaaccctgtccctttctccccccggcaaaccccaccccttgctccctgggaccccttctgtttctccccccagaattctgtccctttctccctggaaccccttacctttctccccgccagaacccttcccctgtggaatccctccccgctctggaaaccctccccttccttccccacccccacccccggaattcctcccctttctccccctcagaacctctcccctttttctgcctaccaacccctcccctttctgccccccaccccctgtggaaaccctccccattcttccccctggaaaccctcgccttcctcccactcagaacctctcccctttccctaccccttggaacccctccctttttccccctaccaacccctcccctttctccccccagaaccctgttgctgctgagtagctgctgccacccatcctgatatccatgcttgttttcaggcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcacc

SEQ ID NO: 38366 - DNA, 6963 bp, Homo sapiens
gccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggaggtaagcgatggctacggctgggccggggtcagccgcgacagaccccgaggagcggccgggaggcgcggagggggcttcgcagttcctggggacccccatcctagaaccccagatccttacccctgcctggcgctcgccccccttgaaaaggaaagtgactcccacgtttccccagagcgaaatgaggcctccccgaggaaaagcgggggctgcagggtcaaaggtcagaggccagagataacctggccgcccccccacaccttaggctgggacgctcgccccagtccgcgccttcccccaacgccctgtggggactttggctttttccaggaaatgccgtaaagggatgaaaggcggggggggggcggcggaggccaaaaccaagggtcaagttcgggccgggagaacggtgcctagagatgggggagggatgatcccgtttccccttcccccaccggaacccccctgtctccatcccagctggagaagagcgtccggcgcctccgggagaagtttcatgggaaggtatcctccaagaaggcgggggctctgatgaggaaattcggcagcgaccacacgggagtggggcgctccatcgtgtacggtgaggctgcaggggtcccgggcctggtgcggggaccgcgcgtgggagcgccgagggggcgtggtctagggagaggcgttgagatcacctcccccggaggtcccagccttggggaggctctgcgtcgcggctctgggtggcctggaactcccacagacccttcaagggcccttcccttatatgcactctcccccgcaggggtaaagcaaaaagatggccaagaactaagtaacgatctggatgcccaggtaacctatcccctcccctcgcaaaggaccgggtcacgggagggagagcaagaggggggacccgacccgttcatggtgactgacccccctctgaaacaggagggaccaggcattgtcggtccataactcatcacccaatctcactttttcacctctccatcatttgtccggccagggagcctgcaaacagtaggcgctcattatgtgctgattgtattcaatgggggagagagccatgaaactaagcaatgaaaggagccaggattattgccatcatagcgggggcgcagaggtcagagaaggcttactggaggaggaggtaccaagtcttaaaggatggggaggagtgagccctgggaggggaaagggaaagaaaggcaggggtcttggggtgggggagggaatggcataagcaaaggctgggaggtggggaagggttgttagtggcagtctctagaaaggctaggatgagcagaggattggggaggagagagaggcaggggaatggaacccttgtgttgaatgaatgaatgaatgaatgaatgaatgaatgaatgaatggctttgaagcacaggtgcatcatggctactttgcttctttgacagctttggtgatgggaacgctgtggatttagcctgcctgaaaggcttagtgtagggctgttaaagagtataataggccaggcgcggtggctcacgcctgcaatcccaacattttgggaggccgaggcgggcggatcacctgaggtcgggagtttgagaccagcctgaccaacatggagaaacccgtctctactaaaaaatacaaaattagctgggcatggtggcgcatgcctgtaatcccagctactcgggaggctgaggcaggagaatcacttgaacccaggaggcggaggttgcagtgagctgagatcacaccattgcactccagcctgggcaacaagagcgaaactctgtctcaaaaaaaaaaaaaaaaaaaaaatgccgggcgcggtggctcacgcctgtaatcccagcactttgggaggccaaggcgggcggatcatgaggtcaggagatcgagaccatcctggctaacatggtgaaaccccatctatactaaaaatacgaaaaaaaaaattagccagttgtgctggcaggcccctgtagtcccagctactcaggaggctgaggcaggagaatggcgtgaacccgggaggcggagcttgcagtgagccgagatcgcaccactgcactccagcctgggcaacagagcgattctccgtctcaaacaaacaaaaacaaacaaaaccagagtataacaaaacatgtatcatagtctacatttatacatataaaagtatgataaaaatgatagcagaggggccaggtgtggtggctcacgcctgtaattccagcactttgggaggttgaggcgggcagatcacttgaggtcaggagttcgagattagcctggccaacacggtgaaaccccttctctattaaaaatacaaaaaattagctgggcgtggcagtgcatgcttgtaatcccagctacttggcaggctaaggcagaagaatcacttgaacctgggaggcagaggttgcagtcagccaagattgtgccattgcactctagcctgggagacaagagcgaaactccgtctcaaaaatataataataataataataataataataataataataatattagcagagagtagcattcattgagtacttcccacatggcaagattccaggaatttatttatttcatcactgcagtgaccccaggagacaggtcctattatttatccccatttcacagacaaagaaactgaggccgaagtcacttgccagcaagcaggggcagctgcgatttgaaccctggccacctggagtcagagcctgggctctaacatgcctgtcagtgggaacccagggggcagggagtggcttgcccaagtccccacagctggaagtgatacagctgggatttgaacccacatctctctcccacttagccgagcacaacgtggcctcaaaggggcgatatgtcacaacatcaacaagcatgtggcatttgcaggcaggaagtgagtatgggggtcaggctagcctcactcaggcaagccctcccctaagcctcagtttccccatctgagcaataaggtaacaggtgtgcccacctctcagggctgctatgaggacaactgaggccacacacctggctctcaataagtgagtggtgctctgtgagcttctggcgagttaggggcaccctactcattgcggccgggggcctcccccagcaaacgggtggaaagaggcctgagccccatccccagtttctgcccctgctatctccacccaggatccaccagaagatatgaagcaggaccgggacattcaggtgagttggtggctagggcttgggatgggggagttgggagggggacatctgcaggcacagaaggatgtccattagggcaggaggggagatattcactggggcaggaagaggactcgtctgtagggagaggagggctgatgcttatgttggtgcagaaggggtgacacccccccacctcatccccacctgccccattccacaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtgatgacctaaaacttaacctcgactttgactgtcccgaactccactcctgactcctatcctcagtgactgtacctctgacctaaggatttcaatcactgagagtccaatccctgacctccaaactcagagctcagccttgatctctgatcccaacccctgacccaggactggacttctgaccttaaatgtgagaagcccaatacctccttaccccagaacctgacccttgacccacaattgaacagctactacagaaatcaaacctggccaggcgcagtggctcatggctgcaatctcagtgttttgggaggctaagtagggaggatcgcttgaatttaggagtttgagaccagcctgggtgacagggtgagaccctgtctccaaaaaaaaatgtgttttgaagacagggggtctcgccctgtcacccaggctggagtgcagtggcgggatcatagctcactgcagcctccacctcctggcctcaggtgatcctcccacctcaacctcccaagcagctgggactacaggcctgcgccaccacacttggctaatttttgtattttgtgtgtgtgtgtggagatggggttttgccatgttgcccaagctggtctcaaactcctgggctcaagcaatctaccacctcagcctcccaaagtgctgggattacaggcatgagccactgtgcctggcaaaaaaaaatttttttaattagctgggagtggtggtgtgtgcctgtggtcccaactactcaggaggctgaggtgggaggatcgtttgagcctgggaggtcgaggctgcagtaagccatgatcacaacactgcattccagcctgggtgacagagcaagactctgtctctaaaaaaaaaaagaaagaaagaaaagaaaccaaatctgacctcaaaaacacagccccaaatctggcttctgaacctcctgactagtagttcacttctggtcaatgcttaactagttcttgcaaaagaggcaggaagccaagatgtgtagtgtttgccaatttctgtggtgtaaatattcccaccatggtcaatatcaggctacccacgtgaagtcactgattgagttgggttgctcaagctgaggccagccgctgcagcacactgctagccctgaccccaacctcagacacctctgacaatccttggtcccctctctgtaccttcctgcccaccaccaccaggtatcccggtgccggaaatgccggaagcgctacgagccagtgccagctgacaagatgtggggcctggctgagttccactgcccgaagtgtcggcacaacttccggtgagggcgctgacccccagctccccctcagccctgccctaccccagccctgcccctccctgccctggccccaccctggcccagcctcgccctcggaccctcacagccctgcccgcccccaggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgaggtgaggctcttctcccccaacagcctggacagtctttgtccccttctgtgcctttaagtccccaaatctccactcagtccactttgtctcccacagcagcagccactgcttccacatggcctccatgaccccccagtctccgtggtcttgcccaggaggctctgaggtttcaccccagtggcccgtgcctgagggtccccatggcctctgcccccatggtctctgggtttggggcccctgttttgtcccctgtaatctcaggtgacccccatgtccccaggtctcctgtatcttcaacacccctgaatgtccagttgtgctggtccccgtatctggtggtctcagctcctccctagagccccgcgtggcctaagtcccctcctccccagactctcatgggacctccagccccatgtctgcagcacctctccctccctagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttacc

SEQ ID NO: 38367 - DNA, 77941 bp, Homo sapiens
ggcctgcggggcggggcctgggccaagcggcccgcaggaggcggcggcggccgttcagtcccttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctgggtgagagtcgggcgcgcggccgggcctgcgggggatgggcgggagccgtgcagggtggttgggtggtctccccatggctagtttcacgcttctggggctggaggagccacttgatggcggggaggccttctgactgcggggttccccccagtcttggggaacatcacccctccacagcacctcctggcacttcctgactctgcagcgtctcctctgcatgtgggggtcaccctctccccgggagtgtcacccctcgggagggccagctgcctgttgaccgtgtgaccccttgctaggctttcctacctgtgaggtgctccctggagtcttgacctccggcctgtgggggcttcccccggacatagggcctttttgacttgcagctcttcctctgtttgtgggggtcccttgccagtccccagtgccgtgcactctgtccccctgacctccctcatctccagctgcccctgctggaggccagcacctagcaggatggtcaggcaggaggccctgtccacgtgtctacactcccagcccccaaacagaacctagtaaaagactctctttccacccatcaccttgaacctcagaaactgcctctctcggtgcgggtggggcaaaggctccttctccgtggggtaaccgctccgggtgctcttcctgagctctagctggcttgcccaactaccagctccacccctccaccctgcctcccctaggtattcctaggggattttttttttttttttttgagacagtttctctctcgttgcccaggctggagtgcaatggcgagatctcggcacactgcaacctccgcctcccgggttcaagtgattctcctgcctcagcctcccgagtagctgggattacaggcatacaccaccacgcctggctaattttgtatttttagtagagacggagtttctccatgttggtcaggctggtctcgaactcctgacctcaggtgatccgatcgccttggcctcccaaagtgctgggattacaggtgtgagccacggcgcctggcctcctaggggatttttaactcatggtctcccctcctcaccccctccgctggcgcagggactcccttgtttctgttggtggcgtcactgttcttgctcaggctcacagggatggacaccccagtcacctgtggcaccagaagtcttctgccacagccccatgtcgctcacatctcctcctttgcagccccttgtcaggggttctggggcctcctttcctcctcaccaaacagtggttggttttcctgcttcctgcttttccatccatttgcatcctgcttgctttgccagagtaatcttgaagcatacaggtcttactttgtcactccttggctcagaagttctcagtggttccttgttgaccacaaaattgcagacggctgcctggcagcttccaggccctccacagcagtggggagcttccacagagtcattttcctaggctaacccagagctgttcctctccttcccttcctctcccttggagacaggtgtagtctgttgccccaggggcttctggacagcagttggtaaatgagtatgtgttggattagggcagcctggagactcctggaagaagcaggaggctgccatgtgggattatgttcttcctctgtgtcaccttgccttgattccatctgtttcctctgccagcaataacagaatgctggtctggtgcctgtctagccctgatgttatgaaataatttcagatcgggcagccctattagatgggtgaaaccaccttcctccgtgggaagtgttgaagagaagggatttgtaatctgactatctggattttttttttttttaagcctcgcttttctcccccaggctggagtgcgacggcgcaatctcggctcattgcaacctctgcctcctgggttcacgcagttctcctgcctcagcctcccgagtagctgggattacaggtgcctgccactatgcccggctaatttttgtatttttagtagagacggggtttcaccatgtaggccaggctggtctagaactcctgacctcaggtgatccacctgcctcggcctcccaaagtgctgggattacaggtgtgagccaccgtgctcggccgactacctgggttttgaactagctctaccacttaccagctgtgtgatcaggaggaagtcattggatctcttcatgccttgtttcctcatctgtaaaatgggcataacaggacctgagtcattgagtgggtgtgcaggtgacaggagatggtcaagcccagtgctcagctctgccctgggtccctggggttgtggagtaaacatgagcaagtgctgggagggcccgagcatggctgcggagctcctttccctccttcagggctctcagactggtggcccatgggccaggtctcatctccagacacactgttgagttgcctgcatttaaaagttaggagagggggctgggcgtggtggctcacacctgtaatcctagcacttggagaagctgagatgggtggatcttttgagcctaggagtttgagaccagcctgggcaacatggtgaaacccccatctctacgaaaaatacaaaaaattatctgggtgtggtggcatgcgcctgtagtcccagctactctggagactaaggtgggagggttgctggagcccaggaggtggaggtcgcagtgagccgagatctcgccactgcactgcagcctgggcgacagagtaagactctgtctcaaataaataaaagttgggagaccatatatgaaaagcaagctttccaacctctgagatccccaaggcctgtcatgctgggtctgcattcccaacgtggcagcattgtccggagctgagtgaggcccctccctttagtttggaggagggcatttagcactgtttttgtccttttctcctcttaccactcttgaaggtgatttccacctgactctcccctttcatattcctggccctggaggctttgggctttgcttgaagatccagctcaaatgctatcttctttttgattattctctttgaatatttctgccttccctcttctctccaagcacatgtaatttgggctttcattctgccctgcctttttgtgtatttgtgagcattcttttttttttttttgagatggagtctcgctctgtcacccaggctggagtgtggtggcgcgatctcggcttactgcaacctccgcctcccgggttcaagcagttctcctgcctcagcctcctgattagctgggattacaggcatgcaacaccaagcccggctaatttttttgtatttttagtagacacgggggtttcaccatattggccaggctggtctcgaactcctgaccttgtgatccacccacctcgacctcccaaagtgctgggattacaggcgtgagccaccgcgcccggctgtgagcattcttattgcttaaagacagtgcccgcgaactcgtatcctctcctctgtgtcccagcagaggctcacttgtagcctgtatacagtatggggccatgctttggactggatgtcagtagagagcaaggcacacatcctcagcagccttgctcccgccctgcaggcttcagggaggaaggcaggggcattccccactccggccgcctctccgtgagcccgtcttcccagaccaaggttggcaggacgtttctatccctgcattttgggaggctctggtagggttacccaccctcttttccactgccataaccacaggttggttggttcttgtcactgcttccagctgaagccacctgtgcactccctgcacatccacgtggggctctggggtcctctgatgcagacttccttggggtcggctgcagctccagcctggcatatgtgcctgtgattccaggcctctagcaagctctggcagacatgctgcatgtactagccctctgtaattaggaggcagggaggtggcaccagtttcaaaggcatgctcttttggaggactgtgccaagtgtccttctgtgtaccacaagctgcacgtcggctctctgtgcaagcagctgggatggagtttgccaacaaatagaaggcttgggccctgttctcaaatagctccgggtggctaggggagagagctcatgtgaagatagtgccacacgttagtggacgctgggcattccacgaatggggcattggtgttgacattctgagtactgcactgttgtatgacagatgcagctgacggctgtaacttcagaagaatgtgtgttcagagttccaagctaaggaatccaggagtggccaacccggatttattccttgtctatgaggaacatctgaacccccggcccatcccatggaatgcaagctctacagggggattgaggccctttcttttggattaagtaaaggttaccaggtggaagttgctaggggagggtgctgagtgaaggtgctgtataaactgcgtgcattttacaagcggttgcggttctcctgtccagcctgctgcccccagaccatccctgtaggtaagtttccaataaaccctgtgtctggctcactgcttccagatctctggaatctggtgccatctattggagttaacaggggtccagcacaacagcagtgcgctgggtttagcagagaatgcggtttagaagggcggatagcctgtaatctcagctacttgggcagcaggggcaagaggattgcttgagtccaggagttagaggctgcagtgagctatgatcatgccactgcactccagcctgggcagaagagtaagatcctgtctctaagaaaatgaataataaaaaagaggcagataaaatcttcagctaagatttgaaggtgtgggctggccaagattctcgtaggtggagaggaagaagggctgaaaattcagaagcctgtagggaccagacaggtgcccaagataataatagttactattcagtgagctctctctgtatgtcgggctccatctggcacctgatatgtatcaactaatgtaatcctctcagtaatcctaccaagtaggtggtagtagtagccccatttcacagctgaacaaaccaaggcacgaagtctcagttaagactttgtagctgtaggcagtggagctgtagtctgccgtctggttagttgttgcctctggcatttgcctgagggcccgatgaggcagctgttcccagttctagctaatcctcactgtgtggtgtggacaatgcatttgttacctattgctggtgacaaatcagcccaaaagttagcgacttaaaacaagaataaacctttatcacctctgagtttctgtgggtcaggactggggagtggctagttgggtggttctggctcagggtccctgaggggctgcagtgggaacgcacccgtccccaagagctcactcacatggcggtaagttagtgctggtggtggcagcaaggtagtgcaggagacatctgccatatgccacctaggactgcgtgagcatcctcactggcttctcctggagcaggtgacccaagagagccatgtggctgcagtgaccgttacaacctggccttggaactcacgtttggccacttccacaataccctgttggtgacacagatcagccctctcaggttggaaaggggaccatagagggccatgaatgcctggaggtgacaattactggctgatgaccacagtcaggtactcacttttctcaggagaagccggagtttcatttaaaaatggatttatgtgcttgctttggcagcacatatactaggtagaaaaatttgcatgatccctgcacaaggtggagatgcaaattcacgaagtagcccataaaaaagcaacaacaggcttttaagtgtgagcagcttgcacaggctgaatcagacctgggcttgcggttgcagcgtcctccctggtagaggcggggagcgtgggagcagaagagtgtgtctgaagagtcgcatttgatgagagggctgagttgctgacagtgggaaagtttccacctgaagtcggccgcttttgctgtcgtctcccagggtccttgtggtgtcaagaggccattgtggctgcatccttccagattcatggggctggccgcgtctgccttccttagtgatgctgttggcgaatgcacttttgtgatacttttttttggttgttgttgttgacagagtttcgctcttgttgcccaggctggagtgcagtggcacgatctcggctcactgcaacctctacctcctgtgttcaagagattctcctgcctcagcctgccaggtagctgggattataggcatgcaccaccacacctagctaattttttgtatttagtagagatgggatttcaccatgttggtcaggctggtctcaaactcctgacctcaagcaatccacccatctcggcctcccaaagggttgggattacaggcgtgagccaccgctcctggcgctttttttttttttttaaatggggtctcactctgtcgcccacccaggctggagtgcagtggtgggatcatagctcactgcagacttgagcttctgggctaaagcgatcctctcagctgtccctgccccagttcttgtgatccctccttgtccaacataactgaggaccattcctggacaccacagtcagaggggacactgctgaagggcagggagcatcgtgtctcttcttgtcttccccaccggggctgggaacagtgaggatgggcaagcttgacttcactgatggcagtgagataattcagctcagcggttgtattataccttttcccccattcctgataccccattggccatcttcctgttatgttattatatccttgccagtctctgccttcctggagccctagcaaggctgtgctttgaaacagaagcactgtatggcttcccttggtccccgataggataaaattctcctgtccctaaggactgattggctcactgtggccaatccacttggatcctaggcagttgagagggtaaagagtcctcagcgaggctggggttagtttttcagtgaagtcacatttcctttaggagttaaatacatctctttgtgtcaagtttccagctcatgtcttgatggtggggaaaagttattttgagtataactgagtggaatctgcaagggggaactcccctgggcataaaagttagactgttgtggaataaaaggagggagaccttttaccatgtaacttttgttttttttttttttttttttttttttgagatggagtttcgctctgttgcccaggctagagtgcagtggcgcgatctcggctcacttcatcctcggcctcccaggtttaagcagttctctgcctcagcctcccacgtagctgggattacaggcacccgccaccatgctcggctaattttttttgtatttttagtagagatggggtttcactattttggccaggctgatcttgagctcctgacctggtgatccacctgcctcggcctcccaaagcactgggattacaggcgtgagccaccgcgtctggcctccatatgactttttacactttcgtaattttgagtcttgtgaacatattgcttcaaaaatcgaaataagtagtaacacctcccaacattatactggccttgagaagtcatcaacagactaccagttttgaacttctgggttttccaatgtatcgactataaatttcctaaggttgtatggtataataatggtgaactcctaatgccatggtgttaatttccaaggccctgttctaagcactttctacatgtgctcatttaaatcctcacaacagccctgtggctggagggggattattaattatccccattttgcacttgcctgaggtcacaaagctaataagtggcagaaccaggatttgaacccgggcatttgggctctagagtctatgttcttaggcatggtagttaagatataaaatcactgaagatgactcaaaacatcaccgcctcagcttttgttctttttggggactagtggtgttgggtttgcgtcaatacaaattaagctccttcctcccccagaccatttctcctcagatgaatttggctcgcttggacatgctcaaggcttctgaggtgtgtccatcttattaatggattgccaagatttcccttctaaggttaatctgagctatttcatttttagagagttatgatgacttgtaccattggtccgttgagtcatattcagacttctgggcagagttctggaaattcagtggaattgtcttctcacgtgtgtatgatgaggtaagtagagattttccgtggatatcatctctttttgtggtcgtgcttcaaagtgaaatgctaattttggggaatactgaattgtatctcctttttacaacctcatgcagatgggaaaaagtcattgccctagagaactggcattaaattatcacagacctcatcgagaactttgcagcctgttaatcctctgttgtatggggaccccaggccctgtcctgggaacttgagtgatcctaaatagtagttttgtttgtttgtttgtttgtttttaatttttaaatatttggggctgggtgcagtggctcacacctataatcccagcactctgacagaccaagatgggaggatcccttgagctcaggagtttgagtgcaggctaggcaacatagcaagaccctgtcttcaaaaaaataaattagctggtcgtggtggtgcatgcctgtggtcccacctactcaggaggctgaggtgggaggattggttgagcccaggaggttgaggctgcagtgagctgtgactgcgccactgcactccagcctgggcaatagagccagaccctgtctcaaaaaaaaaggtttaattatgttaaaatacatatatcataaactattatgtaaccatcttaactattttaaactgtacacttcagtgatgttaagtacatttacattgttgtagtttttttttttttttttttttgaggtggagtcttgctctattgcccaggctggagtgcagtggggccatcttagtatactgcaacctccacctcccaggttctagcagttctcctgcctcagcctcctgagtaactgggattacagtcatgcaccaccacgcctggctaatttttgtatttttagtagagacagggttttgccatgttgcccaggctggcctcaaactcccaaccttgggtgatccacccgcctcagcctctcaaagtgctgggattacaggcattagccaccatgcctggccacattgtcatagttttttttttttttttttgagatggattcttgctcttttgccaggctagagtgcagtggtgtgatctcggctcactgcaaccttcaactccctggttcaagtgattctcctgcctcaccctcccgagtagctgggattacaggcatgcgccaccacgcccagccaatttttgtatttttagtagagatggggtttcaccatgttggccaggatggtctcaacctcctgacctcatgatctgcccgcctcagctttccaaagtgctgggattacaggcatgagccaccgtgcccggcattagttttttaaactatttagaagtttcgttctttatttttctttgagaccgagtctcgcttttgtcacccaggctggagtgcatctcggctcactgcaacctccacctcctgggttcaggtgattctcttgcctcagcctcctgagtagctgggattacaggcgcccgccaccacgcccggctaatttttgcatttttagtagagatggggtttcaccatgttggccaggctggtcttaaactcctgacctcaggtgatccgcctgccttggcctgccaaagtgctgggattacaggcgtgagccactgtgcccagctggagttttttttttttttttgagatggagtctcgttctgtcccccaggctggagtgcagtggcgtgatcttggctcactgcaagctccgcctcctgggttcacaccattctcctgcctcagcctccccagcagctgggactacaggcgcacgctggcatgcctggctaatttttgtatttttagtagagatggagtttcaccgtgttagccaggatggtctcgagctcctgaccttgtgacccgcctgcctcggcctcccaaagtgctgggattacaggcgtgagccactgcgcctggctggagttttgttatttttttaacctgcagcttagaaaaaacttttcaattccttacactgtaaatcaataaatatcgggaaaaagggagtcctgccattcaaagtcgaatttattgtctccttggggcaaaccattttgaaatgttgatcttttgggactttgacaataaaaatcaaggttccagcactccaaggaaggaagcaaaggctgaagcccccaaaagttgtaggcaaggggcaggtggtcctggagcttgctctcctggtttccatgcgtctgggcagagcctgacgtgttgggtgtcgtctttgtctttaggatctctcactgagtaggtgtttaatgagtatttgtggaacacatatgttactggggatggttgttttccgttggcattaatccctactttcagtttctagcttttaggccagttcagagttcagtccataaaatgatttaaaaatgctctgggccaatgagtgagctggcttcctgggaagaagaaccacttttgctgatttgtgacatagtctcatgttttgctgatctgtagcgtagtctcatgtgtgtgcgtcttggtttgttgtcattctctataggttgtggacacatcgaaaggaatcgcagatgtccccgagtggttcaaaggcagtcggctcaactatgcagaaaacctcctgcggcacaaagagaatgacagagttgccctttacattgcaagtaagtcctgatggcgagacctgggatttcctccgtggaagttctagatggtgcatgcatgcggtgccacatatttggagagataggatttctaaaccatatgttggcacctttctgatgtaattaagatttctgtcgactttatttttgctggggaggggaaagggccagtgtgtggtcatgctttatgggcaaaatggagatactcagtattaagtaactagcttgtgtcacacagaaagttaatgatggaactataactagaatctcttcccattggcttttccttttaaaataaagttgaggctgggtgcagaggccgggtgtggtggcccaggctggagtgcactggcatgatcatggatggctcactgcagcctcaatctcccaggctcaagcaatcctcccacctcagcttcctgagtagctgggactataggcacacaccactatgcatggctgatttttttttttttttttttttagtagagacagggtcttgctatgttgtccagggaggtcttgaaatcttgggctcaagcagtcctctcatcttggtttcccagagtgttgggatttcagacatgagccactgcacccggcccctgtgcagcttttaaaaatttattattatttttaaattgtgtgttccactttgggaggccaaggtgggcggatcacgaggtcaggagatcgagactgtcctggctaacatggtgaaaccccgtctctactgaaaatacaaaatattagccaggcgtggtggcgggcgcctgtagtcccagctactcaggaggctgaggcaggagaatggtgtgaacccaggaggcggagcttgcagtgagctgagattgcgccactgcactccaggctgggcgacagagtgagactctgtctcaaaaaaaaaaaaaaaaaattgtatgttcagcaagagtttattggacactctttgtgtctaagacatcttgtaatgtaagactcagagataaactgaagtcgtgttctgcctccagaatattacattctaatcatggaaataaggccaacatacacagaaacagttgacaatctatattaaatgccaaaatgagtctccaagttggcaattttttttttttttgagatagaatcttcctctgttgccaaggctggaatgcagtgatctcagtttgctgcaacctctgcctcctgagttcaggtgattctcctgcctcagcctcccaagtagctgggattacaggcgagcaccaccattgctggctaatttttgtagttttagtagagatggggtttccccatgttggccaggctggtctcgaactcctgacctcaggtgattccccccgcctcggcctcctaaagtgctgggattacaggcgtgagccaccatgcccggccccagttggcaatttttattagaagccagagaaagattaattcactgtggtataaaatactcatcagaaacttcactcactccctagatcagcacaagaaaccaaaccactggaaacaggcagtgagtggccctgcccaggctacagagcagggcctcccttctgccatcgtgggaaggaccagcagcccctgtgcagttggtaaagatcatggcagtccagttcccaccgagacttactgggacacatcttccggggctggggcccaggcttccatgtattttcaaagcccatgggcacttctgatgcacattcctggtgaagagccatggagcaacgtctcgacgtaccatatggggctggtcagtgttccattgctgttttccttggttctcagccttgacatggtcatggcagagtagataggtggtctggggtcagggctctgactggctctcccgtgccctttgcatgcccacctgtctgttacatccatttgttcctcagatctgtattaaatgcctcattagggctgggtgcagtggctcacgcctgtaatcccagcactttgggaggctgaggcgggcagatcacctgaagtcaggagttcgagaccagcctggccaacatagtgaaacccatttctactaaaaatacaaaaaattagccaggcgtggtggtgggtgcccataatcccagctactctggaggctgaggcaggagaatcgcttgaacccgggaggtggaggttgcagtgagccgagattatgccattgccctccagcctgggcgacagagcaagactccgtctcaaaaaaaaaaaaaaaaaaaaaaaaagcctcctctgcaaggagacaagctgcctgccctgggagacgctgatgttccggggggcaaagcgtggtggtttaacaataagtaagaaaacatgcttggaagaataagtaaagcattgtgatgggaaagggatgatggggtggggtgtagggctgttttagacagggctgccagggaaagcctgtttggaggagtctacggaacttgatgaagccttcctctggctgacccctgtacctggaatctcctccccgcacctctgcggaagtcatgttcccaggcacaaggaacagccagaagaaggccctgggctggaggaggctctgtgtctgtggggaacagccaggaaggctgagctggggggcctcggtggtgagtccaggagtgtggggaggtgtgagagggagtgggccatcctcagggttctgagcaagggctgggtgatcccgtggtgacctggctgctgggtggagaacgggaagggattgcatcatgggaaaggagacttaggggactgctccgtgctccagctctgcgtccccagggtcacccctctgacagggtctcactctattgcctaggctggagtgcagtggcacgatcgtggctcactgcagcctcgacttcccaggctcaagcgatcctcccaccttagcctcctgagtagctgggatcacaggcatgcaccactgtgtccggctaatttttttttttaagtttttttgtagaaatgaagttttgccatgttgctcaggctggtctcgaactcctgggctcaagcaattcacctgctttggcctcccaaagtgctgggattataggcatgagccactgcgtccagccagctcctttcttccaattagcatataattcatataccacagaaatacccttttaaagcctgcagctcagtggtttttagcatttttcaagaggttatgcagccaccacccctagttccagaacatttccattttccgaaaggaaaccccataccaattagcagtcactctctgttcctgcctcccccagctcctggcacccacctctctgctttctttcctgggtttccctgttctggacattttgtataattggatcatacgatatgtggccttttgtgattggctgctttcgctcagcacagtgttaccaaggttcatccacattgtagcatggatcagtacttcattccttttatgtcctagtaatctgccacagtacaggcagaccacatttcgttgatccctaagaggctcctgtgagactggcctgcctcaggcactgcagtgcatgtgggaacctccctagggtgccaacccagtcgcctctttcgtaatcctgagaaggagaacgagaacgctgcgtctcttttcttttcctcgtctctttaaatgtgtgtgctttaacccaatgtctcagacacttcatgagctcctggtttctcctgtaaagtgggaacggtcaaatgtgaatccttaaaaaaaacccaaaaacccaaaactaaaaatctaaacccaaaactaaaaaactaaaaatatacttgattcctagtgatgacataagccagtcttcccagaacttgtaatacgggtgtctgggtggagactgaactgggtggggtgtctctctctctctctctctgttacatacagtattggctgaatccagccagttgccttttatttttttaaacccggccctgtctcgagggtgggttataattctgtgtctgtttcacaccccctacccctttaccttagcctgtcttctcttcactcccaccatctcttctcttaagtatttgagccccccctttttaaaattattttttatttattattattaattttttatttattttgagacagagtctagctctgtcccccaggctggagtgcagtggcttgatctcggctcactgcaagctcctcctcccgggttcacgccattctcctgcctcagcctcccgagtagctgggactacaggcgcccgccaccacgcctggctaattttttgtatttttagtagagatggggtttcaccgtgttagccaggatggtctccatctcctgacctcgtgatccacccgccttggcctcccaaagtgctgggattacaggcgtgagtcaccgtgcctggcctttttattttattttattttgagatggagtctcgttctgtcacccaggctggagtgcagtgtcgtgatcacagttcactgcaatctccacctccccagttcaagccatccttccacctcagcctcctgagtagctagggttgcacgcgtgcgccaccacactggctaatttttgtatttttagtagagatgaggtttctcaccatgttggccaggttggtcttgaactcctgacctcaagtgatccacccgcctcagcctctgaaagtgttgggattacaggcgtgaaccaccacgcctagcagagccccttcttttaatgagctttatcccttccttataattgcagtgggaataaggacccttatgccagtgatcacagttagtttacaaatcgcatcccttacttaagcaagggcctaagcagccgattattggctcgggggctttaagatcattgtgcttcgttttctgcatgtttttcctgacttgttccttacccagctgggtgcaggtgctcacggagctctgctccatgctcactcaggcgttctcagcaaaactcatctctcctatgggtaatccccgtcgaggccatgcgatgccctgcttaaaaaaatacatacatgtgcacaattgccttcatgctccagcgagtagagcaaacaacatgcattagcacatccgtgttgagattgttagaacagctgcctgcgcagcacattttgcttttgaagagtagctatcagcttaccgagtattttcacatgatggaaagttttctgggctgggaatgtgggagaggtaataaaaaggctaccccagggcagcaaggagaggatgaagggcagacgcgtacaactctaggcaaataggaaaaaaaaaacgagtttttttttttttgaggtggagtttcactcttgttgcccaggctggagtgcaatggcgtcatcttggctcactgcagcctccgcctcctggcttcaagatattcttctgtctcagcctcccaagtagctgggattacaggcacgtgccagcatgcccagctaatttttgtatttttagtagagaggggttccaccattttggccaggcttgtcttgaactcctgacctcaagtgatctgcccgcctcccaaagtgctgagattacaggcatgagccactgcgcccagcctgatttttttttttttttttggagacagggtcttgatttgttgcccagattggagtgcagtggtgcagtcacaactcactgtagccttgacctcctgggctcaagcaagtctaccacctcagcctcccaagtaactgggaccacaggtatgtgccactgtgcctggctatttcatttttttttttttttaagagatggggtctccccatattgcctaggctggtctcgaactcctgggctcaagtgatcctcccatctcagcctcccaaagtgctgggattacaggtgtgagctgtaacacctggctggaaaaagccagatttatgccaaagggaaattaggatgtttattcactttctaaaagagacaattcgccagcacggtggctcacacctgtatatcccagcactttgggagcccgaagtgggtggatcacaaggtcaggagttcgagaccagcctggccaacatggtgaaagcctgtcgctactaaaaatacaaaaattagcttggtgtggtggcgggtgcctgtagtaccagctactcgggaggctgaggcaggagaattgcttgaacctgggaggcggaggttgcagtgagctgaaatggtgccattgcactccagcctgggtgacagagcgagactctgtctcaaacacacacagacacacacacacacacaaagaggtaattcatgttatagaactgaaaagcgatgatcaatcaggagcaaaatatttgcatcaagggtaatggtcaaaagagtaacttctatactgtagaaattatcttcaaatcattttcctgtaccttcacaacactgagtcttacttgtattagttatctttccatgtcatagatttcctgaaagccatagtttagaacaaacatttcttacctcccagtttctgtgggttacaaatccagcagtggcttagctgggtgatcactcatcaagttgcagtgaggatgctggcaggggttgcaggcatctgaaggcttgactgaggctagaggaaccacatccaagatggtgtgcccacgtggctgttggtgggaggcctcgttcctcctcgtgtgggctgcctcctccagaggcttcctcagtgacctcacagcatggccactggcatcccctagagtgagccagatgggaactgcagtgactcttatgaccacagctcagaagtcattgtcatttccacagtaacccatcgattccccaggtcaggtgtgaataccagcgggcaggagtcactggggggccattgtggaggccggctacacactgtcccttcccatttgtacagtctgttaggcgaaaattggtatcttcctgttttaacatacatttctttgataacgggtggttgatcgttttttttttaatttttttctgtactatcaaagtttttgacagtaagcttgtgtcacttttaatcttctaaaaaattatactactgagcaataaaagaagtgaatttttttgtttgtttgtttgtttgagacagagtctcactcggtcgccgaggctggagtgcagtagcaccatgttgactcactgcaacctccgtctcctgggttcaagcaattctcctgcctcagcctcctgagtagctgggattacaggcgtccaccaccacgcccggctaagttttatatttttagtacagacggggtttcaccatgttggccaggctggtcttgaactcctgacctcaggtgattcacctgcctcagcctcccaaagtgctgggattacaggcgtgagccaccgtgcccggcctagaagtgaattattgatgcatgcaataacttaagtgaattttagtggcattgcaccaaatgaaaaatgccaatcttagaaggtcaccttctggctgggtgcggtggttcgcgcctgtaatctcagcacattgggagttcgaggtcactggatcacctgaggtcaggagtttgagattagcctgaccaacgtggtgaaaccccatctctactaaaaatacaaaaattaggtgcaggtgcctgtaatcccagctaactgggaggctgaggcaggagaattgcttgaacctgggaggcggagggtgcagtgagctgagatcgcaccactgcacaccagcctgggcaacagagcaagactccatctcaaaaaaaaaaaggatcactttctatatttcatgtaacatttctccctccctccctcacttcctcccctcctttccttctttcctttcctttctttcctttcttttcgacagggtctcactctgttgctcaggctggagtgcagtggtacgaacataggtcactgcagccttaaacctctgggctcaagtgatcgtcccatctcagcctcccaagcagctagggctacaggtatacaccaccacgcctggctagtttttaaattttttttttttttttccaagacagagtctcactctgtcacccaggctggagtgcagtggtgtgatctcagctcatggcagcctcaacctcctgagctcaggtgatcctcccacttcagtatcccgagtagataggactataggtaagcaccaccatgcttggctaatttttaaaaattttttttgtagagacgaggttttaccagttgtccaggctggtctcgaactcctgagctcaagcaacctgcccaccttggcctcccaaagcgctggcattacaggcatgagccaccctgcctagccttagttttaacattttttgtagagtctcactatcttacccaggctggtcttgaactcctaacctcatgtgatcttcctgccttaacctctcaaagagcaaggatgatagacatgaactacttctctcagcctatataacattcttgaaatggcagaattatagagctagagtatatgtaagtgattgcccggggtgggggtggtgtaggggtcagggatgactataaaggggcaacaggagggaagggtttggggtggtggaaatgtcctatatctcaattgtggtggttgcaggaaattccgtaaggtggcagagaacctcgcacgtgcatgtttcatccatgtctatttcctggaaccacacatatgcacattgcatccacgtctgtttcctggaaccacgcacacgcatgttgcatccacgtctgtttcctggaaccacacacgtgcacattgcatccatgtctatttcgtggaaccacgcacgtgcacgttgcatccacatctgtttcgtggaaccacacacgtgcaccttgcatccacgtctgtttcatggaaccacgcacgtgcacgttgcatccacgtgtgtttcgtggaaccacacacatgcacgttgcatccacatgtgtttcatggaaccacgtacgtgcacgttgcatccacatctgtttcacggaatcacgcacatgcacgtcgcatccacgtctgtttcgtggaactacacacatgcatgttgcatccatttctgtttcctgtctttgctggtgtactctgtttatggaggatgtagccactggggcagctgggtgagggggacatgggacctctctgttctttctttgaaacttcttgtgaatctgtaattaaaaaaaaaaacccacaattataattaaaggattcttcagttaataaaagcattcccggtagaaaatcttatttatttatttattttgagacaggttcttgcactgttgctcaggctggaggtcagtggtgtgatcatggctcacgtgatcctttgcctcagcctcccaagtagctgggactacagacgtgtgccactatgcctggctaatttttacgtttttggtagagatggaggtctcactctgttgtcagggctggtcttgaactcctgggctcaagcagtcctcccacctcagcctcctaaagtgctgagatcacaggcatgagcccctgcaccgggcctaatagagaatctttacgcagcacatgttgttagtgtatatgttcggctgactcttgcagcctttcttctgtgtgaggttaagttgacctgtatcttgcttgtgttccctgcgtctgttttccctgggtgtagattaataacctgcattgaaacaggtgggatttttcattcagtgtctggcttgcaacttttctttttgcggtggtctgtgtacaatttaccctttttctcttcccaggggaaggcaaagaggaaattgtgaaggtgacttttgaagagctgaggcaagaagtggctttgtttgcagcagcaatgaggaaaatgggtgtgaagaaaggagatcgggttgttggtaagtattttgggtgctggtgatggtttgagggaggagaccaaggtagaatgggtgatgtgaaggtcaagacggctttcaaataagggggagtcatgtcatattacatggaaccttgtgggacttggactctacatgcaaggagaaaaaatagaccaaggaaaattgctgaaagaatatgctgctctgcgaaggcaggaatttgctttgctttgttccctgctttgtcccagagcctaaaacaattccaggaacatcaagggagtgcattcagtatggcttgctggagggatgaaggcgcattcaatatgggcttgctggagggatgaaggcgcattcagtatgggcttgctggagggatgaaggcccattcaatatgggcttgctggagggatgaaggcacattcaatacgggcttgctggagggaggaaggcgcatttaggagttagccctgcagtgaggcagggcaggaaagggcagtctgggcagcagaaacggcctgtgaaaggcctggaggctgctgaaggcagcaagcaggaggccacaggcctggaggcagcaagcaggaggcgtctacacgggcattaggagctctgtggggtggaacatggagggcaggaggtggggcaggtgcccaggtctgatcccaaaggcctcgtccactttcttccactctgcctagagtttcctgaggtgctggtccgttctgacgcccttcccgccttgagccataaagcaagggaagtaggacctaagagcaggccccatttggggattgttctggaaggagcaggggctggaatgtgtagaccttgaggcgtggtttgtcttcccactctgggccggggctctcctttgttccctgggatagcaactgaggatttcccacgaagaactgcttaggtatttttcttacaattttcctttcaccttgacttgtggaaaaaatgtaaaggcctgtgcatggacctgttctttaccccaaacatacttgttagttaattgagatgcaggtaggtgtgtacatggggatgagcaggtgcagacgaaggagatttatcttccagtgcagccctggtggttggggctcccgacctccctccctttcccctccatgtcatcggacaaggaccacagggggcgggtggcaggaaaagccactggggaggggcttgggctttggagccttggtgtttggcacgggtgtgcctctcccgagggaacttactgcaaattgccgttcagcttgtttgcaaagaggcaggaggagctgggcggccttgtcatctataagtgcagtaagtggctggaccaagaatcctgtgcgccaggccccactaccctgccccgcctcccccttgagtaacaggactggacatggagttagtgctcagcgtttggtagctgactaggaaggaatctagcgatgggcatgccggctgcctcctgtctcagcccttggcggcctgttctccttcagcctatcctcagggttcaccctggcttgtcggggttgcctcctcagaggccgttcctggttagccttcgaaaaatgcatcccactcttcctgcagctgctttcatcatagtcctcatggctcacctgaacctgcagggatcttggtgtgtttgtgtgcgtgtgttctccatactagaaggcaggggctttgttttctcctcactgctgtatcttcatagagagtgcctggcacctagcagcatctaagaagtgtttattgaatgaatgactatgggtgttgggctgatcatcagagcagactttttttttttttttttttctttttgagacagggtctcactctgttgcccaggctggactgcagtggcgtgatcatggctcaactgcagcctcgaactcctgggctcaagggatcctcctacctcagcctcctgagtagctgggactacaggcacgtgccaccatgcctggctaatttttgtatttttggtaaagacagggtcttgctatgttgtccaggctggtctcaaacttctgggctcaagagatcctcctgccgtggcctcctaaagtgttgggattacaggcatgagccactgcgtctagtcacaaagcaggcatttttgaggctgaaacctcactttttgggttcttggtcgtctgatttaatctgtacacttttaaggtcttgcaaaggaatgcaaaatgttctgtccccagtttttttcttccctcccaattctcatttaaaaaaatcttttgaagcaaacgtttctgagtgaaggagagacaaaacaggttatattggggacagccaaggtccctgtgagctatgctttctttgaggagacgcctggccgcgatgccctggacccttcagaggtgagctggttccttgtgccccagccattttgtgggtctcagttggatacggatttgacctgatcatagttactaggatttgggactttgagttttccagaaaacactagaaaatgattaaaatggggttggatgctttagagtcttcaaaagatggagttaaagctgcgcctagctccgttttcctttgtctgtgaagtggttcccagggttggcgtctgatgtaccatgggagaagggccagctcctcctcacttgtcagccacatggagtcagatggttaagcagcctcccctgggcaccgagtcctgccctgaccctgggggtgacagtgttgagatgcttcagtttacgctcatagccaagtctcatcttcgctgcaaactcagccaacaccaaccatctgccggatgtgggtggaaccccatggtggtgtgacccctgccccttggatgcttatggcccagcaggggagtcgcgtgtgaatccagacaaacagaaacacccactgcaggggggagaaggagggaaaaagggagccagctgactagggacccctgggggcacacctgggtagctgcacctcgctctgatgaggccttgttcatggcccttcgtctcgtgactgccttctgccctactgtacaggtcctttcctctggaatgtgtagagtgatctggttaattgatcatagtctctgtggccatgaggattccctgcctctgttgtcatgaaagccagcctgctaggagatggagggcctgaggacctctgccccttataggcttgaatatggctcttgacagtactgcttgtgttcttcattccctctcctctctatccatccaaccaaccatccaccagtccacctgtctgtgcagccatccatcaacccatccatctgtccatccatctatccatccttctctccacctacccatccatccgtcatccatctatccatcccttcatctatcctccacccatcatctacccatccatccatccatcttccatttatcatccctcaccatcatttatccatccatccatccatcctgtctatacattcttctctccatctacccatttacccattatccatctatccatccatttatctatcctccacccatcatctacccattcatccatgcatcctccattcatcatccctcatagatcatccatccaactatccatccatccatctgtctatacattcttctctccacctacccatccatccctcatccatctatccatccactcatctatcctccacccattatctacccattgatccatccatcttccatttatcatccatcaccatcatccatccatctatccatccatcctgtctatacattcttctctccatctacccatttacccattatccatctatccatccatttattatgcttccacccatcatctacccattcatccatccatcttccatttatcatccctcatccatcatttatcctaccatccatccatccaactgtctatacattcttctctccacctacccatttatccgtcatccatctattcatccattcatttatcctccacccatcatctacccattcatccatcttccattcatcatcctcatccaccatccatccaactatccatccaactgtctatacattcttctctctacctacccattcacccatcttccatctctccatccactcatctatccttcactcattatccattcatccatccatcttccattcatcatccctcatacatcatccatccgtctatacattcttctctctgcctacccattcacccatcatccatctctccatccatttatctatcctccatctgtcatccgtccattcattcatccatccatcctccattcatcattcctcatccatcatccatccatccatccatctgccagccggcaaatatatgaggacccttgatgtgcagggcatggtaaaaggcatttggtaaagcaaagaacaagacaggcaaagtcccagccctcatgtgagaaccagatactagacggccagttacacaggtgattattcatttgcagttatgctaagtttggtgaaggagaaatacagtgtgctttgcaggtaactagttgggggacctgagttcaccgggttgggggcaagacagccttggagaaggctgctctgaggaagtttcatttgagtgaagagctgcaggatgagcgcacactgagtggagactgctggtgtgcgtggaggagtgttcagcagatcagacagctgtgcaaaggcaggaggtgattaggacaactgaggagtcggaagaaggctgctgtgaccagatcccagggagggatggggagcagagggaggagagcccacggggtcattgtcatcagagcatggagaatggattgcagggggatggtggggagttgacaggctggcagcaggcgattcatctgggcgggggctggtggtcaggatcctcaggcagttcaaggccagcccccttcccactctgaccttggctctcagagaaaccttttggacatctgctacctcccatacaccctgaacccaaggcttcttcctatgttttctccacaggttatttacccaacagtgagcacgctgtcgaggcgatgctggctgcggcaagcattggtgccatctggagctccacgtccccggacttcggtgtgaatgtgagtcagggtctgtgacagagggggcaccccttgccctgtgagcatcctgggcaggggctgcatgggctgaattcccaggggagccggacagcagcgtgagcccagcgggaggaggtggcgttgcagctgcctctatggggaaagaagccagaaggacttgcgtctggttcttcctttcaagcagtcctgacgttcccccactcctcgccgtgttcatcgaagacgtgggcaggtggcgtatgcagcacccagtgttgttaaggtctagtaaggtcgagccctgtcttcctcacctgggatttagtgaccacgtgaggtttgctaagtgtatgtcctctgaagagagttctctagatttttgttctcaaagtcctgcctgcagaagttccccaggacctccctgtgttggtttctgctgttaccagccccttcctctggacccgtactgtgtgggtgtgcactccgggagggtggcctctctgtccccaaaccaccccagggtgtgtccagctgcccagagtggcccaggcagggccggaagcatgtgctgatccccactggggccccccagcctataggtctttccacggggcaaatgaagcagccgcagagcgggtcttcctggggcccccactccccagccagggccctctcctggctgcagagccttgagcgtcagggaccttcaggagccatgagaacctgttacaggacatgcagcatccgtgtccctgaccgctcctcctggtgccagctgcctctgttctgggccaggccctgtgccgtccgtcagtcagcagcaccagctgcaggtgtggccgctggccctttaaaacccagtgcccggagttggtgtctgtgcttgtccacaggtgaggcttttgggtgtgagcttagaaatcatgtctacttagaggcttgctttttcagtaaggttttggaggaggagtgtcctttctccacaccgtgggaggagagatcagacacaggcccagaggagtgagactggccagccgtgcatcaggccgcagcaccagctgggctgatgatggagccctgctgggttcagggagggcgtggccaccttgtagatctgtactgtgtggctggatggccgtgccctgccttctggaactttcctgtgttctttcccaggccatctcaccccaggacctccccaggtcagcagggactgacctagacagaaactcaacctgtggcctctcctgtccctagggccctctgtgggggctgcctgggctgctggggccaatggtgtccttgtgggagggtctggaggggtggagttccggactggacactcagacccctcagccgaccttgagccaggctgtccagggcagagggaagggccccagggtgagacggcaggatggcagggtgtgctcaaggccgggcaggctggctgcctctgctccatgtggcttccttgatcagtgtccatgggcaagtgccctggtgtccccagagggagaatggcagcagtgttagtgcaactgcacagatggcaggagccacgtttgtgtggagccggggacagggtgtgaccctccaggccagcccagtaagtgttagctactgtttgaactagtcgggagatgggtgtgttttgagttaaattatgactaaccttttgtaaacgggttgtgagaggctgggagagccgtgtgtggcaggggagtgatcatggcctcccagagctggagtgtagcctcctccccctggagaggtgatatcagagcaactggaatcggcctttggtggtttgtctgaggccagggggtggagagagggagagcctctgactctgcatggctgcagtggcagggctggaccccagcctgtctcacagctgcatccagcctcgctgggtcattgtcctgtgcacgtcactccccgctgactccagtccggcaggatctgcccatcctggaaggactcaggagggatgcatggctctgtagcaaacatggtctcggggacactgcttcctggccggggttggtccagggttttctggaatcaccgcctccccgagccacctctggagtgggaagtgctggccgagctgctgggcgcactagatggcagcatggctctgctcaccccatggctcccgcagcttctgggaagtgaacagtcccaggccctgcggctacgtctcaggtcagaaaacagggccacctgccctcctgctgagatgcttctctctgtcgctcattttgctagtgtccgaggtatagactccatcctgccggagacgggggtgtgtgtgacgcacgttactcgcactcgaactgagatccagccggttggcagggagtctgtcggcatttggtggcttcgtggcaggcattattgggcagcactcctggccgtgtgcacccagcgtgggagggcctgcgtggatgccatgttcatagcgcttggtcccacagacacctggacacccgctgtcggagctgagtaaggacctggcacaggtcgactgcgcgaaagcctctgctcaccctctatttaccatccttgttcaggggctaaaactaacagggatgaattcctggagttgctgatgaggtggggctggaactgagccaaggctgatgggttctgggctcgtggacagttcctgcatcggtttgcagatctctacttaaaaaagagatcctgtttttaatttccatcatcaccatgttaaacttcagactgtgccccattttcagtaaggggcgctcttcagaaactgcaatgaagcgtgaatgtcttccctttggaatcatgttttctcttgctttgaaattatatttctttgaatctcagagaatatcgtaaagggaaattgccactctcctacaaatcctgtgttgacttctggtctctgttgatggagtcgcaccgttggactcgtgggttcacacgcctgtccactgagagctcctcggctggctgtgctgggtgctgaagggaccctctctgctgcagagccacagaccgcagtgggctgtccagggagtgctggggcatccgtctttactcgatgacactgggggaacgcgtttctggcctccgtcactcccctgtgctttacttctacccattccatgctctctcccaccactgcccacctccttctgcctgctctctgctggctgcctgggcatctcagcttgccttactaatgcttttgggctcgaagggcatcgccaggttggggaagtgctctgttctaagggttcccaacctttccagccccagcaagatctctaggtcctgagtcttttgatggctttgggttttttgtttcactgtttacctttgagcctttgccattttcagagatgtcagggaaggccaccctctgatccctgcacaccagagagcccagcctgtagcctgcaggccttgtcctcctgaagtgccatcaggtggccgtgtgtgtgtgtgtgtgtgtgtgtgtgtgtgtgtgtgtgtgtgtgtctgtgtgtgtaaataggacagccattctcgctcgctctgggtggctgtcaccatgattcaacaccggctgttggtttcaatgcttgattggttgctaagcaccgtattcaggtcagacacatgttcataggtgtgtttgttttgttgcaacatgaaagctgtcctcgagcagctctcctgggccaggacaggctgacagctggttttggatgctcgagatcttgatccctgctggtccagccaggaaaacttcagctgtgtcagaggacccctgagtcttttcatggggctaggggccagacctctgattcagaaacactcgtctttgtagcctgatcactgtcactgtgcctggggtcctgtggtatttgagccccagatcactggcaggctcagtcctttcaccttgagatcctggtcaccctgtactgggctggttctctgagatcccagtttccttgtggaaattctctgccgccctccggggctctcccaggctggctctctctgtttcttccctggcctcaggcttcctggcaggtcttcctctgggccccactccacctgcccctgggtgttgatctctatgtcctctgttcagaacagcctcttctccctcccgcctaccctgtgggacctgcttattcttgacgctgggctttggagatgctgactccagcggctttctgggtttcctcctcttcctcctgattcagtctgctgcagtatcttagcacccgaatctgttctgctgttttgattttctgttccatgtacggtattagtgttttctgagtggagccagcacagtggtgaggagcaccagcacccacatcagacaagccaggctgcagcccagccatgcctctggccagttgtgaggctttgggcaagtcactcaccccgttcctgccttatcagggttagggagtggatactattgcccctctttttttctgagacggagtctcactctgtctcccaagctggagtgcagtggcgcgatctcggctcactgcaagctccacctcctgggttcacaccattctcctgccttagcctcccaagtagctgggactacaggcgcctgccaccatatccagctaattttttgtatttttagtagagacggggtttcaccatgttagccaggctggtctcgatctcctgacctcgtgatgcaaagtgctgggattacaggcatgagccactgtgcccagccttattgcccctctcttaaggctgtgaagggcagtaagtgcttctaatgagctcagactggggcctggcacatagtaagcattcagtaaatgctcaatatgttttaactggcaatcatttcttccccactaaaccaagaactctcggtccatcttagaatcccgggcacagagagggcaccagtgtagacatgccatttgtggtttgtgtgttcgccacagccaaggtctggacaggccccttacctgtgggtgagggagcttgggtgtcaggagtgttgggactcactttgcataaggggtggctggggctggagggagccaggtgcagggataccttgtccagggccatgtggccaggaaagggaggagtaaggaccatggccttagagtaggttgaatgtgttaccttgatatttgcatagagagcgtcagaagtaaacagagggacacccaagtcccagcaggacatgaaagagtctgagaaatcgctgtgcatgcacttagttaagtggacgtggtgtctttccaggaagggcaggcacttgctctcggggggtgcatctgggcactgagaatggggaagaggggcttgcctggctgggggtgagcttctgtttagatgccttgttccagtgccagtgcccaggcgctggtctagggggtgaagacttctctcctggatgcttctgtcccagtctcctgcccatcagaagtggctggggaggaggaaggggtggcattctcagtccaggagggtttggtgccaggaagggccatttctgggcattctgttcttctgatggatttgggcagggtgtatgttagcatcagacgcaaggagggctagccctggtggcctgcggagtaaatgctggtgggaccggggtgccacctgcctgcagactcggcctgttgctgctggactcctggggggcaccattttggggctttctgcaaccacctctgtgtagcagtttagagcagaagaagaagtagtaggaaatagtctttgtccaccaaggacgtcactgaggaaggggtaccgggggtacccttgaaatggaggagggaggaggtggacggtgaccgaaggcctgatgtcctgaggccaggggccaagtccctgttacctgtatgtcccatgcacttttttaaactgatgctgaagttggccaatgttttacttaaaaaaaaaaaaaaaaagtgcgttggggcagctccaagggcgtctctgtaataatgtcacagtcattcccttgtcccccacccgcccgccgtgaactttgctgaggggcagaggaagtggcgggagtagagagaagcttggcttggtctgcgcctcctcccgtgccttccgcagtggccaaggtgttcagctggaggaagacccctccttcctgtcatgactgtgcatcctgagagcacttcagccttccttccccctgtccagtcagcactggcggggctgccagaagttctcaagactcagtgagccccagaggagctcacaagtccccagggggagccccatctcagtaacccccgccactacaaccctgccaaaccaggagctcgggctgtgcgccacaccctttcactcccttccctaccgttggctgttcttgccgcctctccactgtcctccttcatacgtttgattgagcggttcctcggttcctctgtgaccccggctaggcactgccatctctcacgcgtgccgtcgtagtagcttccgaccagtctcatttctgcttctctctactgtacacctttttatctttttcttttctttcttttttaactttcatcacctttctactatccagtacacaccctttaacaagtggatccgaaccagtgtttgtttctgtctctctcccagattaaatattctttagagggctgggctgggtagcttacacctgtaatcccagcactttgggaggcagaggcggatggatcacttgaatcccggagtttgagagcagcctgggcaacatggcaaaactccatctctacaaaaaagaaataacttagctgggtgtggtggcacacagcctgatcctgagcccgggaggttgagtctgagtgagctgtgatctgtctactgtactctagcctgggtgacagggcagaaccctgtctaaaaaaaaaaaaatccttcagtgactttctcattttcttttgttctgtttttctcattaccttttttttttttttctgagacagagtctcagtctgtcacccaggctggagtgcagtggcatgatctcagctcactgcaacctctgcctcccaggttcaagtcattctcctgcctcagccttccaagtagctgagactacaggcgtgcgccaccacgcctggccaatttttgtatttttagtagagatggggtttcaccatgttggccaggctggtcttgaactcctgatcctcaagtgatccacccgccttggcctcccggtgttgggtgtacaggcgtgagccaccgctcctggccctcattaccttttcaaactgtattgctggggtttaacaccactatttattttgctggattgagttatatgtggccaccttgcctaactgatttgttctagtggtttttctggtgactttcacagattttgtgtgcagctgttcccattgtgtgtagggggcaaactgtttctagttcccaccccgggacgtaggtgggggtgttcggcacaggtgcaggtgggctgggggtgggcgtcttgcatgtccttttctcactggacatcttatcttttaccaagtgcgaaatgtgccgtcaggtgtctgccagataccttttgtcagtgaggaagtatccttcagtttccagctgattaaagcatgggtttggaaagcatgttgccttttatcagaagcttccaagataatcatgcgatttccccctctgttagcctgttgctgtagtcgataacattggtctgtaatctctctctcttttggtttgtgtgtttcctgtctttctccgacttctgtaatggtttacgcagaagggatgctgtagcttacagagacttggtggtgctcgcctgcagagctgcccaccctggtgtccctggaggaggtagacctttgtcacttcagctgtggtgctgctttttgaataaattttggtaatttttattttcttgagaagtcatccattctatctggatttcaaaatctattaaacattgttttctggctcatgaatcttttattctgtagtcaagtgtgatttctaattttgagaggccacatgcttcagcttagtcacctgcaatatgagggtgataaggccacccatgtccaaggtcattctgagcagtaaatgagcgaatatcggtccagtgcttagggcagcacctgacacagagtaagtgttctacaagggataactggaaatgttaggtttccttttttgtttgtttgtttgtttgagatggagtctcgctctatcaccgaggccgcatgatctcagctcactgcaacctctgcctcccgggctcaagcgattctcctgcctcagcctcccaagtagcagggattataagcatgggccaccgtgtctggctaatttttctatttttagtagagatggggtttctcaattttggttaggctggtctcaaactcctgacctcaagtgatctgccggcctcagcctcccaaagtgctgggattacaggcgtgagccactgtgcccggccgaaatgcattttttcttcttgaccagatttttcaagaagcttacttttattttattttaagacagggtctttctctgttgcccaggctggagtacagtgctgcgaacacagttcactgcagcctcgagctcctgggctcaagcaatcctccccactcagcctcccacgtagctgggattacaggtgccctgctaatttaataaaataattcttttgtagctgtccaagctcgtctcccaaagtgttgggattacaggcgcgagccaccatgcctgctaagaagcttatgttattggttgttttggaaaaatgatttttggttttgctggtcaagtccatcattagtttttccttatggctttaattccttctctctttttctttccctggctacctaattttgagtgtagtttactgaaaacattggaaatggaaaacaataacatttgcaattgttttcctgttgtgtttctgatagatcgtatgttctggggagtgggaaccctgtctgtctggttccctggcacggtgcctggcacctagcacatggaataaacaaatgctttctactccctactcttctctgttaattcaccttctagttggggaaattggacagtgttgagtaaactctgaatcctagaactcttagcacagaaattctcaaattttatcacacctcaggatcatctggatggctggtgagaacagattgctgggtctcctgcagagtgtccgattcattaggtctggggccccaggtgaggctgactggctgcctgggggaccacactttgagctgcccagcctccctcccacaacactctgccccttagactcccccagagtcagcgtttctgcttccctgctaagagtcaccagggagctctgaaaacaaatgcccgccgctcctgacccgttaattagttatcctaatgagcttaattaacttaatagtcccactgcaggcggtgctaccaggcagccagggtggagagcctgtgctgtgaagtccttactcacaggttctggggccactgtatgtgccctgggggtagccctaggtgttggtcttgaactgcttgcatcaggctcatgtgcgagggaatagcagccatctgggcgatggctacccatgtttgcagatggcagtctcttaacacagtgtaaccttgaggatggccaggagggaagtgaatagaagccttgtctgagagtgctttaatctgttactaacattaataatctgttaataattaataatctggactaacactcagggagtgtcagtgaatgttatgagttccaagaacaagcccatgcctgcatggaaggaatcccctgtttcaggaaagcagtgcccttggctggactgcagactccacgtgcagtacagaccagagacatgggtgtggtgatcctgccttttaagatggggctcattaactagtgtatgcacgtgtaggcttatgccattggttggcataaatgcactgcttggaggattcaggttcctctttaattgaagattccgagaaccaaaatatggggccactttgctttgctgttgtggcctctttggaagatgaatcttcttttgtatacactagcagagctgtgctaacaggctctttctgtaaggtggggaatctttttggtagtgtaaacacacactctatactcttcatatttcagtatatgtctgtaaatacttctggtatttcttgatattgatgccttccttggcatagtggttgttctcagatataagttgtgctttgatcaacttttttttttttttttttttttgagatggagtctcactctgtcgcccagggtggagtgcagtggcactatcttggttcactgcaacctctgcctcctgggttcaagcgattctcctgcattagcctcccgagtagctgggactacaggcacgtgccaccatgcctgggtaatttttgtatttttagtagagatgggatttcaccatgttggtcaggctggtcttgaactcctgacctcatgatccgcccacctcagcctcccaaagtgctgggattacaggtgtaagccaccatgcttgcctttttaaaaaaaaaaacaaaaaaaaaaccagaatcttgctcggttgcccaggctggagtgcaatggcacgatctcggctcactgcagagcgattctcctgcgtcagcctctgaagtagctggggccacaggcatgtgccaccatgcctggctaatttttgtatttttagtagagatggggtttcaccatattggccagctggtcttgaactcctgacctcaagtgattcacctgcctcggcctctcaaagtgcttggattacaggtgtgagccagcgcgcccggcctcatcgactttctttattggctacgggtgctggggacacagggacctggtcatgcactgatgatgatgccctttctctcccgtgaaatgcagtggtcctattggctactgaaggtttttgccatttttttttttagagacagggtctcactcgtgcccaggctggaatgcagtggtgcaagcatagctcactccaaccttgaactcctgggctcaagcaatcctcccacctcagcctccagagtagctgggactacaggcacccaccaccatgcctgctggtttttgccttttggatgatcaatgatgactttttcctcctgctttcagggtgtgctggaccggttttctcaaattcagccaaagctcatcttctctgtggaggctgttgtctataatggcaaagagcacaaccacatggaaaagctgcagcaggtggttaaaggtgtgtggcccttccggctcccagccggcatggctgggtgtgtgtgtgggtacataagagtctgccaggagtcaatctgggtagtctctgccccagattgtgttatattctctgccccagattgtgttatattttgtggaaaaaaaaaaaagcagccaagcatctttgtcctgtaaccttgtgttttctcctctcgctccttccaggcctaccagacttgaagaaagtggtggtgattccttatgtgtcctccagagagaacatagacctttcaaagattccaaacaggtaatgtaccgcattctgacccacaggtccgtgtggacccactggagctcctgcggggaagtaggcctctggatcttctacttggggtcactcagagaattttagaagtggaggaggttttagttaaaagcatcattttgtagataagacacctgaggccccagagtgaatcccccaaggccacatagtgaatgagtggcggaagagagacagtcccaggcaccctcactcttccaatctggtgtcccttatgtagggggctctgatggggccaagcccaccttcctagattggccacagaaattttgcattggaaatcatgtttacatgtatgtgcacatggtgcatgcactgcacacgcatgcacacgacaaggcacacatatctacacgtgtacacatgcatgtgcatttacacacgtgcatacgtgcacaggtgcacatgcatgtgtacatgtgtatgtatggctatgcatacataaacactcgtatatgtatttttcaccttttaggacatgcgtgtgttccccattgctgatgacatcttccttggcttttctgacatttgtagaagaataagccacatgttttgtgtacccaataggattgtaagaatcttcatttttggccaggcatggtggctcacgcctgtaatcccagcactttgggaggccgaggcaggcggatcacgaggtcaggagatcgagaccatcctggctaacacggtgaaaccctgtctctactagaaatacaaaaaattagccaggtgtggtggcgggcacctgtagtcccagctactcgggaggctgaggcaggagaatggcgtgaatccgggaggaggagcttgcagtgagccaagatagcgccactgcactccagcctgggcaaaaaagcgaaactccgtctcaaaaaaaaaaaaaaaaaaaaaaaaaaaaaaaagaatcttcattttgaatagagattaaggaaatggattatggattatggtttagtcaaagctgaattcttcccaaagttcttggagttataccttcctttaatttttcttgaaacagttgtggggagagggttctgagctcaggcgtttacccccacggggtaagctttcccttgagccttgggtcggggccactggagggcaccttgtacgtggctccttgaggcctggtgaggaggggctatgtaaacatggcagggtgtcttcataccagccacggggaccagaggtggaagagaggaggagatggcggagccctttttgttccagcaagtggtagtcggtgcatggcttgttaccgtctgtcagggtgttctcaggggcaccacaaggtacaaatcatgtgtcctgtcctccgggagttgcaatctagttggagaggtgagacccacctgcagggaggttgagctgtgaccactaggagtgggagggacaggatgtgcccaggggttgacagcagggcctgggtgcttccctgtaggatctggggaggtggcatctgggggtggctttgaggtatgagcagggtctggggacagctgtgtgtgcagggcatattctggagcctggagggtgctgcaggcaaagtggtggcttggcgagggccatggtctccagatccgacttgtcaggttcagctctcagctgtgtgaccctgtgccagtaacctctctgagccttgtgtctccatctgtaaaatggagatgaggtggtacctgtattaggtcgttcttgccttgctataaagaaatacctgagactgggtaatttataagaaaagaggtttaattggcttatggttctgcaggctgtgcgagaggcatggtgccagcatctgcttctggggaggctgtatggagcttgtgatcatggcggaagggaagtggagcgggcactttacatgggaaagcaggagtggagggggtcggggggcggggtgccacacacttttcaatgaccagctcttgtgtgaactcagagtgagaacccactcatcaccaaggagatggtccctgccattcacgaggaatccacccttgtgatgcaaacacctcccaccaggccccacctgcagattggaggttacatttcaacacgagatgagggtggggacaaacatccacactcttatcagcaccttcctctcaggctggctgggaggattaaataagctgctgctctgcaaagcgtgcacagtcagctctcagtgatcctgcctgtcattgtgcggccgcggtgggctctgtcgcctgaagcacctgagtcagggtgggcagattcttcacaggcaggcccgggtgcctgtcccatggactgtgggaccctgccgaccttaataaattataaccaggtgccagagcgctggctttctttcatgcaacctcggattttgtgccccaggtgtatggatggaggccatgatgcatggaggctaggaggaaaaccagacagggtttaccagccccctggttggcctggctattttttctgaataatattcatcagcagttgatataaaatgagggcatccagcagaatcatgttagccacttcatttagcccgacaccccaggggctggactcccactgcagtccatcctttgattgtggatgccacagataaagcagaaacgggtacgtgcccatctgtggagaattgacggggccgggggagccaccctgtgggcttttcattcttagaagagctttaacaaaggtaatcattatgtactgtgatttatgggccatttgacagaaaaggcttttctctgtgtgaagtatctgattagatctggcactttataatgggattcttataggaggtagaggtgggatggggttttcattggctgtaaagttccacagtgaatagttttcctgacatgctggagcagacggctttgtttgtttcttgcttagagttgaattattttggatgccctttttaaaccaccatgtcttccccaggagaaacctttatatttaaggatgccttctcatgcaagacagcaaaattcttcattttagtctgtatggcatttgtatttcagagtaattatccctagcaaatggctgcaggctgcgtttaactgattcccacctccttccctgagagaaagtccatttgtcagttgagtatagggccaatgttttgagatggatgttgctgctgaattcaaaatagaaaaccaccttttcccaagatggcttgtggcttctgcggctgtttctagtgcagaaaacaaatctcctgtttgtgtcgcccctttggtggttcttggccacctacaacaatgctgcctgtcagctttgggggtaagcctaggcacacttcctgggtgacagtcaatagctgggattaattttatttgttcttgcacagatatttgtatcttgctattgtaaacctcaggatctagtaagttagtgacaacacatgatatttgctgagcggttctctgtcattgagctgtagtttaggaaattgaccccacatctgtaggaagggctcattaatctagcatctcctcctctcccttctccccacgggggaagcatcttacttcagacccacttggtgagtgcttccttttgggcaatcattggaaacaaagcgtttgctaatcaggtgatcaatagcaaacaaaggacatgggctcagaagacttcaaggccatttccaaagcctccttcagccgtgttggtacacacatggcttgttcattgtaagtgatccttctccgtggtggttatgaaaacacttaaaatattctctaaaagacagcccttggccctgtcagcagtgctgattaagcaacttgaaaccttcactcgttcgatgagttttccttcaattagcttgaatctctgagatctaactgcctcccctggtcccaggaagtttccaaatctggccaccgtccccctggaatcctggcttttctgggggtagaaacagagggaagtgcacgggtggaatcagtgggtccggtccagcattctgggacgttcatggcgtgtttccctgcgtttcggcccacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctggggtaggtctctggggaaggctctgcagggcctcctgttgtctgtttgcttcaacagggcctcccagctgatgatggcagtgttggagttgtcaaactgcaccccatccccggagagtccaacgtgcagcttctctccaagtggggtgctgcacggagatccggcactgggcccagggcagtggagtgctgccacttcaaaggctgggatggcacctaacaccatggcgataggcttggaggtcactgtacagcgcggtgtgccttgggggtggggggtgcgctggctgaaccagctactttcaccctgcaggtctggaccacctgggggattgtgaactcaataggtgggccctgccagtattttaaaaagaacgaatcagaatagacaagaatagataatattagcgcagtgccagacgcaatggcccacacctataaccccagcactttgggaacctgaggtgggcagattgctttgagcccaggagtttgagaccagcctggccaatatagcaaaaccccatttttactaaaaaatacaaaaattaactggacgtggtggcacatgcctgtagtctgagctactcgggaggctgaagtgggacaattgcctgaacccagggggcggaggttgcagtgagctgagatcatgccactgcactccacctggcaacagagccagactctgtctcaaaaaataaaaataaaataaaatattagcacagaataggctcataagaggtatgggtggtgttctgtgaagctgtcattacatggagcggaatgtgtgcacgtgctgggggcgttgtaaaacttatgtctgaccgtgggttgtggtaaaatatttgaaagccactggttaggttattagaaggctaggttactaggttattaggttattattagagtctaattaactgagaaagagcctgcccgtgctgcgagtctgttagggctgccataacgaaacaccacaggctgtgtggaacaccaaggtgccgcacagttgctcttgtctgaggcctctctccttggcttgtggacggccgccttcttgctctgtcctcgtgtgatctttcacgtgacaccgctggtgtctctgtatgggtccaagcttcttctcctgaggaccccagtcagatcggatctgggcctgctctgacagcctcatttaaactctgtcaccttttaaaggcccatttagtcacattctgagatactaggtattgggcttcaacatacgaattttgggggtacacagttcagcccatgacacatgcttttaatttttcttatttcaccgaaagtctaactttattaaagcacctgaaataatatgttactactatgcaatagaatgtatatgtataggttagtgacttttaacctgttattttattttattttatttttttttgagatggagtcttgatctgtcgcccagactggagtgcagtggtgtaatcttggctcactgcaacctctgcctcctgggcttaagcagtcctcccctctcagtctcccatgtagctgggattataggcgtgtgccgctatgccctactcgtttttttgtttgttttgtatttttgtggctttttttttttttttttaagaccgggttttggcatgttacccaagctggactcaaacccctaggctcatatattccacctgccttggcctcccaaagtgctgggattacagatgtgagccacccatgctcaaccaaaccttttatttttgaaaaaaataaaatacctagagaacctctagaaaagctgcaagaatagtaagctccatggtacccttcagctgaattcttccattgttgacattctgtctttaacattttcaacgtccttttgttttgttttgttttgagatagtttctcactttgttgtccaggctggagtgcagtggcgtgatcatggctcactgcaacctctacctcctgggcccaagcgatcctcccacctcagtcttccaagtaccttggactacaggcacgtgctacttttttgtttttgtagagatggggtcttgctatgttccccaggctggtcatgaactcttgggctcaagtgatcctctcgccttggcctcctgagtgctggaattacaggcatgagccactgtgcctgatgtcaacatccatttttaacacgtcctaaaagcctctttcgccttctttctctctcagcgtatatacacatgttgttattttgctttttgttgaaccagttgagagtacgttggagccacaatgatctttcactctttaatatttcagcacgtatctcccaagaacaggagcgttctcttacagaagagtgtgtagcgcgctcatcaaattcaggaaggttggcgttggtgcagtgccgccccctcatctatggtccacagtcaggtcgccagttccccagtagcgtcctagcagctcaggcggtggcacgtcagtcgtcaggtctcctgcatgtctggagcagctccttgggcttcttcgtcttccgtgacactgacattttcaaagagcccaggctcctggtttggcagaatggctctgtttgggtatgtctggtgtctcctcgtggttaggtccaggtgatgcagctttggtgggaacacgctggaaatgatgtggtgttcttctccgtgcatctatcggggggatacaacgttagtgtatttcatttctgtgatttcactaggccactcttcagaaatgaaatgcctgggtcaatgtggtgctttgcttttttttttttgaggtggagtcccggcactgtcacctgggctggagtgcagtggctcaatgttggctcactgcaacctctgcctcccgggttcaagcgattcttgtgcctcagcctcctgagtagctgggattataggcgcccgcgaccacggccggctaagtttgtgtgtgtgtgtgtgtgtgtgtgtgtgtgtgtgtgtgtgtgtgtgtgtgtgtgtgtgtgtttagtagagacggggtttcactatgttggccaggctggtctccaactcctgacctcgtgatccaccttccttggcctcccaaagtgctgggattacaggcctgagccgtcacgcccagctgaatgtagtgcttttctaataactgctatcacatcttacttcctctgatcctcttctgcccctgggcttcctgactcggttgaatccttaccttgcactcagacttctcctgggccggtctgtgggagtcaggatgcttgcgacgccgtggctcccaccctcacgctgctctaggctctcctctgggccagctcttcagctctccccatagctcatttccccatttccctatcagttggctcagcctatagggaggagaaaaatccactgtatcttggtcaaaccttctgatcaccactttttcccccaaactcagaagaagagaattctccaagtggagaaacctttgcttgataagacagtggcatttgaaaaggaaatatacaagttcccttattctagctcacttagcttttatagacgttccctctacctagaagcagtttgaatcccttccataaaaaggaaatatttacattggaatcatttgaaagccctattaggctttttacagagtattttcatcagaatgtggaaaggagccaatgtggtttcatcatcacctagatctagattcactgaaggtcttgttgcaggctgtgaaatagattgaaggtccaagagcctgtccacgcacagcaggttaattctcaagaaacccaggggtgggagcgaggggctgaggtcaggggtggggggcaaaggccttatttctagcagttacactggctcaacggagttgcctctttgcaggcagcgagctgtcctgtcgctcaaatcgtctgattttatgaaagccagtcggggtgtgttcacagactaaggtgtagttggaatcgcgttttccctgtgaaagggcagccctgttgcacctgggtgcaggtctgtgagtgagccaccgagatgagcatttttagaaatcttgcagacaagggtcggggcgggggcgggtgtatgtggccaaacaagacattttaggaaaaatggaaatgtataactgtacttttatttttagtgctctttgcatagtgcatgtcatttttttaagaggagcataaaaatgtattagatataatatagcttgctcataaaatgatcatgcctggtatatttagagtgtggaaaaatcaggaaaaattatatgtactccatcttcactgggctcttgcatctctggagaagtgactaagcatcttgctcgttctctagagttatcttgactacaaacttgaaaacagtgaggcaacataggccagagtcctagggctgctcgtaatcttcccaattgagtagggtggggttctgttactggtttgttggtttgtgcttcctaagtctgtgaaaggtgtcagaaagtggctcccctttctcttcctttacatgaaattactctcctgcgctgagacccaggaaactgtttatgctgccttaccctcagggaaagcattcagacttgaccataaatatttaagaattaagggaaaaacgatggatgtaacttgttaagagtcacacagagaaattcttgagagaggaggagggcccatcatttgttttgtgccatctgagagaatgaggctaatgaaccactgaacgaaggtgggctcctatctctgctgtgctctcagcagaccacgtgagcgaagctgtagagttaagtgctgattttaagtgaaaaagaaagtgggagagggatttgccacaggctcctagaatccgagttccctgtcctttaagtggattcgtggaaagatttagttcatggagacagttcctgaaaagtttgtcacccccaaattattgcctacccactgtgcaggagaacagattgtcatgtaactttctaagaagcttttgagtgcctggggaagggaagggaaggggaggctgtctcttgaccctgactggggattcttgttaaactccaccctgcagctcagcttccagagcccggaggcagccttgggggactgcagaaaagggcagtgtattagtctgttttcatgctgctgataaagacatactgagggctgggtgtggtggctcatgcttgtaatcccagcattttgggaggccaaggtgggcagatcacaaggtaaagagatcgagaccagcctggccaacatggtgaaaccctgtctctcctgaaactaaaaaaaattagctgggcatggtggtgtgtgcctgtagtcccagctacttgggaggctgaggcaggagaatcacttgaacccaggaggtggaggttgcagtgagccgagatcacaccactgcgctccagcctggtgacagagcgagactctgtctcaaaaaaaaaaaaagacatactgagactgggcaatttataagagaaaggtttaatggacttaacagttctacgtggctggggaggcctcacaatcatggcagaaggcaaggaggagcaagtcacatcttacatggatggcagcaggcaaagagagagaatgagaaccaaatgaaatgggcttccccttatcaaaccatcagatcgcatgagacttatttgctaccatgagaatagtatgggagaaactgcccccgtgagtcaattatctcccaccttgtccctcccacaacatgtgggaattatgggaatacaattcaagatgagatttggatgcagacttggagccaaaccatatcaggcagcgtctgcctgtctgcctggcagtctctggaagcttcagttgctgctgtttgtgggctgggtggcggttgcctgtttgggatggactccggaataggagttttggctcctgaatgggagcctgtgttggataggattgttcctggtgagctcttaaagggatcatctcctgcaactggcttttggaagcttttcccttgggtataatgagggccttcatggctgggttttaatatataagtccttgcttcagccttctaggccctccacaaccaggagcacctttgtgatgagccagaggctcacatctgtggaccagactgaagggcagtggtcactgaaggggcagcatccccgtctgtcctcaggatcttgtacgagatccgttggaaagacaggaaaaccgaggctgggagcgtggagtgacgggtgcaggggccactggctctgctctctgggttgtgcctggcgatgggaagcttcctctcctccctgcccctgccagacacacagagttgcttggaacaagtgtgttctgggcagtggaagattatatagttgtaaacagacatgagggagctcccggcatgccaaggaagagctcccaggtgtgctgttaggtggaaaaggcaaagtgcgggacactgtgtcacaatgaacaaaatggcattaataaatatgtgccggcatcagcaagaaagacgttcacaggaaactgctaggaccggctgcctcttgggagaactgggtacaggacagggagagaggacggcttttcatagtatctgcttcagagttctggaccgtgcaaatacattgcctattaagcaccaaaattaaaaggtaatagggcatagtgggtgggagggagcggttctgcttgggtgttttagccagaagcagggtcttgtgctgtcccctcagctgaggcattcctgaaatccgatcttgaacgtgagtcccagctacagtcttgctctgttgccagtgccccacccccaccacatccccctcaccccgctgttccctgtccctcatgaggctgggctagcacccgtcctggaagggttaggccctggtcttttgctcgttgactctcttctcaggaagggtcacttctcttctgcctgaagctggtgggcctccgtggtgcccttgatgtcctgggcaccgagagcttgagggcagacaggagtgtcagggttttcctctccagactacaagccacgctcagctcttgggggagagggacatgggggcatggctcatcacaggggagtggggggaaccctccaaagtctgcttctcccaggaaagaaaatggggatctgctggggcttcttcctggcagcgtctgagcagcgcgtgggccaggtaccagattcctggtactgtatgcctaacagagagcacccgctcccccgtgtctcccctgcagggcaccctcatccagcatctgaaggagcacctgctgcacggcaacatgaccagcagtgacatcctcctgtgctacaccacggtaagggcttccccaggtgctggcctgtgctataccacaataggggcttccctgggtgccagcccatgacacatagtaaggacttccccaggcgccggcccgtggcacatggtaagggcttccccaggtgctggcctgtgctataccacaataggggcttccctgggtgccagcccatgacacatggtaagggcttccccaggcgccggcccgtggcacatgttaagggcttccccaggcgccggcccgtggcacatggtaagggcttccccgggcgccggcccgtggcacatggtaagggcttccccgggcgccggcccgtggcacatggtaagggcttccccgggcgctggcccgtgacacatggtaagggcttccccgggcgccggcctgtgctgcgccgtggtaggggcttctctggggcgctgcctgtgctgcactgtggtgagggcttccccagcgcacggtgtcgagttgggcccgctcctccgcccaccctgcctcagcagcgtggaatccacgccatgaaaccataactcaactcaaggtgttggaggccttcctgcccttgttgagcactgaaagacagaaggttaggacatgttaaaggaagtgtattttaccccagaggaggagaactcaaaacatcaagagcttccacagtgatctagctacaggtcctaggtgatgcttctgtgctgagttttttttttttttttttgcgatgaagtctagctgtgtcgcccaggctggagtgcagtgactggatcttggctcactgcaacctccacctcttgggttcaagcgattcttctgcctcagcctcctgagtagctgggactacaggcgtgcaccaccacgcccagctaattttttgtatttttagtagagatggggtttcaccatgttgagcaggctggtcttgaactcctgaccttgtggtccgcccgcctcagcctcccaaagtgctgggattacaggcgtgagccaccgcccctggcctgctgagtctttatgccaagtggaatgcagcaggcacatgcctgacctgtgaggtcaatgcccagggcccttctgtgccccttatgagagactccccacagatgcaggagggaggacaacccccccaccccagtgacctcacacaggtgcaggagagtatcagaccccccacccatgacctcacacaggtgcaggagactgtcagacccctgggactgcacacagatgtaggagtggggacagacccctgggactgcacacagatggaggacgggggacagacccctgggattacacagagatgcagaaagggtcagacccctgagacctcacacatacacccgtgcaggggacagacccctgggatctcacacaggctcaagagtggtgaccttgggtgtgtttttgatgtgtgactgtggagaggcccctccctgctctctgtgaccagctgtgaattaataaggggcttgagacaaatgattcaggtttttttttctgcagggatttgctctacaacccacccctgtccccaatccctaacgtagaataccagtgccagccccacccccaccatggacccttgtgtgctgggtcctttctgaaacatttcagggcgggaagcccgggcagcagcatcagtgcagtgtccttacggaggtgcaggaagctcccagcagctacgatgatgcaggattcggctgcctccctgggacacggcaatttaaaatgggagggtcttgtattgagaggaaggatacaatggaaagaactcaaaaatttggagcagttttctcagaggcatttcatttttactggaaggatcctgtccactaagaatcaggcagttagatttttcctggagcagcttgaccccacctgtgttcttttatttttattttattttattgttttattttttgagacggaggctcactctgtcacccaggctggagtgcagtggcgcgattttggctctctgcaagctccacctcccaggttcacgccattctcctgcctcagcctcccgagtagctgggactacaggcgcccgcccccacgcctggctaattttttttgtatttttagtagagatggggtttcaccgtgttggccaggatggtctcaatgtcctgacctcatgatccgcctgcctcggcctcccaaagtgctgggattacaggcatgagccaccgcgcccggcctcccgacctgggttctaacagcagccttggtggcagttgtttcatgtcctgcagccctgggcccaggctatactgtgacccaccctccctcccttccttccccttcctttccctcccttcccctccctacctctcccttcctttcccgttttccctttgccttttgtcctcctttttccctttgcctttcttgttttcttttgacagtctcactctgttgctcaggctagagtgcagtggtgatcatggctcactgcagcctccaactcttgggctcaagtaatccttccacctcagcctccaagtagctgagaccacaggtgcactccaccatgcctggctaattaaaataatttttttttggagtccaggcacggtggctcacgcctgtaatcccaacactttgggaggatgaggtaggtggatcacttgaggtcaggagtttgggaccagcctggccaacatggaaaaaccctgtctctactaaaaatacaaaaaagttagccgggtgtggtggtgggcacctgtaatcccagctacttgggaggctggggtgagaggatcacttgaacccaggaggcagaggttgcagtgagccgagattgtgccactgcactccagcctaggtgacacagtgagactccgtctcaaaaaaaaaaaaaatgtttctccatagagaccaggtctcactgtgttacccaggctggtctcaacctcttgagctcaagtgatcttcccaccttgccctccaaaatgctaggatgacaggtgtgagccaccaggccttgattcagcttttagcagctttgttggacaatgaggtggccaggaatgttatgctgcttggggcttccaggcactggtttcctctttgggaacagttcctcaataaaagaaattgaacgagtacattaagacctgttcagaaagcagctcaatggctaggtgtgatggcttatgcctgtaataccagcactttgtgaggctgaggcaggaggatcccttgaggccaggagttcaagattagcctggacaacaaagtgagacctcatctacaaaaaataaaaaaattagctgggcgtggtggctcacatctgtggtcccagctacatgggaggctgaggcaggaggattacttgaggttaggaggtcgaggctgcagtgagctctgattgtgccacggcactccagcctgcgtgacagagtgagaccttgtttcaggggaaaaaaaaaaaaagaagaaagcacctcaactaaatggagacctttggctgtgtccttgtgccctctgcctttgtgcgtggggagtaggtgtgggtgggccctccaggggacgctggttttgggtcactgtagcccgcatgatttggggatggcactaggctgtggcgggcgggaggcaggttcccgacaccattcatcatggatgaacaatgtcttggggtggttccgtgtcagtccagacctcattctgtttcatgactgtgcaatggctgctgtcatactgctgggggtcaggtgctgttcagaacgcctcatgtgggttcagtgactgtgtaggagtgtcagtagcaagtgtgcacctcctgtggccttgcttgtgtcgataacacctacattgctttgtctctgtcaccagcaagggtgcaacagacattctgtgacacatcttcatgcacatgtgtgaatatgtctgtgtgatccattcttagatgtggagttgccgggccagagtgtcctgcatttgaaatgggaagttagcaccaacctgtggctccatcttaggtggtttcccagggacacaggaagctgagggggcagcgctggggggagctgcctagcgcccgctgaagccgcatccctcctgtctttgcaggtcggctggatgatgtggaactggatggtgtcccttctggccacaggagcggccatggtcttgtacgatggctcccccctggtgcccacgcccaatgtgctctgggacctggttgacaggatagggtaggtaccaagatgctgtgctcaaagcaagggacaggcagcaccaggaaggctccttgggatcagatgcagagctgtgcctgccttctaccgtggtcggggcgtctccagcatgctctgcctttgtggacgccccctctccaagaggagggcatgggaggtgccagaagcagaaggtgaaactgttaggaagggagggacaccaagggccagggctcttccctccagagtgagggctgagaaaaatcctacgggcagtgtgcaatctcatttcttttaagaatctatttctattttgaaggttattttttagtaaaaatggtatgtatcgtaaggcacgcggcatggtattttgctgtgtatacgtatagtgaaatgagtactgcagtcaggcagattcgcatttgcatctcctcacacagttacctgtttgtttttagcaaggagagcacctgaaatggactctcttagcaaagttccagcacttattgcatagtacggcgttgtcagctgcagtcatcatactgtgcattcatcttatttctctagttgtggcatttcccagcaaaaggaggaaaaccgagggtcgcctagagtcctgtttcacacaggttctgcagattcaggagtgagattgtattcatccattttcctactgctatgaagaaatgtctaacagtgggtaatttataaagaaaaagaggttgaatggactcagagtttcacatgactggggaggcctcacaatcatgatggaaagtgaatgaggagcaaaggcatgtcttacatggcaacaggcaagagagcgtgtgcaggagaactgtcctttataaaaccatcagatcttgtgagacttattcactatcgagagaacaactcgggaaaaacctgcctccatgattcaattacctcccactgggtccctcgtacgacacatggggattataggagctacagttaaagatgagatttgggtggagacagctaaaacatatcagagatgaagtgaggtgaaggctgaacgcacaggggaggtatgtggataagttcatgaggggtgggtgcagaacctgtgactggggggctgcgtggtgtttggatttcctgccacctttctcctgagcccattggcaggaggagaaccctgtttgttcctagccgtcccttggggctggcagccacctgtcttctagggtcttcctcacctcatcataactgcactgagtgcttcctggggcccctggaggtggtcatttatttcctgtggccctggctggatggtagacaggaatcccatgagcacaggcgagagccagttgggtacccttctggtgcctgagaattatgcaaatggggataggtgtagtggtccctgctcccccccgaccccaactccttctcatcatcatcattagaaaggcctcatgagatccagtctcgtcagcactttgctgatgaattaatcacaactggctggcgtgttctggccactgtggtcttggtcacccttggcctaatgacagtgtttccagagataagaatatagaagttgccagagctccaggggcccagaaacaaccatgctctgtcctaattacatctgaatctgttcttgggggaaacaggagccactcatgtttttaaatccttggccattaaacattttaaatataacttggcctgggtaatatttaaatcctgacatttggctcacaatcttagtgaggaaggctatttcctaatgagattgtttccagcaaaaggttaatcaaatccctgggaacttcagatggctttagaatctttacccttttacccttaagccaggctccaggtggaggaacttttattggtgtgtcggggaggcaggcactgggtcgggggttactggaggaggggtggagagggaaatgtacatcagtgaggcccggtgctaatgagatccagggatgaagcatcccagggagaccgtgctctgtgtgtgcatgggtgtgagtctgcgtgtgtgcacaaaagtgtatgtgaaagtgtgtgcgcgcgtgcatggagcgtgatcttgtgaaagggagcgtgggagtgcgtatgtgcatgagtgtatgtgcacctacatgtgtaagtgcaagtgagtgcatggatgtgtgtgcatgtataggtgtcgggtgtgtgtgcatgtgcatgcagctgtgagtgctgtacatgtggatgcatgtgtgccttgtgtatgtgtgcatgtacctgtgtacacgcgtacatgtgcaagtgttcacagcatggtggctggttccgtgccgtaatcacgggccctgggttggccagagcgctgaggctgattgaggtgtggtcgtgctgtcgcagggctccctctggatgtggccatcgccccgcctgagagagcctcctgcgccgtttggcgaggcaggtgtgacttggcaccctggcaggggctgcgggtgaggggctttcggaagaatgcaggctttaaaccactacactggtcgccaccagcagtgagagggagcgggtgctgggcggggcaggacacttcagctcagttctgtccacctcctggaaactgaatgttgtgtaacagttgaaagcagtcatggcaaaccctgttttgtggcaagaggcatgcggggcaggcacagtcctcgtgatgctgtctcagtgcctctgattaaaacccacatctgttagtaaatgaggggtgagatctctgttgattaccagcatgtcagctctcagccttattgacacattcgatcaaagagcatttattttgtaggcacagacaagataatttgaaaagatgaattttcttcttcacaggggtgtgtttctgggttctagtgaggggactattctggacagaattagggccaggaccccggggactttgtccagtttgctagtagtggggcaggtgtggacgttgtctgggttgcccagttttgcccgtctctgaatggggccattgtctaagatggttctagagggcaggggcctcgtgggcgagcaggcttgtccttctaaggaagtgcatgggttgggtagcactttgtcgggatctgcaccccgtgtgtgctggactacgtgctctgagccaagctccctggggggtcctgggggccacacagcagcgaccaggggccagcacgctctgtcctcatggggctggcactgggagggggaaggtaaggaaaagacagaggccaacctcaggctctgaggagtgctgtcagagacctggggtcagggagtcctcgagagtcctcgagaggtcttggcatttgggctgaggccgaaaggttcaggaactacttttgcaggactggggacgtgtacttcaggcagagggaaccacgaggagatgggcctaagatccatgtgttgtggaagctgggaggggcctcctgtggaccgagtgtgaagggctgatgcggggctgggggcaggagcaggggtcagaggggcggggacttttggagctgcttggagggtgagtttttccccgagtggaatggaacagcagtggacactgaatcaggagaacactgatctggttcatgttattaaaagggcagtgtaggccaggcgtggtggttcacgcctgtaattccagcactttgggaggctgaggtgggtggattaccatgtcaggagttcgagaccagcctggccaacatggcgaaaccccgtctctactaaaaatacaaaaaatacaaaaattagccaggtgtggtggtgcaggcctgtaatcccagctacttgggaggctgaggcaggaggatcacttgaaccctggaggcagatgttgcagtgagctgagatcaccccactgtactccagcctgagtgacacagagagactccatctcaaaaaaaaaaaaaaaaaaggcagtgtagcgcctgagtgaagagagcattgccagggctggggtaggggcagaagctgagagactcaggttgctggagcccacaggcgcagtggcgaccctggaggggctgcctgtgggctgatccacacttccctccgaacagggctctgggcagtctcgggcaccgggtcccaacggtttagggacctgagactgtctcatgctttggtgcagcgacccctacagtacttgctagaaataagacgtggcatgagtgcccgcaggtgggctcccgtgcttccaagagctgaatggtgttgcatttcctaaccgtcttacctgcaccctggagatagatgggggactttgccgtttcttcagacaagcaggactgtgactcacaggccggagagcatcacctctgagtgctggcggagcttcaccaagatcagggtttgcagagtcttgcctgcacttagacgcactttagacccacagagagccttcgagttttctgggggtgggcagtggggggattgcacaaaacccgtgtgttgtttgggcgtggctgttgattggagagctttgtacctgtagctggaggtggtcactgctgctcagggccgggtgatcaccattagagtcatgaggtctccatcctctgttagtgatacttgcaaaggaagtgacaccttagtccttggctatgatgttgaagtagttaatcaaactctgagtttatgaaagaagcatgggggatggtgggaggagctagtctccctcccccaaaactccagccatctctagggtacagtggtggctttgttggtggcagggtgtgtctggggaagtaagagaacgaaggtgtgggaggtggaaggaccatggtaacccgcctccttgcgtggagggagacccaccctgccattgccttagccacgcccagcccagccagccctgaattccgggatgttctgtgccatgttgcctcgtggcttcagacagcgaatgctatgacggtcttccgtgggatgagtctctccaccgaatgtgcaggactgaggttctactgcccagagtgacccagaagagtctgaatctcacagcctcctctaggccccgaagagaataacgttctttagttgggccgactgagtttacatgtgaagggccgcctggctggaggaaaagctgaggaaggaaatagcatattagacagggctgcccttgaaagcgcagtgaggtatattcagcagcgtgtgttgttctgtgagcacaaatgcatagaacggtggattctgaatgttcaagaagagctggacttttctaagtttcataaaaatgtgatcttgtttaagaaaaggggatgggtggagagtttcaagtatggcacatgttttcacaaataaagaattctcccagcactttgggaggccaaagcaggaggagcacttgagcccaggagttcaagaccagcctggcaacatagcaagaccctgtctctcagctgggcatggtggcatacaccagtagctctagctacttgggaggctgaggtgggaaaatcacttgggcccaggagttggagactgcagtgagctgtgattgcacgactgcattccagcttggggcaacagaaggagaccctgtctaaaataataataataataattctgtagccttctcttcattggtgaatgaatgtgtgaggatagaatttgaggggacttgatttttatggcctcctttggtcccccaagatacaatactctgcagttgggaagataatgggttcgggtgagcgactgttttatgtgacgcctcgtggtaaagggagctggccctgcgtgctgaaatcagtgtaaagagcagtcaggtgcacctgtgaggaagtcaggtgccgtgactcagactcgagtaaacatgaagtatgagttcaacccagaaaactgctctctcttgggttttgcaaacttgtcagaaataaatcactaactttagaaagctttggtgcaagagccttgaagagtttctggtgttttctttcccgcctgcaccctagcatcactgtcctggtaactggggccaagtggctgtcagtgctggaagagaaggccatgaagccgggtgagtgtgcctcttcagtactcattccctgtactgccaatcaaggaaattaaatccatcctatttcctgcttgcgagtgaggcttcaggcactgggtttagttttaatcttttggtgactctgcaccccagtggaaacccacagtctccagatgctccacacgatcctgtccactggctccccactgaaagcccagagctacgagtatgtctacaggtgcatcaagagcagcatcctcctgggctccatctcaggtatggccccggtggggacagtccttccagccatccccgccggccccataagtatgcacacctctgcccagtgcttggattcatcccaaggacacagtccgctgggcagccaatacgcacagtcccttctcatgatctgaggcagtgatgttccacgaagtcactgtgaacacggaacccatacggaacccttgctcctgggggaaatagatttatgtacacacacacacctctcacatcgattatagtcttaaaatccaaaacaatacatcttggtaggttctacattttttatcttgcaaaagagaaaatgcagttcagaagcattcagtgacttgcccaaggctgccccaccgtcaggtgctagagctgggatgccacgcccgggaagacagcaccctgccccaccctgccctgggctcctgtgtgtgagagcaaggcagggaggctgtgtcgccttgtgtgacctcagtgggaatgtgcctgggtgacttagggttttgactgctctgcaatgtctgagagtgaccacaaaagctccagagtatggatctggaggtgtaacataccttttagtgagtaggcaaattccccaaaatagaatctgcaaatagtgagaatccactgtatggaaggacaaatattgccacattgtttatataagtaaaaaatagacactacctatatgcccagcagaaggaaattgattgaataatttagggtacagtcttaatttatgcagccattagaagtgcatgaaatacactgatggacatcgaaacatggccattggccatgatgagtgaaaaaatcagattgcagaattacaaggtgcggtcatttttgcaggtggaaaacaggtatatatggatgtgtacatgcacactcatgtatgtatatatatgggtgtattatatgtggattccaagtgaatttttttttttttttttgaggtagagtcttgctctgtcacccaggctggagtgcagtgggtgcgatctcagctcactgcaacctctaccttctgggttcaagcagttcttgtgcctcagcctcccaagtggctgggatcacaggcatgtgccaccacgcccagctaatttttctatatttttagtagagatgagatttcaccgtgttggtcaggctggtctcgagctcctgacctcaggtgatccacccaccttggcctcccgaaatgctgggattacaggtgtgagccactgtgtctggcccccaagtgcattttttctcataacttttttcttaacataaagttgtgctttagaaaatggttcacgcacgtggtaaaaaattcagtccacaaaggtgtcctcatggctgccgtcccccttccccaaggaagccgacgtcgttcccttcagagatgttctgtgcataggtgagcgtgtgtgcttgagtgtgtgtgagtgtgtgtaaatggggcgagagcaccccatttttacacagatgtagtttagggtacacacctcaattccccttcacatgacttaagagttgattccattgctgcccatagaaatctttgggtcagtttttttttttttttttaaagacagggttttgctctgttgcccagcctggagtgcacactgacacgatcatggcttactgcagcctccacctcccaggctcaagtgatcctcccacctcagcctcctgagtagctaggaccacaggtgcatgccaccacgctcagttatgtttttttattttttgtagagacggggttccaccatgttgcccaggctgttcttgaactcctaacctcaagtgattctcccaccttggcctcccaaaatgatgggattacaggcatgagccaccgtgcctggcctgggtcacttttattttatttttacatatttgtagttctgatttttctccttgtgatttaaaaacatactctcaaagcacctctttaagaggtgctatttatacaaaattagctgggcatggtggcacatgcctgtaatcccagctactagggaggctgaggcaggagaatcacttgaacctgggaggtggaagttgcagtgagctgagatcgtgccattgcactccagcctgggcaacaagagtgaaactccgtctaaaaaaaaaaaggtgccatttgcccgaagcctgaggccgacccctcagccttcctccccaccgttggttcctcggcctgaggtggggggtctgagccattcccaccagcagagtgagcagcaggaaggaggtcaggagccctgctcaaccttgatggtggcagaaacgaacgtgactcactcattttcgtgggacacatcagtcagtgacatgaaatggcagagaagacatcacattttattctctgcctgaaggaagaaataaaatcacactccacaatcttgcagctgggaactttttgttttgtttgtttgtttgttttgacagaatcttgctctgtcgcccaggctggagtgcagtggcacaatcttggctcactgcaacctccgcctcctgggttcaagcgattcttgtgcctcagcctcctgagtagctgggattacaggcacatgccaccacgcctggctaatttttttgtatttttagtagagatggggtctcaccatgtcacctaggcttgtctcgaactcctgagctcaggcaatctgcccaccttggcctcccaaagtgctaggattatagacgtcagccacctcgcccagccacatttctgtttttccaaccattaagtccacataaaccatggcactcgagccttcccatgtgatgggtctgtctaggcagtgcctgccaggtatgtatcacaggcaaagcttccattttctgcgatcctgagtcttgaatttcagcatgaccacaggaggtcatttacttagcggatcctctggcaggaaggctcggctaaaacgtcaatcaccagatgtggggggttcattctaatttccatatcacctctcccactgctccctgaagagaagccccacctgtctgggatgttgcagtgtttgtctgggagagtagatatttgtcctcttggcaccttctcctttgttgctcactaatttaacacaatttgtcttgggcttctaaattttgagtctccctttgccattgcttgcaggaggcaccgacatcatctcctgcttcatgggccacaatttttctcttcctgtgtataaaggggagattcaggcccggaacctgggcatggccgtggaagcgtggaacgaggaaggtgatggctccaccaactgtttctttctgtgattaggcgtgagttgggagtgtgggagcgttcggatgtgtaactttgcttggacatagttctccaaaacagccctcggaggggaggcccctgtcacttgcagtgtgatgtcctttccctccagcttggtttaacacccgccgggcttctggtccctagcctctgagaggtcagggtcgagctggaggacaggtggagagatgtgtgctcgggaacagtgggcaggtgggtggtcattgccctgcatctgaaccctggtgctggatacacaggcagcagccagctctgagcttctgagaacctggtcattgaagggatagtctcccgctatgctgggcctggcagctagaaatccagctgtgctaggaggggtgagcagggctcagtgcacctgctctgcagagcaatgtgggaggagtcagtgaagctgaagatgcatacgtgccctgtgatctgggaatgccactcccagaagacttacttgtgatccatgcaagaatgtttgtagcgccccatgatttgtaatggaaaacaaaattgggaacaatagaaatgtccatctttgagaggaagaaactctgtgatcacatgtggagaatgcccaagtggtgaatacgaatgaaccagagtgagacctagtagcccgaacgagcccagatgtcatgctgagtgagcacaggaagatgcgggacacatagaaggacagcgtgtatgtgttcaaaggcatgcagagtgacgacatatgctattcaaggatgcgtgtggatggagcagaaatgttaacacacatgggaataacaaatcactacgtccgagacagcgattttggggagcacacagggaggggacttcatctgggaggaacgcattattaggctgctgtgacaggtgtgtgggcgtggaccatctctgtacctttgtatatgtctggaatattgcataataagtaatagcttaagaaagagagagagacagccagggtgtgtggctgtggtgtgtgttgggcttatttttaattctcccataccaggaaaggcggtctggggagagagcggcgagctggtgtgtactaagccgatcccttgccagcccacacacttctggaacgatgagaacggcaacaagtacaggaaggcgtatttctccaaattcccaggtcggttggagagatgcagacagagctggccagcctctgccttggctgggccttctgtgtctaattctgtaccatcgtgcccctcccctcttccttcccccaccagggcttggagaagctgcttatagttcattccgccagtggggggataatgaatttttgatcaatatcttgttgtcttcagcttgaagctatcgtgtgcaactgcaatctggtttagttgaatctcagccacctctgcccagagcctcttggccccagcccctgctgctgggagctggcacgagcctctggtttgcatgtgggagggtggagggtgtggggctgaaacagggtgatgcctgcctgttcacgaggagtggcatgtggaagtggcgtctggctcgggtctcttccttcgtgtctctcaccatcatccagtcctcatggagatgctggaggaagagcgcttttgcggtggaagcatttacaacccgacacgtcactctcacatagactgacacccttgggtgtcgtcttttgagtggtgccttgccccaaagcagggaagtcttttatttaaagctctgattcctgcctccctctaatcttatttcataagcagtctcgagttactgctgctatataattcatcgtttagcaagccttctgttccagagttatttatactcagtacttgctttctgcagtctctcaaaaggtaatctggtttagcacagaccacgtatggagaatcagaaagcggtaagtggtaggatttgccaggtatccttcctgccttgcgtgtttgcgtttcaccgttaaagccattgtgcctggaatagtgccttcctgcagcagcgtggggcatccccccaggggtggctcagcctccactgcatacctgctgcacctatgccccaccttggctcctgccgtgagcagctgtgcagacagacgaatgcagaaaagcaagagtggatgtagagaaacactcatcagatgaccctgaagaggagggtagggcctcctgccttgggaggagaggccaaaaggattagaatctcagcttgaggatccatccaagaaatgatggcccttcatcttctgtaacattgctctttgaaaactctcttttctgtcactttatttgtcacatgtgcaagggttcatgtgatagatgtctctcaggattaatttcagaataatctttttttgaaactgatattccttcttggagaagacaagtactttgtgacgtgttatatttccatttttgccttggctgccaggaaactcagagctgaaataattgctttgtttttgtagtcctcttacctttagggtaagattttgcttctctttgaataatcctgtcatgaagtcagttttaaaggtagcttcctccaatacttcctgagtgtaggtgagagatatgaataaatatggaaagacaaaggcagatcagataatgagatctgaagctgtttatcatggacaaggtgaacataggctgcacttagacccttcctcaagcaccagcgctgagagattcttgggctgtataggaaatggcgtgatggcaaaaccaagcaacaagagcaagccttcgtttccacaactcggagtgggtttttggacgtcgttaccttaaaaaatgatgccaggtgaaaatgtaaacaggccgtgtgctggtatggaaagatacccaggatgttagtaagtgaaaatgagagtttaagaacagaggacatagcatccctttggtgtaaattttaaatttttattttagagacaaggtctccgtctggccccaggctggagtgcagtggtgtgatctccatccactgcagccttgatctccagggctcaaaggatcctcccgcctcagcctcctaagtagctgggactacaggtgtgtgctaccatgcctggttaatttttgtattttttgtagagatgaggtccctctatgttgaccaggctggtctcgaactcttgagctcaagcaatcctcctgcctcagcctcctcaagtgccgggattactagcatgagccaccacacccggccttgtgtaaattttaaaaaggaagtacatatgtgtgattgtgtgaataaatgaataatgagtatgaatatggggttatatgagtggtgggattatgagcccattttggttttctttatggctttttatttttattttttgacacggtatctcgctctgttgcccaggctggggtgcagtggcacgatctcagcttctcctgcctcagcctcctgagtagctgggattacaggcgcgcgccaccacgcccagctaatttttgtatttttagcggagacggtgtttcaccatgttagccaggctggtctcaaactcctgatcttgtgatccacccacctcggcctcccaaagtgctgggattacaggcgtgagccaccaggcctgaccactttttattatttttaaaaacttaaaattttaaaagaaagtaaaagcagacttaagatttaggtcattgcagatgccacattccaaacaggcctggtctgctatcggcagtcacctgttcccactgtatttccactttcgcctcagctcccaggagactcgaagcttaagtcagtgccttgaagaatgagaatgatctaaatctgttcagtctgctgtagaaaggaagacatcgtttctgcggcttcgttttgccatcaggccacttcctctgtggtgccctggagccagccactagtggattgctcctctcagcctggctttgcaagggatcaaagtgtgtcggggaagttttcacaaaaaacatttcttcagagtggatttacatcctcctttttctctgcatttccggggtctcagtaattagggcacagtactgcagatggcccagaaaacccagaaatttctcgtccgattaaagggagatctgactccaggcaaacaagactgtatgttgttgctggcaccgaagtgccagaatgaggcaggattcccaggtgagcggcacaggcttgcagctctcatcttccagggctgccattcatagactcagtttgctgagtagccatacaggcgtgctcctgcagaagctaggcacatccattgcaagcctaggagtggatttttttttttccttatttgtgtatgtgaatcttttaaaagtccaatgagaaaagaattggtttcattctctagcttggggaggcgggaggaaagacctgaagacctgcagttctctttttttgcattggaataagtagctttgggctcatttcattctcttcagctgcctcccagggaccatgcactcctgtacacagtccccttggccttcgtccccatagaaggcttggtggtggcttgtggcagtgtctgcttcatgatgtcacataaatgcgtgagtagactaggtagctgttgagtcataagctgtttgggttagctcttgccacagagtggagaagtgctggagaagtgtctcgagatttgggagggaggagatgccttctgaggctgccgcccgtcagtgaagacacagaagctggcttctttactgttttcccttcccggatcgcaggaaatcttcggggcgttattgcaggaggccagcctgctgctgaggcagatgacttctggcattacaaagcagcagagatgcgcttttgattacggccagccagttcccctcagtgtggctgatcaagggctggtggtggtgtcagcaggaggaggcccccagctggttaactgctcccttggtgactctctcggctgtgtggcttctcttcactgtttggcgcctgggtggaggatgtggccaaggaacctctctccttagaggcggcatccaaatctgggatttgatccctttggtccatcagcttcatggtgccaccccagcgtgcaggccttctctgaacagctgcacatgaggccactcacgtggcctgctgacactgtgttgctgtcatccctggctctttcctcttccccgtctcctcatcccctgggttttacctgctaatcggctctctgtccatgtggctaatgttttggttcaagcctacatgactcggactggtgcagtagcctccttcctggtcacgagcacgtgtattccattccaagatctggccccaacctctgcacaccctgtgccctccactgcccctggccactcttgcttcccaagacatggcttattctttcctgtgctacactcagggttgtctccagacactcctgttgacccccagtggcctggccgagcttggtcctgccctctgtgaattcccgggtccttgctggtgcctgaggagctgcgttcctcctcgccggcggtgtcagagctgcccgggcagcagccccgctagagggcatgttccttggggcaggaactgtctggctccctctggcccccagccccatgccagacctgcctctgggccccagtgatgtctgcggacctacacccagcgtctgtccaggcagcctgtcatggccccttctcctcgggatgaccgggcacctctgctgtctttgcaggtatctgggctcatggcgactactgcagaatcaaccccaagaccgggggcatcgtcatgcttggccggaggtaagggctgcagagtcggcttctctttcctggagccccaccttccagaggcatgggggtgggagaggaggtgctttctataaaagtcagtgacccccttcctgggcacctcactccactccagcaccagggtgtccacaccacccacacctctgctggtgtctgggaccccccagcccccaccggctggtgcgccatgtttccccacccctgtgcctgtgcacacaccatccctgggcctgaagaccccctctgaggaagcattgtctgctcagtctgcaacatggctgactgtccctcatcttggacccttcctgtgtcattcctggggtggcgcatccctgtgccagcttccttcccgagggatgggtctgggcgtgatccaagtctccctgccctgtgatggggttctcgggtagggagtgtcaggatgggggttccacagcaaaggcacagcagtgtccacacctgcaatgggggacacgtgtgcaggtgggaaggcagtgaggtgacagatgttcctgcctccctcgatggaaagctttaacctgagagggagaaagagccgggtggtagggcaaggagctggggagcggagtgtccgtgactagtcctgggggatgccatgggaaagtggggggtgactgccctcccgtgggacccctgggacttgcttcactccagagctgcggtgtggccctgacctcttctctctttccagtgacggcaccctcaaccccaacggggtgcggttcggcagctcggaaatctataacattggtacgtgcttcccctccctgagcgttctccagtctccaggaaggaggagggtcctggcgggagccccaggagccccacctttggcacaactctggccccttgttctctggtgtgacagtggacatttgtgagcctgacctcctttccagaacataccttgcccacactgccatcctcataaaacctcaaatggggtctttaaggtccctttgcccatcctcttcctcattatagctcatcctcccggtgagctctgctgggctggttacttgtgtctatctactcttttttttttttttggagacagagtctcgctgtgtcacccaggctggagcgcgatcttggctcactgcaacctctgcctcctcagtagctgggatgatagacatgcaccaccatgcccagctagtttttgtatttttagtagagatggggtttcaccgtgttggccaggctggtctcgaactcctgacctcaagtgatccgcctgcctcggcctcccaaagtgctgggattacaggcatgagccaccacgcccggccaacttgtgtctactctttatggttgaagaaaccagaagcacagagagggttcaggattgctgaaggtcacacagcatcatgcaggacaccaagcacagagagtgtaggcctgtggatctcacaactgtacagtggagtcacctgtgggccttcaaacttcccagcccagggacccagacccagcccaggccgcagagttggtcagatggcctcttatgctagtgcttaggtcagagtcctaaacttatgtcaaggtcgtttgtgtggccagggtagagaaatcccgatgtctgattccagccttttttcctcactccagtggagtccccaccacaggcacctgctttcttttttaaaaaaatttttttttgagacagggtcttactctcttcacaggctggagtgcaatagtgtgatctcagctcactgcaacctccgcctcctgggctcaagcaatcctctcacctcagcctcctgagtagctgggtctacaggcgtgcaccaccatgcccagctaatttttgtattttttgtagagatgaggttttgccatgttggccaggctggtctcaaactcctgagctcaagtaatcaacccacttcggcctcccaaagtgctggaattacaggtgtgagccactgtgcccggccacctgcctccttttttgggaggccgacagggtctcactctgttggccaggctggggggcagtggcgccatcataactcactgtagcctcgacctcctgggctcaggcgatcctcctgcctcagcttcccgagtagctgtgtctccaggtgtgtgtcaccatgcctaacttaggttttgatttttcgtagagacaaagtctccctatgttgtccaggctggtctcaatctcctggacttaagtgatcctctcacctcagcctcccagagtgctgggattataggcgtgagccaccatgcccggccctcttttttatcttgaattaatttctcattaagtaaggcccacacctggcttcctggtagaacatcacccatcctgccaaacctgaagctctctctgcctccccagtgatgggttttcttccgcttgtgaaacggcctcctcagcaaatgtccctccaaggcccttctcctgggtggactgggagaacacaggcaccgctggaaggcttgggggacccagcctgcccctcctgctctgccaggttgctgtgaggcccgaccccacactgaggggccccctgcgtgaatgtgcaccctctcctgtctccacagtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccggtatggccatctcccgccagcgaggagaccgcagccatcgccccacgagcccacacattgaggggcgcttacatctgagcagcttgccggtgctttatatatcgtttgtccacgttgcctagcaacgccatcctctccctgccatcctttttcctacccttcctaagactgcatttaaagcaacttctgctaaatacccatgttcagagggttagcaggcccagccctgcaggtccaactggcttctccctgctatcccctggttttagtgtattctcaaaatttttaatgagaacattaattttaactttttattttttattttatttttttgagactgagtctgtcacccaggctggaatgcaatggctcaatctcagctcactgcaacctccgcttcccaggttcaagcagttctcctgcctcagcctcctgagttaactggtagctgggattacagtcacatgccagcatgcctggctaatttttgtattcttagtaaagatggggttttgccatgttggccaggctggtttcaaactcctgacctcaagtgatccgcccacctcagcctcccaaagtgctgggattacaggcgtaagccactctacccagccaattttaactttttaaagtgctgctgggagccgttgctgttgccttttagttttaagttctgctggtacagacaagacttgactctttttagaggcaggtcttcctaaggctgtgtcgtcatcccccagcccctggccccagtacgctctgctttgattctaagtgggggaggaggagggtcacccaaattggatcacagctttcatttgcattgcttacaaaacggataccccgcaagctgacagaagctgctgtgtgtgtgtgagtgtgtgtgtgtatgtgaatgtatacaacaatttagacagtggcaggctgtatttgaagcctatggaatggctattcgttaaggagaagatgggagcacacactcactgggttcccaggggaagctgactttgatgttgcccgggagcagggctgattctgtgaggtgtaactagagacaggatttaccaggagagtctgcttcctggagaatgttgaaatatctgatgccgtttactttgaaacccgtagatcattctctttgccttaaaagttatttcaacatcttcaaaacaacctgtccaggagtgggggctggggagagcgcttgcagcacgacaacggtgtgcaatccctgatcatccctggaagactgactcctactcgggaccctgttcctcctcctcccggcgcctgtccacatctgcgctgactcccactcgggacccctgtccctcctcctcccggcgcctgcccgcatctgcggtgttggttgctttttgtggtgtccacacgtttcctttgtgttctggttctgcatgggaagagccctgcagcttggggctttccatccatctctttctttttcccttatttttggttggtgactcttggcggctctctgtggggacactgatgctctccaagaaggtacttcttgaatcagtgacccttattgtctttttctgatgagggtctaaggttttccttcagtgaatcagtgctgtcttatctggaacattttagggaactggaatttgcatttatccccttggctttatattattgaaaaagaacttaggtcttttgctgccaaaacagttgttaccaaaccatatttgatcacgagagtagtggaacaatttattatgaagggggaaaactcagcacctttctttccctggttgtcctggcttttgtgggcttgcgtccagggcacccagctgggctctgggctctttctctccccagataaggtctcctcctgggtgcattcgggaagttatttggagggttcttccagatttttgaatgcccttacattttcgagccctcacggcaggcttaggagaggatttacctcttttattgctgagctagggaggggtccagcctccacagggaggtgacacggcgtggccccagcctgcccattcaggaactggacccacttcagggtcagaagaggacaactgaggtctcatctgcaaagtcccggggccttgctgaggcaggagagcctgttgcaggtctgacccttcacatgttgcttgtagggagtgggctacccacccctcaccaccccgagaacagcctgagcccggggcgcatctctgtctctgtgtggagagacactgccgcttctgttccctgggaagccagtgccattttcagcatttagggggttcctggtgagggctcaggagagatctgggcccagagccagccacactccttgtgttgagtaagactcatcccatctctgatctgtgacacgaggagaggagcccctcactcacccgccacagctcagggtggtgatgcggcaccattggagtgagcggccccgggggactggggaggctctggccggcgtagtccttgccgccagccttcacagcgggttctctgagggtctttatgcacaggggctctgtcacttagctctggccccccctctgcccctgaggcatgactttgggcaacgcagcatccaagcctcagtttccccatctctaagatgagttgacaacagagcctctctggtgggtgccgtgggccacagggtgcccagaacgcagtccccgtgcctctgtttctgtgctgcctccactcaccgtcagccttcattcggagtaggtgcgcatgctgtgcaaagcccttccacacacctgatctcagttgctctctgtgcaaaagtcagagaggctttccctgcatttcctgtttgaacagtgtcctggcctccatctttagctttgacagtgtttaccatgggggtgctgagggtgagttcttgtgtatgtgcacatctttctggtggagtggaggcctcttgaggacaggaaccttgtgggtctacctccttttcttcggagctcagctgactgcctggcaaacagcagatgcttttggtgtctggtgagtgaatggggggtggggagctggtcctgtgaccctggtgaggcgggacaaacttgtcttcctcacacccatcttacttcctcttatgaggaaacccagagagatgaggggtcttgcccaaggaaggggtgtccatagtcagctctgccttctgctcacccagaataaagacctggggaccccgcgagggtcatggccaagtggaatggactcctggcatttgagggcttcccgactgcagccctcaggcagccatggctgtcccaagtccagcgggcctttgctcgggtcatggctgggatgtctggcccttcctgacaggaggctgctgggctcctgtctacttggggacgcctcatgcaggagctggtgtgggggtgggcaggggggcggtggcttcttcctttctctttccctttcctctaccttttcccctctccccagaggaaatggtagcaggatttcttttaagaggatgctgctgtattttgccagcgggtggaaggtggcggtattagctcccgtgagctgcacgtggacccctgtgtgaagcgtagcagggcacagagcaggcgagacgtttgcatctcacagcgggagggccggcgacatcacatgaagtgacaggcaggcccttggaagccggtgcttagatccttaattagttcacacgtcgactgaattttcaagtgaatgaattttaattacatctcaggttaaaaaaaaaaaaaggcgccagtgatcgaggactcgtcactgggctctgttgctcctgaagtttcctagcccacaacacaccaacactgccaagggctcttctggattcaaggtgaaacacatgtgccataaatcttggagctctgaatgtttggaaagggcccgactgtgagaagaagtaacacaccgtcccgtgcagatggctggctctgaggaggagttcatgggagcttggggacactcttgcctctagttctaggaagctgggccacttctgaagtaatggcaatatcaataaagtaatggtctttatcatagaataacgtgataaaatatatagagaagtaaaaaagtataaataaaagtaaaatcatcataaaacatagtagctaggcacttctgaagctgtgtgtgcactgattcattcacccagtgactcacagccttatagcctaggtgctggcacccctactttcattcgaggaagtgaactcaggttcaggaatttacccagcatcccccagatggggtggcaggagccacatcttccctgaaaactttcttgcccagggtgtctgctgggatttaggaatggtctatgcctgcatttttatcctggtcaggctgaccctgaaccctgagagatactcttttttatattcccatctggaatatgcactgccggggtcagtggggtgtctggagggccctctcgaggccagcttggatgtgacacgtgtcgtgggtcccaacggggcccagtagagtgtgcagcgttagaaaaatgaacatgctcggctgggcgcggtggctcacgcctgtgatcctagcactttgggaggccaagatgggtggatcatgaggtcaggagatcaagaccatcctggctaacatgagaccatcctggtgaaaccccatctctactaaaaatacaaaaaattagctgggcgtggtggcaggtgcctatggtcccagctactcaggaggctgaggtaggagaatggtgtgaacctgggagggggagcttgcagtaagcggagattgcaccactgcactccagcctgggtgacagagtgcgactctgtctcaaaaaaaaaaaaaagaaaaaaaaagaaaaaaagaaaaatgaacatgctcatggtgacctctgggcaactttgaaatagcctcagtttctcaacagccgtgccagggggcgggggtggggtgtggagagtgttagagttgagtttcagcaccagtccttgaaagtgcctttcagaagaacaggttttatcccccaaacagagagacagtggtcagttcaccgtacttcggtgcacgtttgcagacctggtgggaagaggggcatcttagagccgagacccattcactcttggcactccaggtggagctgggcctttggggcctggatatatccagggctgcggattttccccccttcaggtttaaatgttcctgtttttctacctttccctcgcagtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcaccc

SEQ ID NO: 38368 - DNA, 251570 bp, Homo sapiens
tgccactcggctgccggaggccgaaggtaggggcggtgagggccgcccggccctggagctgggcggggggctcagggcgcttcctgggcctcctcctgccggcggcctcggcgccttcccagcagtgttctggggacccacacatcctcactagtgtctccaaagcgggacgtccaagtgggcccggggctccctgccgaaggcctacctttcttatctttcccactcagaatgtctccattcacctctttattggcaggagatggggccgtggaaatttgagattggctttggctccgcacctgtttttagtgcccttgcctgtttcattctcccagcctaagtttccgtatctgtccgaagaaggggtggtttggtgttgatctccgagacccgtgtgtctcttcccatgtggaattattgtcactctcttattgcttgtttttctttgtcctggaaaatttgcctttagaggttacagactggttagtgttatctctcggatcgtctaggggctttgtgcataagccttgggctccattccctgggatttccgataagatggtgcgtgggcagctgtaccccagggggttctcattcaggtggtcccggaatcctggctttgaaaatccctgcttcagaagtcaggagagaatgacttgacatatgagcccctggaatggggctctgagtgggaaaagccaggaatcaggaaatgctaacacgtgtgaggctggggctttctttgcaccggaggaattagaatgccatttgatgtcttttaaaaatatttgactacctatatatgtaagatcagttttctaatattcttaaatgcctggcttcgtttaaagttcagttggctttcccacctcaataaacctaaataaaaacatgatctgagagatggggcgggggttaagttaacccaaactaagtagacaggaggagaatgaaacttacatatttgctaagagaagaaagtgatgtgtttataaacagttttttttttttttttttttttttgaggcggagtttcgctcttgtttctcaggctggagtgcaatggtgccatctcgactcacagcaacctccgcctcccaggttcaagcgattctcctgcctcaccttcccgattagcagggattacaggcatgcgccatcgtgcccggctaattttctatttttaatagagacagggtttctccatgttgatcaggctggtctcgaactcctgacctcaggtgatctgtctacctcggcctcccaaagtgctgggattacaggcatgagccacctcgcctggcatataaacaggtttttttttgacattgtgaaagatattttgttgtgtgtgtgtgtcttttctgctctcaccccacccaagtttttttcttttctgataaaagtatagccagatttggggattgggtaggattttgatgggagccagagtgtaacgatattgggattgatatttgtataacatgggtcagaacttggtctgtggttttgagaacatggctctcgggtttttaagatggtgttaccacaccacatttatttcccctttctttcatttgtttagtgaatttaatctgctcatgaatacatgtgctgttttaatgaaattggcaatagaagagacgttctgctcccattttacaggtgatggaaatgttagtagggatgcggcagtccaggaatgaaaagttgcctagtactttgattcccacttacttccccttccctgctgttttctgaaggccagctattacttctctactgaggccaactgtgagccctggtgtgtttcattggcaggagaagaggctaattaagtgaaactgaaaggtaacaaaatggattttaaaataactgacatgtgggaacttgatccaccaatgaatgttctcctttagagtgatgtgtgcaggtgtaggtggtgggagttgaggatggcgtgcctaagtgatttggctgttgtccaaggcagttttgaaaatccacctctggaattgttttcagagacctttttgaaccatgcgagagatcagtttctttaatatattaaaccatactgtattattattattattatttttcagatggggtctcacactgtggttcaggccggagtgcagtggcataatcatagctcactgcaaccttgaactcctgggcttaagtaatactctcactaaagcctcctgagtagttgggactacaggggcgcaccaccaggcccagctaattttgtaattttaatttttgtagagacagggtctcgctgtgttgcccaggctgtttttgaattcctggcctcaagcgattcttctgtcttggcctcctaaaatgttgagattacaggcgtgagccactgcacacagcctatatatatttaaccccgaatggcatgggtaagcaaccttgtcacctgccttgtcttcagatgagttaacagttcttttgaagtggaaataacagatttttggagggtggtgaacatgagttttaattctgagtctaccacttattagccacataaccttggataagttacttcacctctggggctcaatgtaccactacataacagtgggaatagggccgggcatggtggctcacgcctgtaatcccagcactttgggaggccaaggtgggcggatcacgaggtcaggagatcgagaccatcctggctaacacggtgaaaccccgtctctactaaaaatacaaaaaattacccgggcgaggtggtgggtgcctgtagtcccagctactcaggaggctgaggcaggagaatggcgtgaacctgggaagcggagcttgcagtgagcggagatcacgccattcactccagcctgggcgacagagcgagactccgtctcaaaacaaaacaaaacaaaacaaaaaaaactgggaataatatttactttgaagggtggttaaatgacgtattacacatgaaagctcttgggacataggaatgcaataaatgttttcaccctcaaagaatgaagatttgccgttaatgagaatattcaaaagaacatgagagtctctggccgggtgcggtggctcacacctgtaatcccagcactttgggaggctgaggtgggtggatcacctgaggtcgggagttcaagaccagcctgaccaacatggagaaaccccgtctctactaaaaatgcaaaattagccgggcgtggtggcgcatgcctgtaatcccagctactcgggaggctgaggcaggagaatcacttgaactcgggaggcggaggttgcaatgagccgagatcattgtgccattgcactccagcctgggtgatagagcgagagattctgtctcaaaaaaaaaaaaaaaggctctgaaaggaagttgtacctttttcgaaataggtggattctctttttcacatacttgtggattcatactctgacctgctcagcctccccctgtctttcttcattcattttctgtcctttcctaagtgaagttttgctgcagaggctgtctgccagtctcttgtagtaagcctcttttcaggagagctaatctgaactctcttacaatgctagtcccttagtcgctattcctagggatttttttctgggggctccagatggtgcttggatcacgctctgtagcacagccatctctaactcctggatttggtgtcaatttggagacccatcctgtggagctaatcttctctctttctgagcaaggatgaatactttatccttttctgagtcggccttaaactgcaaaccttagtcttctacagcagagagtcttgtattttaattatacgtagactaaagacggaatagcatgcccttttcttttcttcctttactttcaccaaggatttcactgctgagtaggggagtaggagaatagcctgttgccattcagagtgaggccttgggtaacccctgattcctagcataagcaataactgagttcatctttgggacaaaaaccttgtaaaagattcgggctgctcagacacatgtggagaacctcaagctaggaattttcctagcttgtgaggagtttacacctggcattcttacttttgcaaatttgtacccagaatccagtagcaacaaaactatattcagcccagacttgtagttccttcaggttccaccaggcagctgtaagacatggctgtgattatgctggctggccatgtttgccttcatcctcctaatactgcccttggctttggtattgagaaggaagtggcataatcaattcatgagtaacattctctgccaaagtggaaatcaggggcagagagttgtgagcataggactagacaaatggaaagagccagccttgcctcaggaatgctgctaaagtgctgtgaatccgtgacaaccactgtgtttcttggtgtcacctcatttgtgaaatgggaatgccttcattgatctctctcttgagaagagtggaccaccatgccagttttcccaggacagagggatatccgtatgtgggacttttagtgccaaaagcaggaaagtccggggcaaaccaggacaagttagttaccctacccatgaccattatacaagttaatgaacactgtgcccttagggttcatctaagactcaaccctttgggttcatctaattatttttcaaccttttgttcattatcatattttgagactttttttcccttaattgtctactccccagtggaatgtttttttgagagggagtctcactctgtcgcccaggctggagtgcagtggtgtgatctctgctcactgtggcctctgcctcctgggttcaagtgattcttgtgcttcagcctcctgagtaactgggattataggcgcccaccaccatgcccaactaatttttgtgttatttagtagtagtttttgtgttttgccatgttggccaggctggtcttgaactcctggccttaagtgatctgcccacctcagtctcccaaagtgctgggattacaggcatgagccatcgtgcccagctacccccaatggaattttaataccacagatgtactgtgtatctgtttttgtattgtggccctttggatggccacaaaccattgtaatatctaactttttttcccccaagaatcaattttcaccccttctgggctgttactgcactcactgagaatgcatggtcttatctgatattctttctttaatgtagtcatcaaggccagttttttatccagaagaaacagctagtaccacaagctttttcgtttcctttcctgttttttttttttttttttttttttttttgagactgagtttcgctcttgttgcccaggctggagtgcaatggcgtgatcttggctcactgcaacctctgcctcctgggttcaagtgattctcctgcctcagcctcctgagtagctggtactacaggcatgtgccaccacatctggctaattttttttttttttggtagagacagtctcactgtgttgctcaggctggtcttgaacttctgggctcaagcatttctcctgcctcggtctcccaaagtactgggattattaagtgtgaaccaccacacccagccaagtttattctttattgttttaattttcttccagtctttggattttgaggtggtccatttatcatctgcttctctggtgcctcttggaccttccatcttcacagctggggctgctgtgttggcccaggtgtccccagactggacatcggaacctttgggaagagtctgatgtttggcccttgtcacatttcacatttcacatctacagagaaatggggaagggtatgtttctgaggtctgctcataggctatgttgtgactgaggaagttcttgatcatcccttttggttaccacttatcatcactggcagaaaaacatcaaagtggtcagtgaactcatctccacatctggctacttccatctctgcaagtagtttgcttcttcagtcttgtgatgggaaagagatctagaaactggaagaataatctgagatacatcctaaagttctggtgaggaaagctaatgccaatggacttttttttttttttttgagatggggtcttgctatgttgcccaggctagtcttgaactcctgggatcaagcaatccttccacctcaacctcctgagtagctgggattacatgcatgtaccaccatgcctcactcgccagtggatttttttttttttttttttttttgagacagcatcttgctctgttgcccaggctggagtgcagtggcacaatctcggctcactgcaacctctgcctcccaggttcaagtgattcttctgcctcagccttccgagtagctgggactacaggcgcctgccaccacgcctggctaatttttgtatttttagtagagatgggatttcaccatattggccaggctggtctcaaactcctggcctcgagatctgccggcctcggccttccaaagtgctgggattacaggcgtgagccactgtgcctggccctttttaagagggtctcactctgttgcccacgctggagtatagtggtgtgatcatagctcattgcaacctccaactcctgggctcaagtgatcctcccacctcagcctcccaagtagctaggaccatgggtgtgcaccaccatgcctggctaatttaatttttttttttttttttaaagagacagggtcttgcttgcaacattgcccaggctgatcttaaattcctggcctcaagtgatgccctaccttggccttctagagcactgggattacaagtgtgagccaccatgcccagctataccagtgggcttttaaatggacatttctttacctctggggatagtctcatttttgtgaggctcccaaggggaaagcagccatctgaccaaactagaaaactagcaggcttcagcccagtggaataacataaagtaggacaatcgatacagacaacattgattggccatgctttgagtgctgtggatagtgtgtattggaagcttaaggggccagctcataagtaagttgtaagtaagtatttaaggatgcttttttttttttttttttttttttgagacagagtctcactgtcacccaggtgtgagtgtgatcttggctcactgcaacctctgcctcccaggttcaagtgattcttgtgcctcagcctcctaagcagctgggattacaggtgcttgccaccatggccggctaatttttgtatttgcagtagagatggggttttaccatgttggccaggctggtcttgaactcctgacatcaggtaatctgctcaccccggtctcccaaagtgctgggattacaggtgtgagccactgtctctggcctaaggttgcttcttgtttttccccacaccccatctcatactcatggggagttgggtttgactgtattcttgaagttaagtctccatccttggacccagctgctaaagtctaaaatgattgtgttttgggctggaagatattatagagatctttatttccttgcaaacatcagggctggctgtttgtggtactgtggatgagtgaagagtcaggagatacacttctagttctgttactgcccaatgcctccattttgcatttgataggtttttatttttctgacgacaaaaactgagccccagagaagtgaagtgggccacgtaatggtaggatcttttttaggccacccacataatagtgggactctagtgttagagctgggacacaggctaggggtcttacaaagggtggccatagaagttgttagaattgtttaaagcattgtaaagatgcaggatgcttttgcagttaaaagtctcctgggaaggaggaggccctgtctccacttactgccttgtacatgatcttataccctcatggttgaagatttttgctgtcgtgctgtttttcctcctactcatgtcgaaatgtgtttctcttgctcttacctcagaggaaatgaatttgaagccttcctccgtgttagaaacaaatagtgctcaggccagacttgtgtgtttctgtaaagaatgaggccagatgtaacagtggaccttatctggtgatccaagcaaaccttcaagacatctctaagagaaagagagaaggaatgagtgtatttcagagtggtttaaacacactttggagtcagactcacttgtatttacgttctgatatctacttactagttgtcagattgtaagttacttattttctctaagccttagttttatgatctgttgaatgggaatagtaatatgtatttttatagctatcttaagaattcagagaatagatatggtgcttcctctggcacaatgtaaaacagcagtccccaacctttttggcactagggactagtttcatggaagactatttttccatggactgggggatgtgggggatggtttggggatgattcaagcacattatatttattgtgtactttatttctgttattattatttttgagacagagtctcactccatcacccaggctggagttcagtggcacagtcttggctcactgcaacctctgcttcccaggttcaagcaattctcctgcctcagcttcctgagtagctgagattacagatgtgtaccaccacacccgctaatttttgtatttttagtagagatgaggtttcaccatgttgaccaggctggtcttgaactcctgacctcaggtgatccacccgcctggacctcccaaaatgctgggattatgggcatcatgcccaacctatttctattattattacattatagtatgtaatgaaatatacaactcaccataatgtagacttagtgggagccctgagcttgttttcctgcaactagacggtcccatctgggggtgatgggagacagtgacagatcatcaggcattagattctcataaggagtgttcaacctagatcccttgcatgcacagttcacaatagagtttgtgctcctatgagaatctaatgctgccactgatctgacaggaggcggtgctcaggcgttaatgcaagcgttggggagcagctgtaaatacagatgaagctttgctcactcacttgctgctcacctccttggatgggtttctgataggctacagaccagtatcgggggtttgggacccctgatgtaaatgctctgtgttgtcatcattattgacaacaatagtttccagtttctgagccacgtcgtagtttcaggataggttatgctgaccaagcaagttttatcttaaccatcacctcattgttgtcttagttggtttgtattacatattatttataccaatagttataggtatttcatgctgaataactaaaagttgtgagtagcaaggaactttgctgcttctctgccatctccttccttactcagcttagtgcttatctttctcaggttctctcttgtcaggtgctcaagccagcaggccttgtttcgggggcagtgtctgatgaggggattttattggggtagggctggctagtccagagcctgcctggtccctcagatagtatgttctccttatctcttgctttctgctcttcagccagacatgaagcaattagctcatcaagggaatgttgacttttgtcactgctttcctctgatttgtatgctcatttctggtccttgtgcaaagtcacggaggcacagtcacatacactgacccagattttgtgctcaagttgactgtctctctctttgagatgtacaactggttccatgtagcaagggagtgaggaaaaagcccctggagccaatcccattattttgatctcaagttgagtttttaaaaaaatccaagcactatgactatagaccatgcctcacttctctgtatgaaacaaataaggtaaaaaaaactcactatttggagggaaggccaatctgaattggtaaacaataggaattagtacattcaagaaaatgccattgtctttttctttttagcgagcctctgcagtatcttttttacctagttttgttgcttcccctgtttcctgtgactgtgctccagaattattacagaagcgccctcttatttcttgcttttgcttcctccaggacactatataccactgccactttgggtcttcctatatattgtgcttatcagagaatacttatgcttggaagctgtattagtctgttctcatacagttataaacaaatacctgagaatgggtaatttataaagaaaagaggtttaattagctcatggttctgcaggctgtacagacttctgcttctgggaaggcctcaggaaacttaccatcatggcggaaggcgaaggggaagctggcacgtcttacatgtctggagcaggagaaagagagcaagggggacatgctgcacatttttaaatggccagatcctgtgagaactcacttttgtgaaaacagcaagggggaaatccgcccctatgacttagtcacctcccactaggcccctcctccaatattagggattacaatttgatatgagatttgggtggggacacaaattcaaaccatatcagaagccttcaatggcacccactagctcctgaataaattccaaatgtatcaggttgttggtgttccaagcctattgcagtgtatacccatcctaccattttaattaatatgtccgtaccatcacccacgtgtaccccttgctcctgatgaactgatccacgtggtcctctgagtatgcttcatgttggtgtctctgccagttcttttgcccagagtactctctccttagtttcctacttttttttttttttttaagatggagtcttgctctgttgccccaggctggagtggagtggcacaatctcggctcattgcaacctctgcctcccgggttccagtgatactcctgcctcagcctcccaagtagctgggaccacaggcatgtgccaccacacccggctaatttttgtaattttagtagagacggggtttcaccgtgttggccaggctggcctcgagctcctgaccttgtgatccacccgcctcggcatcccaaagtgctgggattacagacgtgagccactgcacccagccggttccctactttatgctgcagagctgccgccttcagtgagccttacctgatgtgtcctcatctgtatccccattgcaacacctttattatagaattcagcacacttttattatggtatgatgtttgtctctttttatatgagcttctcaaggatatgggttgtgatttaatgtgtctcttagcataatgctgagtgtaatatggataccataaatggttgttgaatggatgtttacatgaaaacttaagaaatgataacaatcctgttgaaatcctacttccctgaagcatttcttgattcccagccacagtgagttcacatgctccattcccagagccctttgtttttgaagcattggattccttagagtaagccttatacactcaattggattagaacttcctagagggcagacactgcatctgtcattcctcttcatgcatccaatccccagcacagtcctggcacatagagagtgttcaataaatgtttatgaattcaagagtcctgctatttggtcagctgatgtacttgccagtttagcctcctgtgttactcactggctaggagtctccaactcagatgtttttagggccaagttgggaacagagaggcaacagagaatggtaggcctgtgtcaaaccggagtgcttatgtgcttcatgaggggtggctgctactcagcctatcgtcatgggtgagtatggcctcctcatgtcatatgggaggccagatattcataatctctagggactaccaaagcatatttgtggtctagatttgacctataggctacccatctgtatcctttaggtagaggctggagtttcacacatttaaattccttgtaaaataataaaggtgggggaggggaggacatagcttgaaaacttttgagggcgtttggtgaaagcctatctttagataaaagtgtcctatgattttctgtgggtagtgacttaatctcttgggttcggccctgtagaacatctatggtctgggctttatcctcccttatattctgatttcactgggctatgaaaagcaacttttgtccctagaaaggtggtgactcaagaacttttgcactttttgcccttttgctcagcttccactgaggcaggtttgatagttgttcctgcttctggctactttgaagggcctggtggtcaggctggtgcagcataaggtcccagaggccacttctgttaatgacatctctgagaaagagctctgggtgaacaaatacaactaaaagggaaatacattgtacagaatcactgcttaaatgtggtcagccaaggggcaaaacagtataatagccagaaggaagtctgcatctccatggaaccttttgcaaggtgatatcttatcctctggctgtctcatttttttcatagtccctaagtgccccagcagtgcttacttgcctggcatcaccttctaggtctgagagtgttgccacaaatgatatccccatctccagtagaaattagctgcctgggatatctcgggcagactacatgagaaactgaaagcagtgcagtttgtctctagtgagaggccctgggtaactagagaattgggaaggagggagacttacttttcactatatgtctttgtgtgccttttcaaatttgaaacatatgcatatacagtaagtcctcacttgacatcggtcataagttcttggaaactgtgactttaagtgaaatgtatacaaaaccaattttactatggctcattggtataaacaagagttaagttcctacagaatatttcttgttacagaaacatgaccaaacttctaaataaagaccaaaacacttctaatattaaaaactgagataaatgtgagctatacattcctttaagaaggattaacaaaaacaagtgagataattactaccctattagttcagggtcttgggtggccagagcccatcccggcagctcagggcaccaggcaggaaccagccttggacaggatgccatcccatttcaaggtacactcacacaccctgacactcatgcagactggaccccttacacgcaacagtgaacctaacaggcacgtcttcgggatgtggaaggtgactgaggacttggagaaaacccacacagacatggggagaataagcagactccacacaagcagtggccctggctgggaaacaattatttttttctcgtcggtgttataaggaaataatgttgatcgaagcaatgttatttggagacctgctgtattgttattttttaaatgtagctgagcagacccatgtgtggtcttctcttcaaattttactctgtcctcactttattcctgacatatggatttctctgtaaacaactggacccagtcgctgtagactgcctctcagatgtgacagcttggcctctctgctccctagaaatgtcctagggtttctcatgcaggggtctttggaataacaatcaggtgtaaagtatgtgcaatattttactgttttcaaattttactgttttcagtctgattcttatgacatccccatttatttattttttagttgtagtttttttagagacaacatctcactcacacccaggctggagtaacagtggtgtgatcgtagctcactgcaacctcaaaatcttgggctcaagatatcctcccacctcagcctcctgagctgggactataggcatgtgccaccatgcctggctaattttttaaaatttttttgtagagatggggttttgctatgtttccgaggctggtcttgaactcctggcctcaagcgatccttccaccttgacctcccaaagtgctgggattataagaatgagccactgtgcctggccacacaacacccccattttatggtggtaaaatattgaggctcggagagtctaaatgacccatttagggtcatactgctagccagagtagggctgtgactaatccaggtagctttgtctcctattaatgtaccttgttcttagttcttgtagcaatgaggcagtcctctttggaattctttaccatttccaggaccattgcagttagggcaggaatggagtggtggtgattcctctttcctcttttggtttgaaccctcctttcaggatgcttagttacacaggcctgtcctctctggaaaaaggggatcagtagtaggtttctccactttttggagaaacctaaactaaagcttcaatggggcaataccttttaggagagtttgaactgacagtctggcttcctattctttgcggagagttattgctgctattaggcagagggctttgtttccaggttacaaatctttttagcaaagaagtgagtgtggaatagaattggaaggacttgtgtagtccttggatataatttaatgctccacatcccagagagagtaaacattgtaaagtgtgcaagatgggtttggattaatatcctgacagcatgtggcttggcatgtagggcattccttggagacccttcttaccatacacagcctgcctttgccgggtggcctcttcccacaggtcttcccagcagctgttgtgcacctgggtgaatcatccgcttccctgtgctttgaaaaaacccattttaactgatgaaagccctcatacaggaggtgcaataaacagacaaccttgaaaatgttttttagtacaacctaagctgcctctgagtttgtccagggtattcacctccattaggagcactggctgattctcacctctggtctcttctgaatagaatatggaaaatcaccttgccctttctactctgctgcacctgacatcatgggtgtggaaggtctctggaaactccggggaggcaggagcaccatggacatggagggaaggctcatttgcttctaaggaccatgcagaaatccttggctttttacttctgttagtcctacttaaatcagaatttaaagccttcaaatagaattctgtgtatggctgacatagcatggagtagggaaggcttctttgtaatttctgaggagaacttgggggcatgtagaggtcatgcttaggttctttccttacccagacctgacctgtgccgggccagagaggtttgccctagaaagctgatgacttaggaccttactggtgtgcagctttgcaggcctgtaaacttagttagttcatccaggtttcagttcctgggggcctgcctcaggcatgtgaaattcataagagaccatcaagtcacagttccagttaactaactccaataaacatgacgactaagttgatttatgtggacatgtaagagcatctctcctctgtaggagagattagctgggaagccagctcccctctggaggaaaccaaggcaaattatggtggcaagcttttgggtcatagcatcagatacacccagatttaaaccatgtaacagctgtgagacttcagaggagctactcaacccccctgctcctgtgtcctcagctgtgaaaccccctgggtttttcagatatatacatggtaagcactcaataaatgttttgtctcacttgtttctcactcttccctcttccccttttctccttcccactttgtccttctagggctatattgtaatctgaccagaatacacttgtcagtctattaaggcaccaggtactggagatagactcatttttattctcttggctccctttatatattctttgccgtccacggctcttttgttaccacaggttacaataggaacagttagattctagctcttgtcagtggcttccaacctaagggttctttctggttaccattcagtccaccattatttgctgagtacccattgtgtgccaggacctgcttagccctggaaatacagtgatgaatgagacagatgtggtccatgccttgagtaacacctcttcaaaccccctccttagataggtgacttctgtggatgactcgccctgctcattccgtgttgcgtcatattaatttccttctgagagggcaatcttctccttagacctagggaacagtgcctttttgtgctgcgtggaccttgcctgctggcttgcctgctcccaagcaatgagagcagcgtgttgaggctgaaggagaaagccccccgggctactactgccctggccacacatgtcccaagaggctgcacttggcacttctgaatgttccttttctccttgcacacagattatagtgtttactgctcgtttaaattcaaataaccttccacccccttctctgccttaaaaaaaaccaaaaaaacaaaaactgtgtattacagtgtagaaaacaaaacaggccagccctggtcccctggcgaggtttgttttaacatcattttttagtgaagccttgctatgggttgcctttactttaatagggctaatgtgtaattcaggcatattgatagtctgcagttaaagaatctcacatcttttttctaccttgattgtcatcaacagtgtgaaaggtagatgcaagggctttggctgacaggaggtgggacttctctgctttggcctccagactctatcctggactctggcgggtcctataaagaaggctgagcagccagtttagtgatttctcaacttcaaaatagaagcctggagatagtcctacccctcctctcccttctgccaattttaccagcaattgccaagaactgtgtgtggggaaccaggcagaatgactctctggaaatcatttgtttgagaactcccagtggaggaatgcattttcctgtgcttcttctcttgtgatggtgtgtgctgttgtgatttggtactgcttgtccctctgcagtactgagacttgtatataactcctccagccctgcgggggttttcaacaataaattgcttgctgggtagtatttcccccaaatccctgggagagcaggggagcatgttaacaattagggacctagttgagcctctgtttctggcactgtgactagaggcatggtgggtgaacccagatgagccatgtttcccactgctgctcgggctgggcatttattgcagttggatgtaacattaagagtcacactagaggcttggttggaaaggagagagcactgcataattattgcttatgtactgtttaaacctatcagccaacagatgtcaagtgcagaaaaaaagcacaataatgttattataatggcataatagttatcattataataatcagctggcataggttttgataagaggcagatcctgaaatgagtgcagggggaagggttaaccttgaactacagcacaatgaatggctgcttaaccttgcagaagatgctgtgtagaggcaggtgactcaggtatggagttgctaccctctctgcctagctagaggagctatggagacttcagctgggattgtctaccctgcaggtactgtctttctgatggtgtgatggagcacaccatcctttggtttaaggcatgctacactgcaggaataccatactagtgcccagagctgtgggttctgggaaatgcagagacttcatcactgtggtctcattttgggttttcagaaaatccagcctcatgcccatagttgcagatgatgaattttgctccctacaacaaactgtgctccaaacctaggaagtggtggtgcatctcagttttgtatgtatcaattgtggtgggttgtgctcatggaagacagacttttctttgccagagagcttaccaggagctacattcccaattctggttaggaaggtggtggtaaaggggtgaggagcagagtggggctaatagatgacccacaaaggcagcattggggtaggagaaaaaagtctgattcaggcaaagctgggtatgatttttttttttttttttttttttttgagatggagttttgctcttgttgcccaggctggattgcaatggcgtgatctcggctcactgcaatcttcacctcctggtttcatgtgattctcctgcttcagcgtcccaagtagctgggattacaggtgcacaccactatgcctggctaatttttttgtgtttttagtagagatgaggtttccccatgttggtcaggctggtcttgaactcctgggtctcgaacgcctggcctcaagtgatccacccacctcggtctcccaaagtgctgggattacaagcatgagccaccgtgcctggccaacttttttttttttttttttttaaagagacagggtcttgctctgttgccctggctggaatgcagtggcacagtcttggctcactgcagcctcgacttcctgaggtcaagagatcctcccacctcagcctccctagtagtgggactacagtcatgtgccaccacacctggctaatcttttaattttttgtagagatgggatcttgctgtgttgctcaggctggttttgaactcctggtttcaagtgatcctccctcctctgccttctgaagtgttgggattataggtatgagccaccacatctggctgtgggtgtgacccttgaccttaccattcaatagttggacaagttgcttaacctcgctgagcatcagctacctatctgtgtatgtgcttattcatttcccatttgttttttattaatagccctgtctataaagtacctgtcactatgcctggcactaagtggtgctcaaaaaatacttctgcctcccttcctgccaccccctacctgcctaccctacataagagaagggtaaggagaagatcctcctgcttctgtagagggaaaatggccttaattagagctttatgtgaacttctttagttgctgatattgcttttctgagccacaatctgtggacctcctctgaagctgcctcatcaggagcgactttgatatttagtgtttgggcacatctctgcttcatccaaggagtaaaagagggtttaaaatctcatcagggcacagaatgcctgcttctgcccctgtagccttgcctcccctcccttctttctttgggtgggtcactcggggggcactgtctgccctggggattactcatttctttcagggggtcctggttgtttggttcagtgtctttactggggaaaggcttttgtgtttgtgcctgcctgggcctgtgctgggaacttttattttggaagcctggagcactcagacaaggtgatatctttttagactgtttctggctgtaggccagcttatcactatggctaccaccagcttaaagaatgtcaggacagaaagtaacttctgtaagaaatttgggagagaaagggggaaggggagagaattgtttggcttaaggtcatgtagggaggagaacagctctaagtagaactctttgatttggatacagcttcgttttccttctctctgaaattttattttttcagtcaacaaatgtatataaaacatctgttacattccagagactgttaggccctgagatacagtgtcagatagggttccagcttagagtgtactgatgaatatgtcaaagttagtaaaattacacttggaataagtgtattgaaagaaagagttaagaacatctgagagggatttgacttggtcctagggctaagagggtatcatagaaggcttctttgaggaagtgatgttcgagtaaatattgtgaagaccaaacaagtatttaccaagcagagtgacaggacgttgaggaaaatttcaggctgagggcctggatttgcaaaggctctggaagcaggcagtgggtggggagttttatgaggaactgaaagtatggttggagcacagagagtgagaggagccagctgaggttggaggggttggtgagggcaggccttgtcagctgtggcatggcatttcatatttacctggagaacaggggaagcctttggagagttggtggtggttttggtggttttggatttgcaaatgagcagcacccttttggacactggatggattttgttgagggagtgaaaatgaagatcagaaaaggaacattactgtaataggttgttttccttcagtcagctaaatggcaatcttgagactaatctcctttagtgtggccttgttcctcctgattcatgtgctctctcagtgccagtagtcagtgtgttgttggggcacctggccactcagcagacatggtggcccagggtgccagcacttggcatctttccatctgcacagaaaaaggcctggaggtttcaggcttgtcacatgttaacggctgacagctacagagtcctttgtaacctgctgtgtcaccatccctctcttggctgtcactactgggtaagggctacccccttcaccttagaccacttaagccactgacactggcaactcccagagatgtgatgtgccaagttagcaaagccagcacctgtggtttgtgtaacattcagttctggttgatgtagatgtgcacatgttctctcttggcagcaaccaatgtctggagggccagaaatgggctggagttgttcctcccactgtgtgtccaggaaaactgaggtttaggagttgcctgtggtataaagaaaactgggtcagagttacgtgctgccagaccaagtgttaagtgcatggtgggcgggtatagaccctagaccagactctttagtgatactgtggccttgcccactactcctttcacttattcatctggaaggccatgctgcatagtggttaggagcttggcccttggactggggctgactttagttagaatctcagcttctcggctgggcgcggtggctcatgcctgtaatcccagcattttgggaggccaaggcaggtggatcacgagatcaggaattcgaaaccagcctgaccaacatgatgaaacctcatctctactaaaaatacaaaaattagccaggcacggtggtgtgtgcctgtaatcccagctactcaggaggctgagatagcagaatcgcttgaaagcaggaggcggaggttgcagtgagccgagatggtgccactgcactccagcctgggtgacagagccagtctcaaataaataaataaataaataaataaaataaaggccaggcgtggtggctcacgcctataatcccagcactttgggaggccaaggcaggtggatcacaaggtcaggagatcgagaccatcccggctaacatggtgaaaccccatctctactaaaaatacaaaaaattagccggctgtggtggcgggcgcctgtagttccagctactcgggaggctgaggcaggagaatggcatgaacccagaaagcggagcttgcagtgagcgaagcttgcgtcactgcactccagcctgggcgacagagtgagactctgtctcaaaaaaaaaaaaaaaaaaaaaaagaatctcagcttctccacttggaagctatgtgaccttggactatttactttgctttcctgcccattaattttctcagctctaaatagggaataatgatagtgccatggtctgaatgtgtgtcccctccaaattcatatgttgaaacctaaccctcgaggtggttcctctgggaggtgattaggtcatgagggctccaccctcatgaataggattagtgcccttataaaagaggcccgaggagcttccttgcctcttctgcatgtgaggacccagtaagaaggtgccatctatgaagcagagatccctcacctgacgttgaatctgttggcatcttgttcttggacttccaagcctttagaattgttagcaataaatttctgttatatataaattatccagtctaaaatatttttattttatagcagcctgagtggactaagatagaaattggttctgagaagtagggtgttgctataacagatacctaaaatgtggaagcagctttggaactgggtaatgggtagaaggctagaggagttttgaggtgcattgccatgaaaggagccttaagggtaattccgacgaaggttcagaagagagctgtagagaaagcctccgttttcttagagattatctaagtggtcttgatcagaatgtagatagaaatctggatggtaaaggcccttctaatggtgcctcagatggaaattaggaacatgttattggaaactgaaggaaaggccaccttcttatgaagtggcaaagagtcagggtgcagtggctcatgcttgtaatcccagcactttgggaggccgatgtgggaggattgcttgagaccagggttttgagactgcagtgagctgtgattgtggcactgcactctagcctgggccacagagtgagacactgtctcacaaaaaaggtcataagagaaacaggtctgtagttttcttttttttttctttttgagactgagtctcactctgttgcccagatcatgcaatggcaagatcgtggctcactgcaacctccacctcccgggttcaaatgattctcatgcctcagcctcctgagtagctgggatcacaggcatgcgccaccacgctcagttgatttttgtatttttagtagagacgggttttcaccatgttgcccaggctggtcttgaagtcctgacctcaggtgatctgcctgcctcggcctcccgaagtgctgggattacaggcgtgagccaccgcgcctggccagtctgtagttttcttgtagtgtttgtctggctttggtatcagagtaacgctggcctcagagaataaagtagggaatattccttcctcttcaatgttttggaaaagtttgagaaggattgatgttagttctttaaatgtttggtgaagccatcaggtctagggctttgctttgttgggagatttttgattactggttcagttggcttgctagttacaggtctgtctgttcagaatttctatttgtttgtgattcagtcttggtagattttggttctatgaatttgtccatatctaggttatcaagcttgttggtgtacacctgctcatagtacactctttttttttgtttgtttgttttgagatggagcttcgctcttgttgcccaggctggagtgcagtggtgcgatcttgctcactgcaacctccgcctcccggcttcaagcaattctcctgcctcagccttctgagtaactgggactacaggcgcgtgccaccatgccagctaatttttgtattttttagtagagacggggttttgccatcttggccaggctggtctccaactcctgacctcaggtgatccacctgccttggcctcccaaagttctgggattacaggtgtgagccactgcgcctggcctagtacactcttataatccttttcatttctgtagaatcagtggtaatatctccactttcattatttttttcttttattctttttttttttttttttttttttgagacacagtcttactctgtcatccaggctggagtgcagtgacatgatgtcgcttcactgcaacctctgcttcccatgttcaagtgattctcctggctcagcctcctgagtagctgggattacaggcacataacatgatgcccggctaatttttgtatttttagtagagacagggttttggcatgttggccaggctggtcttgaactcctgacctcaggtgatctgcctgccttggcctcccaaagtgctgggattacaggctgagccacttcaccctgcagtcttttttgtttttttttgaaatggggtcttgctgtactgcccaggctggtctcaaactcctgggctcaaaggatcctcctgagtacctggtaccacaggcatgtgccaccatacctggcccaactttgatttctgattttagtaatttgagtcctctctctctttttcctttttgagacagggtctcaccctgttgcccaggctggagtttggtggcgtagtcatgacctcctgggctcaagtgatccttctgcctcagcctcccaagtagttgggaccacaggcacctgccaccatgcctggctaattttaaaattttttgtagagatgggatcttgacatattgcccagacgggtcttgaactcttgtgcttaagcaatcctatcttggcctcccaaagtgctaggattataggtgtgaaccactgtgcctggcctgttttaaaaaagtccatctaggtaaaggtttgtcaattttggtgatcttttttgcataaccaccttttaggtttgttgatttttttctattatttttctattctctatctcattgatcttagctctgatctttattattattttctttcttctgctagctttgggtttagtttgcatttcttttttcagttccttaaattgtaaagttaggttgttgtctgtgatctttcctgtttttttttttttcttttattttttgagacagagtctcactctgtcacccaggctggagtacagtggtgcaatctcagctcactgcaagctccgcctcctgggttcacgtcattctcctgcctcagcctcctgagtagctgggactacaggcacctgccaccacgcccggctaatttttttttttttttttttgtatttttagtagagacggggtttcaccatgttagccaggatggtctcgatctcctgacctcgtgatctgcctgccttggcctcccaaggtgctgggattacaggcatgagccaccgtgcctggctgatctttcctgttttttaatgtacacattatagttataaatttctcctttagtattgcttttgctgtgtcccgtgtaagttttaggtatttatttatttatttttgtttatttttaagacagcgtctcactctgtttcccaggctggagtgcagtagcatgatcttggctcactgaaatctctgcctcctgggttcaagcaattctcttgcctcagcctcctgagtagctgggattataggctcctgtcatcacccccaactaatttttgtatttttagtagagatggggtttcaccatgttggccaggctggtctcaaactcctgacctcaagtgatctgcctgccttggtctccaaagtgctggtattacaggcttgagccactacacccggccctcattttttttggtgtatattctttagctattttctgtgtggttgccatgggcattacatttaacatcctgaagttataacactgtaatttgaatttataatagcttaacttcaatagcatagaaaactcggcttcttcaacagctccatttctcacccctttcagttgttgatgtcatgatattgcatcttacacgttgtgtgtctaaaaacataacctatatctatttttttaatgcattagtctcttaaattatgtaaaaacaaaatgtggtgttgcaacatcctgggggtgaattctagggtaggctgtcttctttgggatcatgggggcatcagcgggttctggagtgggggcagagatgtgaggcattatctaaaattggaaatgtcacagaggatagagaaaaactcccctcagcacttagcagtgaatctgggaccagctggtgttttgctgcctgtcttcactgtggccgcaacagctggcagccattgcggctgccatcttgggagtgggtccctccaaagtttctgatgagagatctccttatcttattgaggatccttgtgtgtaatgagttgcttttctccccttcaagattttgtctttgtctgtcttttttttttttttttgagacggagtctcacgctattccccggccggagtgcagtggcgtgatcttgcctcactgcaacctccacctcccgggttcaagcagttctcctgcctcagcctcccaagtaactgggattacaggcacctgccaccatgcccagctaattttttgtatttttagtagagacagggttttgccatgttggctaggctggtctcgaactcctgacctcatgatttgcctgcctcagcctcccaaagtgctgggattccaggcatcagccatcatgcctggctctaagccaccatacctggccctttgtctttcaacagtttgattataatgtgtcttggtgtgagtctctttgtattcatcctgtttggagtttgttgagcttttcagatgtttatgttcgtgtctttcatcaaatttgggaaattttgtaccattatattttcaaatgttctctctgctacttatcttttctttctgggactttcacaatgtgtatgttggtctgcttgattgtgtcccctaggtcccttagtctctattcacttctcttcagtctttgtgcttcttttcctcagacttgataatttccattgtccagtctccaagtgttctcagattatttcttttgcttgctcaaatctgcctttgaattcctctagtgaattttttatttcagttattgtactttccagctctagaatttttggtttctttttaagatgtctgtatctttattgatattttaatctttttccaaacattgttttcttgatttttctccatgccttcctttagttctttaagcaactttaaggctgttgctttaaagtctttgtctagtagatctgccattaggtcttttcggggatagtttcttttggtttattttttttctttttttttcttttttattttttttctttttatttttttttattgatcattcttgggtgtttctcgcagagggggagttggcagggtcataggacaatagtggagggaaggtcagcagataaacaagtgaacaaaggtctctggttttcctaggcagaggaccctgtggccttccgcagtgtttgtgtccctgggtacttgagattagggagtggtgatgattcttaacgagcacgctgccttcaagcatctgtttaacaaagcacatcttgcaccacccttaatccatttaaccctgagtggacacagcacatgtttcagagagcacagggttgggggtaaggtcacccatcaacaggatcccaaggcagaagaatttttcttagtacagaacaaaatgaaaagtctcccatgtctacttctttctacacagatacggcaaccatccgatttctcaatcttttccccacctttcccccctttctattccacaaaaccgccattgtcatcccggcccgttctcaatgagctgttgggtacacctcccagatggggtggtggccgggcagaggggctcctcacatcccagtaggggcggcggggcagaggcgcccctcacctcccggacggggcggctggccgggcagggggctgacccccccacctccctcccggacggggcagctggccgggcagaggggctcctcacttcccagtaggggcggctgggcagaggcgcccctcacctcccggacggggcggctggccgggcgggggactgacccccccacctccctcccggacggggcggctggctgggcagaggggctcctcacttcccagtaggggcggctgggcagaggcgcccctcacctcccggacggggcggctggccgggcggggggctgacccccccacctccctcccggacggggcggctggcctggccagggctgacccccacctcccttccggacggggtggctgccgggcggagacgctcctcacttcccagacggggtggctgccgggcggaggggctcctcacttctcagacggggtggctgctgggcggaggggctcctcacttctcagatggggcggttgccaggcagagggtctcctcacttctcagatgggggcggccgggcagagacgctcctcacctcccagacggggtcgcggccgggcagaggtgcttctcacatcccagatggggtggtggggcagaggcgctccccacatctcagacgatgggcggccgggcagagacgctcctcacttcctagatgggatggcggctgggaagaggcactcctcacttcctagatgggatggcggccgggcagagacgctcctcactttccagactgggcagccaggcagaggggctcctcacgtcccacacgatgggcggccaagcagagacgctcctcacttcccagacggggtggcggccgggcagaagctgcaatctcggcactttgggaggccaaggcaggctgctgggaggtggaggttgtagcgagccgagatcacgccactgcactccagcctgggcaccattgagcactgagtgaaccagactccgtctgcaatcccagcacctcgggaggccgaggctggcggatcactcgcggttaggagctggagaccagcccggccaacacagcgaaaccccgtctccaccaaaaaagtacgaaaaccagtcaggcgtggcagcacgcgcctgtaatcgcaggcacttggcaggctgaggcaggagaatcaggcagggaggctgcagtgagccgagatggcagcagtacagtccagcttcggctcggcatcagagggagactgtggagagagagggagagggagaccgtggaaagagggagagggagaccgtggggagagggagaggggagaggggagagggagtagagcttttttttttcttaaatataccatacttgggccgggcgtggtggctcacgcctgtaatcccagcactttgggaggccaaggtgggtggatcatgaggtcaggagtttgagaccagactggccaatatggtgaaaccccatctctactaaaaattcaaaaaattagccaggtgtggtggtgtgcacctgtagtcccagctactcgggaggctgaggcaggagaatcgcttaaacccaggaggcggaggttgcagtgagtggagattgtgccattgcactccagtccagcctgggcaatagagcaagactctgtctcaaaaaaaaaaaaaaaaaatctatctatatacacacacacatacacacacacacaccatacttttctgtttcattgtatgccttgtgttttgggttcaaaactggacatttgaatataataatgtggtaaccctggaaagcagatcttttgcctttcccagtgtttgtggttttcgtttttgtttttattgtcataggctttgtgtgctgaggatcagcctcaggtgtaaacttaaggtcttctcaggtctcttttgagcctgcactttcccctgggcatgtgcagtgactttctgattttccttacacatgtagatgccttaaaaacatttttgtttagaggcaggatcttgctatgttgtccaatcaggagtactgggactattcatagacatgattataatgcactataccatccaactcctgggctcatgcaatcctcccatcccagccttttgagtagctgggactacaagcatgcatgactggacaggcttatgtagttgcctttaaaaattcagtttttttttttttttttgagacagggtcttcattgcccaggctggagtgaagtggtgtgatcacaagtcactacagccttaacttcctgggctcaggtgattctcccacctcagcctccagagtaactgggactacagacacgtgccgtcaggcccacttaattttttgtagagatggggttttgccatgttgcccaggatggtcttaaactcctgggttcaagcgatctgcctgttttggcctcctatactgggattacaggtgtcagtcactgcgccttgcttgaatgttctttaatgtctgactcccaaaaggtgaaaaagataaatgatcaggggaggaaaaaaaaaagcattggccctttaaatctccaggaagtcacttcagcctgagggaaaggggcttgcaaccgggctgggaggagcaacaacaatctctgctactactttgtctgcacctctgtaatcagaagcagcaatcagaatcagcacagatccccagtatttggaagacagtgttctttttgtgcaagctgtgtgcaagctgctccaggaacacatacacaactacctgccgtgaagttgggggaaacgtagctgctactctgctaagagttgaaattgatagacattaactgcaatttgccatcaaggcctttccctggaagttgcaaggcttcagttgtttccagagttccaaaatacagccatacttcacttaacaacagggatagttctgaaaaatgtgttaagtgatttttgtccttgtgcaaacctcataaagtgtacttacataaacctagatggtatagcctaccacacatctaagctttattgtatagcctcttgctcctaggctaaaacctgtacagcttgctactgtactcaatattatagacaattgtaacacaatggtaagcatttatgtacctaaacatttctaaacatagaaaaggtacagtaaaaatgtagtataaaagataaaaaatggtagctgcacacgggtgtcacatgcctggagtcccagctacttgggaggctgaggtaggaggattgcttgagcccaggagttcaagatcagcctgggcaacagaaggagaccccaacctattaaaagagaaaaaataaaaagtagtacccctgtacagtgcacttaacatgaatggagcttgcaggactggaagttgctctaggtgagtcagtgagtaagtggtcagtgaatatgaaagcctaggatgttactgtatactactgtagactttataaacactgtacacttaggctacgctacatttataaaaaattttttcttcaataataaatgtagctgtagcttactgtaatatttttactttatatactttaaaatttaaaactgttgactcataataacagcttaaacaaatgcatattgtacaacggcacaaaaatatttatacattattctgtaagcatttttctattagcagtttttaattttactttttaaactttttttgttaaaaataaagacaaaaatacattagcctaggtctacacagggtcaggatcattaacatcactgtcttctatcttcacatttagtcccactggaaggtcttcaggggcaatcacacacttggaactgtcatttcctgtgataatagtgccttctggaaagacctgcttgaggctggtttacagttaactttgtttttcttttaaagccactccttggctgggtactgtggctcacgcctgtaatttcagcactttgggaggctgaggcggggggtgggggttacttgagcccaggagttcaggatcagcctgggcaacatggcgaaaccgtgttagtagtctctactaaaaatacaagacaaaggctgggcgcggtggctcacgcctgtaatctcagcactttgggaggctgaggcgggtggatcacaaggtcaggagatcgagaccatcctggctaacacggtgaaaccccgtctctactaaaaatacaaaaaaataattagccgggcgtggtggtgggtgcctgtattcccagctacttgggaggctgaggcaggagaatggtatgcacttgggaggcagagcttgcagtgagctgagattgtgccactgcactccagcctgggcgacagagtgagactctgtctcaaaaaaaacaaaaacattgccaggtgtgctggtgtgtgcctgtagtgcccgttacttaggaggatgaggtgggaaaatcacctgagcctggaaagttgaggctccagtgagctgctatcatgccaccgcactccagcctgggctatgggaatgagatcctgtctcaggaaaaagaaaaaaagtcactccttgcccaggctgtaatgcaatggcatgatgatagcccactgcaaccccaaattccttggctcaagcagtcctcctgcctcagccttccaagtagctgggactacaggtactcatcaccacgcctatttttgtattttttgtaaggacaggatcttgctatattgctcaggctgatcttgaacttgtggcctcaagggatcctcctgtcttgaccttctaaagctctgggattgcaggcatgagccactatgcctggcccctcttaaaaaataagtagaatgagtaccctctaaaatagcaataagaagtatttaatggtaaatactaggtgataggaatgtttcagctccattgtcatcttatgagaccactgtcgtataagtggtctgttgttgactgaaatgtgcagcacatgactctgatttatatcagacaaattctgtcagtgcagttgttgtctagttagggagacagatttctgtgctgttgacgaagagttagactctgtaaaatattttttagagacttattctgagccaaacctgagtgaccatggcccatgacatagccctcaggaggtcctgagaacatgtgcccaaggtgttcggggtacagcttggttttatatatttcagggaggcacaagacatcaatcaaatacatttaagaaatacaggccaggcgtggtggctcaggcctgtaatcccagcactttgggaggcctaggtgggcggatcttgaggtcaggagatcgagaccatcctggctaacacggtgaaactccatctctactaaaaaataataaaaaaaaattagccgggcatggtgggcatgtacctgtagccccagctactcaggagtctgaggcaggagaatcacttgaacacaggaagcggaggttgcagtaaaccgagatcgtgtcactgtattccagcctggtgacagggtgagaccccgtctcaaaaaataataataataaaaataataaaaaagacagacattggtttggcctgtaatcccagcaatttgggaggctaaggtgggcggatcacctgaggtcaggagttcaagaccagcctggctaacatggtgaaaccctgtttctactaaaaatacaaaaaattagccaggtgtggtggcatgtgcctgtaatcccagctagtcgggaggctgaggcatgagaattgcttgaacctgggaggtggaggttgcagtgagccgagatcacacatttgtgctccagcttgggcaacaagaatgaaactccatctcaaaaaaacaaacaaacaagaaatacattggtttggttcagaaaggtgggacaactcaaagtgggggcttccaggctataggtaaatttaaacattttctggctgacggttgagtttatctgaagatctgggatcaatagaaaggaaatgtttaggttaacataaaggattgtggagaccaagttttattgtgcagaggaagctctcaggtagcacacttcagagagagcaggttgtaaaatgtttcttatcggacctaaaagaatgcgtgactcttagttgattatctcctggatctggaaaggaaggaaggaagaaaggaaaacaagggggtaggggattctctatagaatatgtggatttttcccacaagggatcactttgcagggccattcaagatatggcagagaaacatgttttggggtaaaatatttttattttcttccttgttatgccagagtcagattggaaagtaagtctcaatatacatggttaaataaaacccatctgatgagaatttactgtttgtaggacatgactccccagaccttttagataggaatttgggccagataaaatcagagtttagtcctcattgctttctactctaccatcttcccacctcttccttactagcttttggactttgttcttattacttctgtgacttagtttcttcatctgaataagtgtgtactgatacccacctcctagggcagttaggatgaaatgaaataatggaggtcatgtgcttggcacatggtaggtgctcaatgaatggtgaagattgtaatgcctttaaagagctcaagtttcattagggacagaacccatgggcccgaccctaggggctgagagaggctgactaacgacatggggacagtggggttgggtttgccttgttagggaaggttcttggagaaggtatttggagtcaggcctcaatctgtgtcccttactggggaaggtgagcggctccttcaagtagagagaaggcaatgggcagaagctttgagtagtaaccagaaagaactgttttttctcttccctcttgtgagggaagggatggagtcattagagaaagtagctggtgcactggctcttttgagtcagagagacttggagtcccttcctggctttgtgccatgtacatgttgcgtggcctttggcaagtcatttcccctcctgtctgaactttggttactttatctgtaaaatggagatgataatatctttttttttttttttttgagacattctcttgttgttgcccaggctggagtgcagtggcacgatcttgtcttactgcaacctctgtctcctgggctcaagctattcttgtgccttagcctcccgagtagctgggattacaggcttacgccaccatacccagctaatgtttgtatttttagtagagacggggtttcaccctgttggccaggctagtcttgaactcttggcctcaagtgatctgcccgcccagcctcccaaagtgctggaattataggcgtgaattataggaattataggtgagatgataatatctacttacagtgctggatgaggatgaaataattgcaattttaaatggcaaaaaccacaattacttttgcaccaacccaatatttaatacatttagtacagtgcccttcacttagtgcatatttaataactgataaattaaaaaatagtgaagcagctgggcatgttggctcatgcctgtaatcccagcactttgggaggccgagacgggcggatcacttgagcccaggagttcaacaccagcatgaccaatatggtgaaaccccatctctaccaaaaacacaaaaaatagccaggcgtggtggtgggcacctgtaatcccagctactcaggaggcggaggcaggagaatcgcttgaacctgggaggtggaggttgcaatgagacgagatggtgccacttgactccagcctgggtgacagagcgataccttgtctccacaaaagaaaaaaccgaaaaaaaaacaaaacagtgaagcatttcttttggggaaattaagctgttttaaatttctgtggttagataacttttctgaaaagtcagtttccatcttggaatcagttatcagtttccctcaatttcttaaggagcacgtcaccttgctgcctgacgccctttgggctcaccatcatacttagaatcaactccaaactccttagcctggttataaggcctttcatattccgatccctgcctgccttccttggcagctttatctcctaacctcccctactcccttctgcttgccttctgtgttctggacacagtaacttactttctgcttcttaaacagagggcctttgctccacctgtaccctctgcctagaatatttttctctcgtcttcattggatgagctctttgtcattctcagctcagttctgctgttatttacaagaaaggctcttccttttatctggtataaagtgactacttaagtcaccataacttaaccacttgatatttttcttgcttttctgcttcttgttgactctgttttccctccactagaacgtaagtttcatgagagtagggacgagatctgtttgtcacattcacagctgtattcccagtcctaggaaaggtacctggcatatagtagatgatcaaacaacatttgttgaatgaatgagctgtgaatgagaatgtgttcttttattacgctgaacctgggtacacaggtgttcacattcacattcctactgctttgttccttaaataaatgtaatcaagatgattttctttcttattcattaactattgtgctcctccactcccattaattggaacagtctgtggagaggccattttccccttccttcgttttatgtggctctctttcttcctagcattttgttactggaagggggagtttgtggttgctaggctttgagcattgatttttaggatttctgtcataaggaagcaagctttagtgaattggtttggaataaaacaaacacaaaagctcaccaggaatagcaaatttatctcactctgattttttactgacattttttgtagtactccctaagttcttagataaggtcattagacaggaattgacaatggccagatagaaacaaattcacagaatgtgagtgggtggcagggtgagacatggagaggtcagaggggatagtgcttctctttctggtagtggcctggtttttcatggcaaatattggccagtgtaactgttctcctttcgtagggcctgtatgtttgggagctgtagagactgtagggggactgctcagtgctggtgtgcccacctggtaaggcctaggcaatcctaatttttttttttttttgagacagagtctctctctgttgcccaggctggagtgcagtggcatgatcttggctcactgcaacgaccacttcccagcctcagatgatcctcccacctcagcctcccaagtagtggggactacgggagcgtgctaccatgcccagctaatttttgtgtttttagtagagatggggttttgccatgttgcccagtctggtctcaaactcctggactcaatctgcccacctcagcctcccaaagtggtgggattacaggcatgagccaccgcacctggccagcaattctaattctttgcttttctagggaagtgctccaagctcctgggagtaaggaagatgtgggactctggtcacttttgaaaacgtttgagtcctaaatgttattggtgctcaaagacctggttcttaagataataaaatcccagggatggatatgagaaagagagagtgtctagaacagggttagccgacagatgttcattagctttcccaaaaacaattctttgtgtgttgagaactgtagccctgcagatactggtctctactcatgtctagggctcctttttcccacctgaagctggcttctccttttccttttctcaaagcacatggttacctttaacctgacttagatgttgtctactcttcactatacggctctcaaatgaaggatattggacagcctgcttgttagctttctccttcatttcccttatttaaagatttggccttgtggctgactgagggtatttggttattcttttttttgagtcagagtttcactcttgttgcccaggctggagtgcaatggcgcgatctcagttcatcgcaacctctgcctcccaggttcaagcgattctcctgcctcagcctcctgagtagctggaattacaggcatgcgccaccatgcccagctaattttgtgtttttagtagagacgaggtttcaccatgttggtcaggctggtctcaaactcctgacctcaggtgatccacccgcctcagcctcccaaattgctgggattacaggcatgagccaccgcgcccagcctgttattcttgttactattaacttgctttagttactgactatcccctatccttctggaatagtctttatgtttaaacttatgtagaagtccccttttagtgaaactcttgctacccccacccttttttatttgtgatggagtcttgctctgtttcccaggctggagtgctgtggcatgatcttggctcaccgcaacctccacctcccaggttcaagcaattctcctgtctcagcctcctgagtagctgggactacaggtgtgtgccaccacacccagctaatttttgcattttgagacgggttttcaccatgttaggctggtctccaactcctaacctcaggtggtctgcctgcctcggcctcccaaactgctgggattataggcatgagccacgacacctggcctcgctcccttttttatgcaagaatttcagctatacaccagcaagacagggatttgaaggttctagtagttaccagaaggtagttttttggtagaacagctttttggtagagtggctctctcaaccaactttgggctcaaaaatcattattaaggctctgctcacttcttttactgccccttttcagtgctaaatgatgatcctcattcctttaatcttttttcacttgctctgtttcctggcccctgtgttgtttctgcagttcttcaaaggagtgttttctttcggaagttttcacagctgtcttctggctagggttgtaggtaatatgttaggctccatctcttctactcctccaggctataacttttgtgtgtgtgtgtgtgtgtgtgtgtgtgtgtgtgtgtgtgtgtgattgtggaaatgtgattgggatgggtaaaatgcacagttaggctctcccaccccactgtgactgtcatttgtgaatctgtgtcatgtaatggtacctcagccagggtccccaaacttgagatgctcttgaccttcagggatggtaatggcctgcacttctgtgatgcctaatgaggctgcctttaaaaggaaatttttttttaggttgagggtttttgttttgtttagaaagtaaacatacttgcatctctttttattttgacttgcattgatttcctcttctttcttaaatcctgagtaagaacttcaaaatcagttgccaacctttgtgttcacaagaattgagtggatcagcctctgtattcttcacctgtgcacctgatggactaatatactgctgtgggggaaacagcttccaaaggtctctcttctcttacacatgcacacacacacaagcacaactgtgttataaagaataggcacttctctaagaggaacttgtcctgcttcatgcaaataccctccattgcagcaaaattctggaaactttgaaagaggtacaattagtgattttttttttccccaagaagcctcaaagctcttaaaataaatcttaaaaaatctggtactcagagcttcagctcagaaagcagacaaattgcaaacctggtgcaataagactcttctctcctctgatctttttccgttttctctcaatttattttaacatcccctttcatggtcttacgtttcagaaacttgattcagtccttccttgccagctcctggcaggacaagcagcagggcttccggccctaatttatggtttatatttcttctccatcccctctttgctgccccagttctttacctcctcacatcctgctggcctttcttccatcagaaaggacagtgtcatgtgtgacatgttgctttggaattggatggcatcagtgttagcctagtgatttgggtagaatttgggaaactgttttgcgcatgtgctgctaaatgaggagatggggcctttttttttttccctctctctcttttagtaccatctttctttccccttgtcccctgtagcctccattagccctgttgccagggggaatgggaaattctttaccatgattagttctagggtattatcctataaagttacaaaatagcatttcagagcaagatgtcagagagtctccctgcagttcccatggaaccagttgacctttcagttacattttttcaacatctttaggggcccatttgaagagagctaaagcaataactaggactaagcaaagaaagctaatttggagccagaatatcttaagaagcttaaaaaattagaacctgcggatacataataaataggagcttgagctttgttcttttctttttttaaaaaattattttacctttttttctcatctgccattaactgaaaggctttgttctcttcttactccttatctttttacattactttttggttttctcccccacacttggggactctccattatttccctcatggtgcgatgaatgaggatcttgctggtgacagcctgctgagatcaggcaggtggagggagcaggggtgggctcccttcaggtactgctaaatccgaggggtttggttcatctggggaaggggtaagcttgctgtcatttctagattcatttgcctcccacaaggattcttagggactaactgcattttcaagatgattctctctgaggatgcaggaatggaagaaattttctagacagaattctaagaacatttttgtgagtctttctgagcacttcagaggctcacccaaagatgtgtaatttgtctcttttagttcttctctagcttacactattaactttcccccattcatttggtgtcatttggaggcaggcagtttgatattgtagttaagatcttgggctttggagtcagacctgctttctaattctggctctgccattgattagctctctgactttgggaaggtggcctaacctctttgatctcagctgcctcatcagtaataggggaataatgatggttcctatgacgaaggattgttgtgaacccagttttgcaactctctaaatgttagctataattgttttgggatactgacgaaaaatcagattgaaccttcttgacaaaagaaggtagagagttgctagaataaccttgaaggattgaaggaagacatggggttgagggagaggaaaagcatctagcaaaaagaaaagtagaactctgggtactttaatgaattaactattattgtactacattagtaaattccaagtcttcccctttgctattccaccaaactgatttttctcccaggaaccccaaactggttctactggctcctctgcaaagatttcatagccacagcagccacagtgtcctctgttaccaagacatcattatttttacaaaacatactgctgtgtttctccacctgcattttgaagtgtcataaacagataaagctgaagcacacttgtcagaataggttcaaaaagtgcattttgggttgctttacctttgtcctgacaatgtgtttattagcttgcttgttaattccagaattggttaacttgaggtacctctgggccagcctgctcacaccaacactcatcctgaaaacttccagagaaggactcaggtggctcactccttctcttggtgttcctgggaagtcaaagtggtgaatagcagtccttctcagggggcagagaggaaactgaattactcgtggtctgataccttccaaacatgtctctgtgggaaaggagaaattgtgggcaggatggagcagaccaacaaaggttaggagcttctcagtgattggaaaaacaagtacaaacaaaaaattagatgaaaacctttgttagacagtttgatttacttcctcttgtggatgatagattctggactatttctctccacacctgataattagaacatcaagaagataattcagtctctgataagcttttgcagtgatgttggtgggagaaaggagaggctcatgagaaggctttgcagcagaggagctgtcagtgctgattgcttcaattcttggcagggtcacccatcagatagtggacaagtctggcttggggaggctgtgtatagaaaaggagcaaggcacagggctcaagagtgctggcctggagtcataggacccaggttagagtctggctagctgggtgtgttagtttcacgtggctgctgtaacagatgaacacaaacttggtggcttaaaacaagagatttatcctttcatggttttggaggccagaagtctgaaatcagtgtcactgggctgaagttaaggtattggcagggctgtgctccctctataccttgtagggcaaaatctgttcttccttgctgcttctagcttctggtggctaacagcattccttggcttgtggacacattactcctgtcttcaaggccaatgtctacaaatctcaatcaccttcttttctgtgtctctgtcaaatctccctcagcttcttgtgatttagggcctatgctgataatccaggataatcattttaagttccttaatgtaaaaacatctgcaaagatcctttttttttcttattccctccctcagccagactcaactcctgggctcaagggatccttctgccccagccttccaagtagctgggattacaggtgtgagtgatcacacctggcttcttttttttttaataaggtaacatttataggttctagggattaggacctgatatctttgggatgttatttttctgcctaccatactgggttaccttgggcaagtgactttcatcagtgtgaacttattttcttatctgtaaaataaaaatgattatcaaatattctgtactaaattgccatgagatttaaatgaaatcttgcctgctaagcacttggaaatgggccaggtatgtagttgatgcctggtatccagaaagcattattattacgtaaacatatattttatattactattatttagtcatcttctgtgaaagggagaggatagttccttaagagtttgacctggcagtagttcaagaccagcctggccaacatggagaaaccccgtctctactgaaaatacaaaagttagccgggcatggtggtgtgttcctgtaatcccagctatttgggaggctgaggtgggaaaatcgcttgaacctgggaggcagaggttgcagtgagcccagatcacgccactgcactccagcctgggcaacagagcaagactgtcttaaaaaaaaaaagagtttatttgacctgggacagttccccctcatgcctgccttggcctcctgtgccctggggtccttggctgtcacctgctatggtctgcagatatccccaaggccaccctcttacccagtcttctgttttcttttatcagtgcttgggctggtctttgggggaacaggtctctccctttagggggtattaatgactgaatgcttgtgtctcccaaaattcatatgttgaagtcctaatcccaagtgtggctgtatttggtgtaaagaagtacgtgaggctaaatgaagtcatcaggtttgggccgtgatcccacaggattagtgtctccataagaagagattaaagagagctcgagagctcgttctctctctctctctctctctctctctctcactctgtgtacgtgtgtgtgtatactgaggaaaggccatgtgaagacatggcaagagggcagccatctgcaagctaagatgagagtcttcagctggaaccttgatcttggacttctggccttcagaattgtgagaaaattttccgttgttgaagccatcagtctgtggtattttgttagagcagcctgagcaggctaatacagtgggcctaacccagctcatacccacttgtgcccagaaatctcagaataaacttgaactctgaaattattcctaattagcattcaaaatagtttatgttcctgctttcctgtggataactataactccataatgaaggatagaataatattatttttacagcggtatttagtatctgttagctatcagccaaaaggtacgtatccccagtgaggtactgtaaatacattttatctgttcttttacctgctgtttcacaaacacatccctgaagcatttcaatcttgtttttcatacttgtcttcaggtgaagaattgttctgatttgcaactttgggggataattactatgttcattagtttctgttcttttcttcctctccatttatttctggttccttgagaaaaatttcccctaaatctacactaacaggagacaagtcacttgattaaaaaggtgttttacaacactagtttctctggctcacttggcttggtgatgtgagggctgtgtcagcatctccttagctggagtaaaggtctccctggtctaggcttagatgaataagaggctttcggggtgggggttctgacctcagctatattgcaaaatattttttacaccggggtattcctgggcaaggggcaggagaggctcacctggtttccttcttatcagtgattcaatcacagacattaatcaagcatgtgttatgtacagagcgtgcacagcattgtggaagacatggctcttggctcacaggggtgctcagcacatgttgattaaatgagcacatggctggatagagtggccttagcattcagagagactgaaagggcaggccagagggtcactgcctgggcattagtgagtaaagggcactgtaatgtccctggaaatgtaacagaattgggaacatcttctgagggccatgatgccctagcacttggatctgtaagaggaagcagtagagggagaaaactttgttgatgaaggtttattttgcctttttttttacctgatattttggctcagtcccttcttcattatagacagagactgttatttacattttgtgtaaatgcagatgtcttataaatgccaagttatcatccaagacagttgagagaggagatggagaaatactagtttggacaagttggctcaggataagaaaagaggcagggatgtatgtgagatgcctgagaaaagaactgaagaaggcgagaaagcagaagccagaaagaatttcaattaacctggaacagaatgggagcccagcttgaagaagttgggtctgggctggacactcggggaaagagcactggaaggatttctgtctgtaagaatgaggaaggacagtgtgtagttagcttggggtactgtggaaagaggagcactgggaaaaatggtttaacaacacctacattccgatacctcaccgttatgacacttatcatactatgtggtgattatttgtttatatgcccctttttttctcttagaaggcaggagggggagcatagtcacctttgtatctcagttacttaacactgtgtccatcagatagcaaatgctgcaacagatagctgatgaacgtgcttaaggtcaaggcctcagtgagccatccactaaggacagaaatgtgaggggtctgtggaggcaagtgggtgttgtggtggcaagcgtgtaactggcttagggggtgaaccaggatagaactgagaagtgagtctaacagagactctaaatcatctcagtaatttattaaacatctcttttgtctcaagtcttgagctagttaggcagaatgaacatggtctctgtccttgcaatggttaaggtctggaaggggagaaggacaactatataagaaagtataataatgctatgatcagagaagtacaggtgctctggcagcactgaatttgctgtagtggggagggttggggaaggcctcaaagcggaagtgtcttttaagctgtagcctttaggatgagtaggaatttgtcagataaagaggaggggaaatggcattccaagcagagggaatgacatgtgcaaaagcctggaggtgggagacgagatgtcttcagcattgtaagaaatgttgtataagaccaactctaggccaggtgcggtggctcacgcctgtaatcccagcactttgggaggccaaggggggcggatcacctaaggtcaggagttcaagaccagcctgaccaacatggagaaaccccgtctctactaaaaatacaaaattagccgggcgtggtggcatatgcctgtaatcccagctacttgggaagccgaggcaggagaatcccttgaacctgggatgcagaggttgcggtgagctgagatcgcgccattgcactcactctagcctgggcaacaagagcaaaactccatctcaataggcagggagaggaaagagatgaagctgctgatgttgatcagggctggatggtggcaggttgcgagtatggaatttggcctttattctgagggtcctggaaaaccattgaatggtttcaagcagggaaggatagggtcagattcatggtctggctatagagtaatccctctacattctttttttttttcttttctttttttttttcccaagatgttgtctcactctatcacccaggctggagtgtagtggcatgatctcggctcactgcaacctctgcctcctgggttcaagggattctcctgcctcagcctgccgagtagctgggattacaggcaccctccaccatgcccggctaatttttgtatttttagtagaggtggggtttcaccatgttggccaggctggtctcgaactcctgacctcaggcagtccacctgcctcggcctcctaaagtgctgggattacaggtgtgagccactgtgcctggccaatccctctacattctaaataaacatttaatcaagatgtatacttgtaatttgctgatcttttaccccaggatactttgacgttgcattaaagcctgaccatttactccaaatcactgtctgagcataggaacctgaagaattgtgtggagagcgtggcctgccgcaggcctgagtccctggtgtttgatcttagacgcacggcccaaggcaccattgccgagcctgcggtgttcagggctgctgctcccacctctgctgcagctctgcctgctctcacctcagagcctctttgcagcagcttaaaattcctcagccactgcaccttcttctgctccatgctctctacaaattgaaattttttatgacaatgttgtatcaattggaaaagttttggaaagtaggattgagaaataaagacttctttgccttttctccctgcaagggaatttgaaaaatatagaaattctaagttacatgttaaatatccttggggtttcctttccttctcttttgaaagtttttttttccattaaccaaatatccgacagaaatgcttgtgggaagataattccttttggctagagcttatactccacattgtgagctttttaattttctttccttggtggtgggttgggacccaactgtgcagttgcgggagctcatcacagtcctgttgctgggcaagttctccctgtgaatctgtgttttccccttgtacctacctaatgaaagccaaattagataaatttttaatcaaggagatgaatgatgagtttttccttagaaaagaaaccacaaggccccacagtactggatacaataaaatgtgaagtttttgtttgcatgtatgctgtttggcatggctttaatgtcagaaaaacaggaggtgttgttaaagtagcatttggaaagacagcattccagacagatagtgtgtttttctccccagtcgttcttctctttcacagttgatgcatgcctgtgtgttcccagcaccttgcactagtacacggtaggtgcttggagatatctgaatgaatgaaaaggagagttttgagcagggtcttctttttctcctgttgcccccttcctctgtcctcagtctatttgttcatttcttcattcattcaacatatattttttctttctaggctggtgtgggggccaatggttgggaatggggtaaagggaaggtttccattgagttgaggctgggaggcatagtcagatctctccttcttcttcaatacctattttgtcctttattttggaaaatgttcaaggtattatcaataccagcatcctcctcctgaaaattgctgccttctacctgctttcaccaaatggttttccttatgccaagggagggtggcagagggagtagggatgaagcctcttcaactcaggggctgtgtaggtatgtctccgtgcactgtgagtggtggggctgtggggagccaagcttgccttgcctgggatataattcccataattgaaggcttggctttgggctaggctcccaaagtgttgacatttccggaggactcacgccagcaccagaccttccccgcagcccacgttctagcttgttactgctattgaataggctccctgagtgcctctcttcaaccgaagaagaaagtggcttttattgagagcctttaggaggggttcaggagactggatattgggtattccagaaaccctgagttgagcaaatgagagattcgtcaaagccatgtgcctttggcttcctcattttgctgctctgcttgggtctggcttgattgacagcttgcgacggttgctcctacctgagaagtggggagtggctataataatttgggcatgagaacaggagcatagggggagggacatatttagtagataaaattgacaatagttgatgatggctgagtaggggatagaagacagggaagggagaggagggattgagagctcttgggtttccagcgtgtgcagtagaactaggcagtcctggaggaggatgagacgtgtggagggaagagcaggagctgagctttggacttcttaagtgtggaacatacaagaggagagtacagcaggcatatcacccagaagagatggcaggaagactacctaaaatctcaggctgcttttctgttgaagttatccgctggggtttaggccactatgggtagataatacagtccaaatcaaattctgtttactggctccttctattaagtgaagtagaagttgagagtttgcaagagctaacaaaccactgagctgccaggaatgaattcataatcagaggtcacaaactgtggtgactgtgttatgcaagttgcaggcttatagcaggcttccttctcccttctcttatctctcattcaccatggggaagttctaaaaaggagagatttgctaagacagtgcagtgagctatgtgtttgaactctatctaacctgtctggcaaggaggtcttgtatatcatcatgctactctccataagccctttgctccagcatatattgttgaaattaatgcatgttcctagtttcatgcctccaggcctttaaaaaaccactcttgtcctgcctaggatgcctttcttattgtctttgtttctgtaattccttttcctcttttaatcatcaaagctcacctcttctaggaagtcctccctgaccccatctcctgaatgagacgtctgttgtcttctgcctcagagtcatctctgtcagggctcttttcaactcagtgtttgctgtaattgccgattttcccatctggtatctgttctccttaagagtgtgtattgccaatctatctccattgcctgtgtggaagctcctggaggacaggacccctatttgtatctgcagcacctggcacatgtctggattgcagcaggtctcaaacaaatatgtgtggaaggatgaataatcttctgtttggatgtgtttggggtggcaacttgttgtatggtccctagtaggcagtatgggtttattcatcttttcgtagagcacaaatatttgctcttttggtagctgtcctgtatgggagaatgaaaaatgtttttgcaaaaatatatttttccagattggcgtgactgttaactgctcacctggggttgaaatggctttggcgtgggtgtgtaaccacaggtagtaagtgaacaatgtgcctgggcagcacagtttctttttttttttcctgggtgctcttcacatttttgtgagctacaacccaagcacctggcttctccgaagccagggtttgtgcctagttgttaacgggagtggttgcatttcagggtgagagtctgtgatattaaccaagcttcttctacccagtgttttccgctggcattaccaggggctgcagtggctgttttaaggagagctgccataagagggatccctgagcagtgagactcaggatggaataattggaaagaattgcctcctactttgcaggagggcaagccctttaggcaaaatagaaggtgtaggaaggggctgagtgatagagacaaaaaagtaagacttactgagaggtgagttggtagttctgtaaggaaactagaaagaactggggcccttgttgtaagagtgaggcaaaggacggccacttggcctctctcacacccttgttgctcttaaaatgatgttttcttattcatgacccggtgggattgggttcagagcgtctgctgcccaaaatgtagactcctaatgcttactgatccttggctgaatgtgctctgcctggaggcagttagtgagacagactgtttccaggatatgtttacctgggcaggtagctggcatgtcatccccttacagcaaatctggtttggtgagaaggctggctggcaagccatccccatggagcctactgtggcaggagagacttcctggggtcccactggtatccctatcacaagctcacccactggaacccagagtccctttgcaagttccagcctaggacactgctgttggctgagctgtacccctgtcagttgcaggctgatgactcttggcaggctgggatttggttggtggcatcttgcagggccccctgaccctacctgctgtcacaaatcctattgtgtaccccctgtacacatgcctgaatgttttgtgatataccactcttaaagagaacagataccagatgggaaaagtaactctcttgggtttatgtgtgctttttttttttttaatgcactttaaaaaataaattgtagtctggtttggcacttctccatgctcagaatgtatttatttgtcatgttcttgctgccctgtggagaccagcagagctgtgaagagaagccacctcattaggagactctagaagaaaaccagggctctcctggcacttccccagggatatgggctcctccccttccacatcctgccaaagccagggcctgggaacggctccccagggcagcgtgctctgtgccagtgtccaaggatcttaaggaatttaattaagcaactaatagactaggggatatttaaagtgtgattttgttgacattaaacacagttatttaaatatcagctaattagtgctttttaatattgcttcttgaacttaagtttggttactgcagttgacatagatacttgacagacccaagttcagtgtggaggtgtggggcacagttgaacatggacttggaggaggggaagagagaacacataatttacagctgctgaaataattcagctgtttctcttgctgattgctctcctcctctggagtgctgaggcagtgaattgttaatgggatgggctcttgctatgccaatcagggttgggatgaggccattttgattgttgggaataaactctgaaattgagaggaacactgagtttgaagccacatttcccctcaaccccagcataggatctaagctgtgtggtgtgctgtgataccagggctgtatcctgttggtgaaggcaggcactgatctgtagagtgttgctgatgagggtaagtggtgagatgagtgtctcagggtagggttcagcttacagatctgcagacaaactgagttgtccacagacagattagatacctctttggagtggttggaaaccccttgggaaaagagctgaaaagagctgaaaaggcaagggaaaccccttgcctgaaaagagctgctctatactcctgccagggcaagtgacactcttctggattaaggtgtttatttgcttatctgttcgtctgtccactcacccatttattcacctatttgttcatcagctatacctttactgagtgcttgctgtgtgttagatctaactagagattaaacagtggatgaggaaggagtcccatgtactcaggcaattcatatttacagtacagttttgtggatcttatgatagttgcacagagaattatgggagtacatggagaatcaacaaaatatggcaaataaaatccaacagaaaataaaagtgattatctgaccaaattgagcttacccaagaattcacgggtggtttcatattagaaaatctatacataaaattagccacattaataggttaaaggtaaaactatatgatcatcttagaggtagaaaacacacttgataaaatttaacacacattcatgataaaacctcttagcagtttaggcaaagaaggggatttctttaccttgacaaagaatatctaccaaaaaactacagaaaagatatttttttctttcttaagtttatttttattatttttattttattaaacattttttgaaacagagtctcaccctgtcacccaggctagagtacagtggtgccatcatgactaactgcagcctccacctccagggctcaaatgattctcccacctcagcctcctgaatacctgggaccacaggcatgtgcttccatgcctggctgagtttttaaattttttgtagagacagggtctcactttgttgcccaggctgatcttgaactcctgggctcaagtgattgtctcaccttggcctcctaaagtgttgggattataggtgtgagccaccattcctggccttcttaaatttttagaagagagcaatataatgtattcatgtacccaatgtccggttttaacaatttctaactcatgggcaatcttacattgttttttaattttttagtatgataaaatatatacagcagaaggctgggcacagcagctcatggctgtaatcgcagcactttgggaggccaaggtggggcaatcacttgaccccagaagtttgagactgccctgggcaatatagtgagaccccatctctaccaaaacacacaacacaatctcatatacatatacatacacacacacactcacatacttatatatacacacacacaaagcataaaatttgtcattatgatgcctctttatttttttttttatttattttttaagagatagaggtctctctgtgttgcccaggctggcctcaaacccctgggctcaagctatcctcccactttagtgggccaccacacccagcaatatttgtcctttatgtgtctggcttatttcacttagaatagtgttttaaggtttcattcatattgtagcatgtatcagaacttcattcctttttgaggctgaataatattccattggaaatacacacacacacacacacacacacacacacacacacacacacacacacacacgcccccacacccacacccacattttataaaaatccacttatctgtgatggctgtttgagtcattttcatcttttggatatagtgaataatgctgctgtgaacattcacatgcaagcatctgtttgagtcactgttttcacatcttttgggtatctacttaagcaaagaattgctgggtcatatggtaattttatgtttagctttttgaagaaccaccaaacttttccatagcagctgcaacattttatactcccaccagtgatgtatgagggttccagtttcttcacatcttcaccaacacttgttattttccttttcttcaataattataaccatacctagtaggtgtgaagtggctttgattggcatttctctaatgatgactaatgatactgagcatcttttcatgtgcctccaggccatttgtacaatggagagatgtctattcaagattattgcccattttaaaattaggttgtttgtctttctgttgtaggagttgtttctgtattctggatattaaacccttatcagatgtgtgatttgcaaatattttgtttcattcccttgtcttttcattctcttgatcgcgtcctttgcacaaaaattttaaaaatattttaatgaagttcaatttatttttcttttaccacctgtgattttagtgtaatatttaagaaatcattgccgaatccaaggtcatgaaggttttgcccatgttttcttctaagaactgtatagttttaactttttttttttagatgggaggcttgctttgttgcccatgctggagtgcagtggctcagtctcagctcactgcaacctccacctcccgggttcaagtgattcttgtgcttcagcctcccgagtagctgggactaaaggtgcccgccaccacgcccggctaatttttgtatttttagtagagacggggttttgccatgttggccaggctggtttcgaactcctgacatcaggtgatctgcctgcctcagcctcccaaagtgctgggattacaggtgtgagccaccgcaccctgccagttttagccttttaaatttcgtcctttaaaaatccctttttactcaataacacttttgtaaaaatcagttgactatagagatgtgagggtttaattctggtctcacaattctattccattggtctatatgtttatccttacatcattaccacacttttgattactctagccttatggtaagttttgaaattggacttgtggaattctccagctttgttctttttttcccctcaactttgctgttttttgtttttgtttttttaagagatgggatcttgctctgtcactcagactaaagtgcaatggcactgtcatagcccactgcagccttgagttcctagcctcaagcaatcctcctgcctcagcctcccaagtagctgggattacaggcatgaatcactgtgcccagcagttttgttctcctgcttcaagattgttttggatattcagggtcccttgaaactccatgtgaattttaggatgggtttttccatttctgcaaaaaatccactggaattttgaaagggattgcgttgcatctgcgtattgctttgggtaatactatcattttagcaatatcatatctttgaatcatgaacctaaaatgactttttatttatttatgtgttgtacagaaaaattgaaatggagatcttcttttatttcttcagcagcgttttgtagttttcagtgtaaagtcttttgcttcattggcaaaatttattcctaagtgttctttttgatactgttttaaatggaattgctttcttagtttcctttttggatcgttcatctctgggatatagaaatacaactgatttttgtgtgttggttttatgtcctgcaactttactgaatttattagctctaacaggttttatttgtgaaggttttctatgcataagatcatatcattggctgggcgtggtggcttatgcccgtaatcccagagctttgggaggctaaggtgggcggattgcctgaggtcaggagttcgagaccagcctggccaacaaggtgaaaccccatctctactaaaaatacaaaaacttagccatgtgtggtggtacatgcctgtaatcccagctacttgggaggctgaggcatgagaatcgcttgaacccaggaggcagaggttgcagtgagcctagattacgccccgctactctaacctgggcaacaagagcgaaactccatcttaacaaaacaaaacaaaaaaccatatatatatatatatatatatgtgtgtgtgtgtgtgtgtgtgtgtgtgtgtgtgtgtgtatatatgtatatacacatgtgtatatacatatgtgtgtatatatgtgtttatatatgtatatatacatatatgtatatacatttatatgtgtatatacacatatatatgtatatatcatctgcacatagaatagttttacatcttcctttccaatatggatgccttttattcttttcttgcctaattgctctggctagaacttatagtattatgttgaatagaagtggtgaaagtgggtggccgggcgcggtggctcacgcttgtaatcccagcactttggaaggccaaggtgggcggatcacgaggtcaggagattgagaccatcctggctaacacagtgaaaccctgtctactaaaaatacaaaaaaaattagccaggcgtggtggcgggcacctgtagtcccagctactcaggaggctgatgcaggagaatggcgtgaacccggaaggcagagcttgcagtgaaccgagatcgcgccactgcactccagcctgggcaacagagcgagactctatctcaaaaaaaaataaataaataagtaaaagaggtggtgaaagtgggtatctttgtcgtgttcttggtctttggggaaaagctttcagtctttcaccattaaatatgatgctagctgtgggtttttcatatatgccttttattatgttgaggatgttcttttctattccgggtttattgggtattttttattatgaaaggatattggattttgtcagttgctttttcagtatccattgaaatgatcatgtggtttttttccttcattctattaatgtggtgtattacattgattgcatttcatatgttgagccactcttgtattcctgggataaaacaccacttgatcatgttgtataattctcttaatatgctgctgaattttggcttgctagtattttgttcaggattttttgcatgtatattataagagatattggtctggagtcttcttatagtgtctttgtcttgctttggtttcagggtaatgctgacttcatagaatgaattaggaagtgtttcccttctctttggtttttgtgaagagtttgagaaggattagtgtactgctacccttcttaacaggcaccttgctggccagtaagtgcctgttaaactcctacctttttggagctttggctttgaagttgggccaggtgaacttttccatacttttttgttttgacacttccatcttggccgcctgtctgggcagccagccattctgattatgcagcctggaaactgcccttacagggtcaagttgctaagttggactttaagactgcggctttttccatgtgttctctgtttcctttggctgatgagtgtatggtctgatcttgggtttgctgaacaagaacaaggcctctgagccattcaggagatcagaacaagtcagctgataagggagtaggttctgtgctgaaaataatgtattttaaagtgttttctcagatatttaacatttcagggtgaaagattccattgagcacagttttccataattctaagttcacatgtgatcatagaggtggccacacacacttctttccaaagtagtaatttacatatgtatgccattaggttctgctgctttcacttccactcaacaattttttatgcatctgcttttaaagataggggtctcgctattgcccaacctggagtgcagtggtgtgatcatagctcactgcagccctgaactcctgggctcaagccatcctcccacctcagcctcctgagtagttgagaccatagttgcatcaccatgccctgctaatgaaaaaaaaattttttttttttttttgtagagacagagtcttactttgctgcccaggctgatcttgaactcctagcttcaagtcatcctcctacctaggcctcccaaagtgctgggattacaggtgtgaaccattgtgcctggccagcacctgtttttatgtattaccacagtccatatttttacctattttaatggcagtgttattttccattgtactcttccaaatggttctttttagattattgattttattaaatcaatggctattttttgagtgccaggaaaagtgctgggcaatgaggagacagtggtatgttacacagacaattgtccctcccgctgtggagctcccagtcagatggattctagttataggcctatgaaatagagcttcactgacacctaaaacagccctggagaggatgaggagtttgtgcagtccctagctctggttcctattgctgccttctaaaatgcggggggacgtcttggcaggacagtgtcagttctgcttgtaactgtgctctcagcaaagcacaggatggaaaccctgtgaccatggcagagatggctctgaagtggagctgccgcagcagggagaactgctgtttcctaggcaatactctgcttaatatttttagcatgtggtcatgacagaactaaatgtggtttctgatcccaaattggtaataaatgtagccatatttagagtcagaaacaatgcatttaaaatcctctgctccttaattgtcctgccaagtactgagtttaggtttctttgtttcttggctacctacccagcttcctaccatcccttgtagaaggtgcccggattttctctgggcattcggtgggattgtgaaagccgtgagttatggctccctgagctgtgttgagaggcatctgatttttgtgtttctgcccacatatgtaaatgtgtacattttaaaattcatctccctttcaagtttttaaggatctggtattataaatagtcttgggctctcaggcatgttaaaaataaaatgttgcagttgctgacttacctggaagacatagttgataccaacatggtagtagcaagtcctgtgcttggtgacccatcctcgtattgttgctaagtgtttctgtaagtaaatgctattttcttggggctccccaattagtttaaggagtaccctaattattgcctagctcattattacaaagttgtaattagtgtcttttttttttttttgagacagagtcttgctctgtcgcccaggctggagggcagtggctcgatctcggctcactgcaacctccgcctcccaggctcaagcaattctcttgcctcaggctcccgagtagctgggattacaggcacccatcaccacacctggctaatttttgtatttttagtagagacggggtttcaccgtgttggccaggctagtcttgaacttctgcctcaagtgatccacctgcctcggcctcccaaagttctgggattacaggcatgagccactgcacccagcctcaactaatttttgtattttttagtagagatgaggtttcaccatgttggccaggctggtcttgaactcctgacctcgggtgatccacctgcctcagcctcccaaagttttgggattacaggtgtaagccaccatgcccggccccaactagtttttgtattttttagtagagatgaggtttcaccatgttggccaggctggtcttgaactcctgacctcatgtgatccacctgcctcagcctcccaaaatgctaggattacaggtgtgagccactgcgcctgtccttttctttttaataattatgctgtctgagactaagatgtggaaggccacattatccactgaatgtgaacaggacatcatccacctgaggcaagtgacaatatcttttgtatattctgttccatagtatggtgcccagtgtgctcaaggaactgacattaatgctgaaattatctttgtgtggtatttgcttttagagtgtgagtgctgaatgcttgcaatagaaatggcaaacaaattgtacttaccagttagcagatagttcctttagaactatggactggaaatcataccttcttccctattttagcccctttaagaggccctgatgttttctggaagcttagagacatcaggggaaaggaaagatgaattctgatctctcctcccctcgaaccctgaccgtggtatctggatgactgtggtgtgaaagtccctggtgttctttgggagcaggctatagagaaagcccatcgcacatactgtcaggagatccagttactattttaaaaggggagggaagaaaagccctgggacccttagtccctggatgctagctgcatctgtctacagtggtcccagcagtctaggtcagctgcatttgccccggctgttcctactctccctgactcccccttagaggtaggagagtggcagcaggaatttggagacaggcctgagtcatcaggaagcgggactctgaagtgtttgatgtcagtcagctggcactgatgcagagccagccagcatcgcttaaaggtttcaatggaaatgtgtctgtaaccacccagagtatagtccaggtgtgtgggctgacttgtggctcagggaagctagtctccaaagaggggcttggttgtcagaacagaagacagttctgtatgggggtgaagccctcgctgcttttgcttatcctattctttgctcagaattttctctaataatagtagtgagagctataagctttatgagccctcattttgtgtcaggcactgtgctatatgctctatgtcatctcatttaatatagacagtcatactaaatagttactatcaagtcctcttatagatgaaggggttgaaacttgtagaggttaagcatctggcccaaagtcacacagctagtaggggagacttggctcaaaatccagagcctgcattcttcctattacactgtagtgggttggaagggaatggagcttcttgtaaccttggttgttatcagacatgggctgatcactcccggtacctcaggcagggtcaaggatcaggtataaggagtaggtccccttgtctgtatcttgctaggagcttacagtctaggacctactggaaagtacagactaggacctgagtattcctctgattcatctggtcaactgctggtatgcttaggcaagccccattcaccaaagaagactccgtctttgtctgccatgtagaaatacttctgtcttgtgtattttctgcatggaggggcgaggtgtcaagttcttgccagacagttgggtgtgtgtatatacgtggtgtgtgtggttgtggtttgtgtgtgtgtgtgtgtgtatatgtgtgtgtgtgcctggcactgggctccatgaaggggagcagggatgcttttgcttcgtgtatagctaggaagcttgagtgataggagtttaagggatcaagtcacaaaggaagcctggctgcaatctgagtcaagggatttcttcttcctgaatgcctgtgcctatgccttggctggtctgtgccaagggcatttagtaatcaaggtgcctgtgtgtggtatgtgtgtgtgtgcgcgtgtgtgtggtgtgtgtttgtgtgtggtgcagaaactagaacatggtagaggtgggtctttccacaagagggccccagtaggctcatttaaaaatttctgtcctttctacatatggctagccagttttcccagcacccattcagaggtgggaattgaacaatgagaacacatggacacaggaaggggaacatcacacaccggggactgttgtggggttgggggaggggggagggatagcattaggagatatacctaatgctaaatgacgagttaatgggtgcagcacaccaacattgcacatgcatacatatgtaacaaacctgcacattgtgcacatgtaccctaaaacttaaagtataataataataaaattaaaaaaaaaatttctgtcctgacacaaaatgtgcctttttatttatactgttgcagaacaaataaaatgatgagtccagtttctgtggctgatttcacagacccctcgagagacagcacggctatggaaagagcatggctttggggccaaactggctttgaattctgactctactgctctgtggctgcatgaactctggcacgttacttaacctctctgaattttggtcccctcatgggtaaaatgagcagcatattggaaccacctcagagggttgtcgtgaagagtaaatgaactaatactttgcttgcaacatggaaagttctctataaatgttgactataattattatttgacagaattaattttcctctgggatgcccagatagtatatttgaatgctgggggaaggggtggcactagggtatttctctgtctccgccatggcggagttattattacatttccacaaagtggaaggactaaagcctccgggcagtctgaggcatggctgagagcccagagaaggtagaattgtgtctgatgggagtttcttcttagaaattttacctccctgccccctccttctgctggagtgactgatgcccatcattgtcctgaggtcatgtgtgttgtggggtagctcttcatcaatcataggaacttatgtatggtattgaagaatccctctgttgcacccatggaggaatttttttttctcttttctcattaagactttagtgaaatgttgaaaaatcacatttagaaatgtggcctcaaatcttcaaaatttagtggacccattgagccttttggagtggcctacccttgtgcctctatgtcttcatctgtggacactcttttgaagggccctctgactgcctcattgccaaatccagtgactgatctcctgacattgttgcctacaactggattttctcaggattctccactcttttgacctgtgtaggtctgcactaatcatgtggctgctcctctggtttccttgcttgctcccttttcctaacgtgcagccatgagttgaagactatgcttggtccgctgtccttttctctctaaggtttctccctagaaagatagtcgctctgctcctgttgctttgatgatcacctctgtgttgatagcactgaaactcttgccctgccttagccctgtctacctcttcgtcttcaacaggtatgaggttgccacagccttcctggatccattgataagttccacgcctaatggcattgaattccaattgttctctatgtaggtattgagtgcctgccatgtcttctgggtctttagcagtccaaataaagattgagccttaagctcacttctagcattcagattctttgcaagctgtggccaagtaggagagatctggagagggccaggctaggctttttattcagtcactctgcttgtcatgtgatttcttttttttctaattttgagacagagcctcactctgtcacccaggctagagtgcagaggcatgatctcggctcactgcaacctctgcttcctaggttcaagagattctcctgtctcagcctcccgagtagctgggattacaggcgtgcaccatgacacccggctaatttttttgtatttttagtagagatggggttttgccatgttggccaggctggtctcgagctcctgacctcaagtgatctgcctgccttggcctcccaaagtactgggattacaggtgtgagccaccatgcccgattgtgtcatgtgatttcttttcattggatgcactaacttttgtcgctgtgattgcagttttttttttttttttttgctagtttgtttagctcccttcttgaagatctgtattcttctctactggagtgggaatggagtaggtcgtgttccacctctgggagtacagagaaagggctaggaatgctcctcactgcccttcccatttcatcccatcccatgttgtcttccttccaggtgcctattcccagctgggcctgtggagcccttcttggctccctgtgccctctggcagggctaacatctgtactgccactgttctcccttgcaggctgcacggtggattttgtagctctctgtagctctttgtagctctctggttaggcagaggcttggatccattgtgaaccctctaccctccaacagcctcctctaataaccttttttcttgggtgccttgggtttgttgagagcagtccctctttgcttggccctaggcatgacttcaaaacataggggagatattatccccattgtacaaatggccactggctcagggatgttccagtccagccaccttgccagctgggggctggactagttagaagccacatttgttttgctgttcaaagactttccatttaattgctgtctgcctcttgactttctgtttagtattgtctcaggcgggaaaagcttgtttgcctgactattacaaacttgtttttcttgtccttcaaattattctttaaaattccatttcttttcttaagcctttgcacgttgttctcccttgtcaggggcgtcctttcagtgtcctctttgcgttgtttctccagcttcatatttgtctgcttaaattaggtagtgcacttctgtttgtgtagaggtgagtgactgtatgtgtgcatatgagtttgtgcagcccataaatagtaatgaatgtgtgtctgtggaagagctcatcctctaaccttcagtttgtaaagcaggtgattgtcttacagctgttcctgcagctggcagttctgcatgttggtggcttggctctctggatgccaatatgctaggaaaagcactgagtgggctgggtctgccttggggctcagcagaaaactgcctcgggtttctccattttcagccaggagggtcatcctttaacatttatttcctttacctcctgggagtagctacccaacaaaaggctttggtcctcatttgaggcatgggtcagctggacagtgtgtggatctaacagggagcaggagctttggagagtagttgcctggcctggctctgatgggctgcgggtccagggcagcagtcatcatttccattccaatgatggagtgggccgggcaccgaggctcaggactgtaatcccaacactttgggaggctgacatgggtggatcagttgagcccaggagttcgagaccagcctgggcaacatggtgaaaccccatctctacaaaaataataaattttaaaaagccaggtatggtggcacaccatatctgctactcggtagtagtcccagctactcaggaggctgagatgggaggattgcttgagcttgggaagcagaggttgcagtgagctgagattgtgtcattgcactccagcctgggtgacagagtgaggccctgtctcagaaaacaaacaaaacaactaataaaaaaatggagtgatgattagatgctaggtgctgtacccagtacttcctattcattgctttatttaatcctcgctaccaacctttgaagtagaaattcttaatgtacctattttataggtgaagaaactgaggcctagtgaagttgtgtccaagatcacatagctaggaagtggcagagccaagaattggccttaggtctgtctgacttcaagtccatgtgttatactacccagtgtttttgtttcttttgtctctttgcttcagtttcttccttataaaatggaagtaggaattcttgccctttcacttttcccaggagattcaggaaaacaaatacatgaacatacagtgtaggttaataacatgagcattttataagatggaattccaagggctccatggcaggctactgagttggctttgcttgtccaggacacttagaaccttttccagttctttctgtgctctggtcctgaaactcagctactgcccatgggtcctgccaggtgtgtcagaagctgccagagacccagcaatactgctccctctccctttattggcttcttgccatcctcatcccattcttttgttttccattctggagaaaagacattaagaagagacgtcttgtttacacagggcccaatccccacccccagtcttgtctgaattgtgtggaagacatgaggcactgagagaggtgggggccgagtggcctcctcccacctgctccccaaacatctgctctgggctgcagtaagctggcaatacagattggtgagtgcatccaacctctatttaagcagaggtacagcctacaaatggacacttttgatagaaaaatgggcatctcaagtaccttattgtctcttctgtcccaaagcccaaggatacttaaggaaagagttaccggtgagacactgaaatagtttcccctttcctggacagagtgatggtattttatgtcagaagagggccataaatgtaaagatgtaggtctgtcctccattgaaagccaaggatgatgagaaggatttttttttttttgcagggtatgcaggggccattgatcaggtgaacccagagtttatgggtggcaagtggtttgggaatggcactatcatcaggccaggtgtgccaaactgtgcctcaatgggatgccatgactttggctttacttatgccagggaccgcagctggcttttgccactgctgctgcctctgtccctgcttgtgatggtgggccatcctggcaaagcatagctgtgtgccacttccctttccccctttcccttctccctcagctttagcataaagcccagggcaaactatgcctgccacttcttgagtaaggaccaagaccaggtgacgtggctgcaggccaggccttaaaaggacggagaacactgttttccgtgcctgcatgctgtagtttgtacttgctcttgctctctggatgcccctgtgaagcctgagaaactatctcacacctttctcccagcctcacctaggtctctcctcagtcctctcaatctccccatccctctcccactgcccacctcagctccatgttcttgtcctctctttctctctctcattctctctccctgttttgtggaaaaatatatagaggcaataactgggtcagctgtgcagtccatgtggaattattgagggaagatgaaggatccacttgtgaatccacctctcatccttagtattggcagaaaatgtttctgacagtgttagcgtgtgtgcaggagacagagatggctgggagccctgtgggagctaccatttctctcaccctccactcctcttcccactccaaggagtgggggaagctgctgtgtgtgcatcagctgcccctgacctcttcttcctcagtcccttctgggcctcccccttctgctcatttgtcttctttgcccttgactatttccttctcatttagctcttcctcctcttctttttccccagcaccagtttcgttgttgatccctagctgtaagaaggaagctcataactgtgtgtctgtatgtgtgtgtctgtgtgtgtgtgtgtatacacatgagtatctcatggaaggggagggatatctgtggctttgggttaatctttgttttgttgtatgttgtcctgataatgctgtgagtcccccacttctattctttattctttttctccccacagccaaggctgcagcgttaacagaagtatagagcagtataggcagctctagggttgtgccctctcaggaaccatctccctaggcctccctagccttctccctcctgttgtggtgacgccttgcccttgttcatcctcacccagcctggcccctctcctgctcacacccagggatggccagtcacctatccagagcctggtgtggtgctgtgaactcaatccctgtctttcagtgtgattggtgccccagggagccaggttgctgggggaagctctcgtggcactcagccgttccattttgtcggcaaaaaaagagggggggagctggcagaaagctaaggcttttgctgctgggtgagtgtagcagctatttttagtacccgagcctttgcttttccatttggctgtgcttttttgcacagtggcggtccagcagggctgttttccttcatggctgcagatgtccttagggaaagtttcttccgacccctgagaagatgtgggcagggcagaggggtaatgacttctgagagtgggttcaggcacgctttgggtcccactgcaatcatgccacaggtccaatttgttaaggtgaagcagggaggaatgtggcaggagtgggatagagaaaaagtaaacaccgcattcttcagaggtgctgccctgtaattaactcacttaagcctcaattgagtaaactgcctaatgaggtatactggggctgagggataaatattaaaacctcttataagggtctgggctaatactgacacatcctgaattttcataaggttttcttgtttgttttgcttgttttattttgtttttctttcctagatcatttgctaatttggattaagttttcttgacgtctatcctagtttactagaatattttcactattccaaatagaaactctttacctattaaggagtaactctccatttccccttttccttaacccggtaactgcttttctactttctatctaaatgaatttgtctgttctaaatatttcatataattagaatcatacaatatctgagcttttgtgtctgacttatttcacttgggataatgttttcaagcttccatgttgcagcatgtatcagaatttcattccttttatggctgaataatattccattgtatgtatataccacattttgaaaatccatcttttgatggcacttggattgtttccaccttttgggtatcgtgaataatgctgcaatgaacattgatgtacatatatctgtttgagtccctgttttcaattctttgggggatatgcctaggagtggaattgccgggacatatgttaattctatatttagctttctgaggagccaccaagctattcccaagtggctgcactgttttatatctacaccagcaatgtacgagggttccagttaatccacatcttcaccaacacttgttattttacttaaaaaaaaaattacagccatcattgtgggtgtgaagtggtgtatcattgtggttttgatttgcatttccctcatggttaatgatgttgagaaccttttcgtgtccctattggccatttgtatatcttctttggagaaatgtttattcaagtcctttgcccattttaattttttttattttttttagtggcagaatctcactctgttgcccaggccggagcacagtggcattatcatagctcactgaggtctcaaactcctgggctcaagagatcttctcacccgagcctcctaagtagctgggactgtaggtgcacaccaccacacctggctaatttaaaaaatttttaatttgtttttttagagaagaggtctagccatgttgctcaggctgttcttgaactcctgcctttgcccatttttaaattgggatacttgtctttttattgttgagatttaggaattctcaacacattctggacaatatacccataacagagatgtgatttacaaatattttctcccattctgtcttttcactatttgataatatcctttgagacccaaaagctttttaattttgatgaagtccaatatatctatttttcttttgttgcctatgcttttggtgtcatatttaagaaaccagtgctaaatccaaggtcgttaagattacatctatgtttccttctaagttttatgcttttagctcttaaatgtaggtctttgattcatttctagttagtttttataaatgatataaggtaagggtccaactgtactcttattattatttttgagacggagtctcgctctgttgcccaggctggaatgcagtggcgtgatctcggctcactgcaagctctgcctcctgggtgcacgccatactccggcttcagtctcctgagtagctgggactacaggcacccgccaccatgctcagctaattttttgtgtttttagtagagatggggtttcactgtgttagccaggatgatcttgatctcctgaccttgtgatctgcccgccttggctgggattacaggcgtgagccaccacacctggccccaacttcactcttacacttgtggatatccagttgtcccagtaccatttgttaaagagactgtcctttctcattgaatggtcttggtaccattgtcaaaaattggccatatatgagattatttctggactctcaattttattccattggtctgtctgtccatccttatgccagtatcaccctttgattactgtagctttgtagtaagttttgaaatcaggaagagtgagtcctctaactttcttcttttactttcttagatgggtactcactctgttgcccaggttgtagtgcagtggtgcgatctcagctcaccgcaacctttgcctcccaggcttacgcgatcctcccacctcagcctcctaggtagctgggactacaggcatgtgccaccacacccagcaaatttttgtatttttggtagagatggggttgtgccatgttgaccaggctggtcttgaactcctgagctcaggcactccacccattggccttgcaaagtgctggaactataggtgtgagccaccagacccgaccctttcttcatttttaagattgttttggctattctgggtcccccgaaatgtcatatgagttttagggatgagtttctccattgggattttaacagagattgctctgaatctgtatgttgctttgggtagtactgttgttaacagtatgaagtctctaattcatgaacatgggatgtccttccatccttatattcttttaattttttttttttttttggagggatggggtctcattctgtcacccaggctggactgtagtagtgcagtcatggatcactacagcctcatcctctggggcttaagtggtcttcctgcctcagccttccacatagttgggactacaggctcacaccaccatgcctagctaatttttttgtttttttaattttttgtggagacagggtctcactgtgttgttcaggctggtcgtgaacttctggcctcaagtgatcctcccacctttgcctgtccttttaatagctactggggcttgtacttttatttgtttgactgtttgaaagctgatgtgagaggttttgtgacttgggaatatcgaactttgctgtcttagaggatattgatgccatctgtcttcaggtaggataatgggtgtgttttagaagtgggtggttataaaggcttatgtggatttgtgcccatgtttgttcacatgcagatcagttggttagtttccctctctccttatagtcaagaccacccgccacaacctgataacaagttctaatgaagaaggaagggactagggctgtaatagcttatgcaggagtcctgatcgactgtatggttctacccagggcatatctcttgttggatggctggacccaccatggtagatggaggcttcagaattatctagaagtggtagaagactcgttatacctctatgcaggaaatgtctgacatgtgagcaagtgacgacatgggaatcacagtgcgggggaaccaagcattagcttttcattgaccttctgttgtctatgcttgcacctgcaggtccctgactatggctccccagagcctgccttcatctaggatggctcctctgggcatgctgcttgggctgctgatggccgcctgcttcaccttctgcctcagtcatcagaacctggtaaatatctttattgtaaatgggagggacccttgatgaggtcttgagaaggcctccctgtcaccagggctgttgtgggagtagggtgtgggcttctatgtttctttcttatgtgagtgtggctggcagtggatcatggagtaggtagacttcttcctccccatccctgtgtcttctggcctctgtttaaagcttatgacacagtttccctttggggaaaatatgatgatgatgataaattcataattataatcttccatttaccaaaccttgtagtgagtgctttatatgtattctcatttaatcctcccaacaacactatgaagtaggcagctacagtttttattctccttttgaggagaagactaagactcagagacattaagtaacttggccaaaatcacacagccagtttgtgagagctgtgaatgtcaggattcttcccaaaagctgagtgcctgtgtggtgggcatcagttccaagtaagactctttttcttcctctactcctctctcccttgtactttctcagttcatctccatctctgtatcctccttccttttgtctgtagctccctgttctttctgggccacacttcattaacctagagcttactgctcagggcttctgccattgccactggcaggaggagaatgcccagaaaggccctgagcttggcctggctgcagcacactacggttcctggccctgtttacttggcttgtcccagcaacagcctgcccttgaccagctcctaatgccctccctctcctctcccttgataagctcccactgtcagttatttgacagtttcaccctcccctggccaccttccccaacccccagggctcccactaaatgttggataaagcgctggaagctctggagcgggaggtccttgaagtgcaaatgacaattgtgatgaatttaataacaatccagcttagctgtggttcacctctggctcatggcaagcttccaccttctctctgaaatcatttgtttcctctctgcctttccccccacttcgtggagcaggggaaaacatacagttaggagtcacgagtccttttgagtttttaatgccctctgagatcctgttggtgctgtttatttgcctcttcttcaaggacagtaagaatgggatcccaggggcccctgagaatgggactggctacagcgtgaggttggggctgtctctggcatgggttggcggtggaatggcccagaaaagaaccttcagggcccagggctgtgtcccctccccaacttgtacctcatgaggatgccatgctccccatcgtgagctttagcagatgcacaattaacaaaggcatgctgatgaatttacttaaggaccgagttaggaagtcccttttggataatagtccaaccaaatagatgagctttcagagcataattattctggcccatttatattagctctattgagtctagtctcagaaaaatgttaatactgactttcatcaacagaagctgcttttatccttatgtctgttcctaagctgtatccatttgtcataatctttcatcatgtgctaagcacaagtaggagttgaagcatcttttctctcataccataaaaattgctgccctgatgtcatttaaaatctaaattatgcagccagccaccttcacaacagtgaaaatggggtggaggtggttatgatcctttcttcagagcctggagtccaggtaagtgctcctgatgacctagaattgtcctccccaaaggcattggggcaggttaatgcccacccaggaaaggccggctgtgtgtatcacagtatgatctggagccagctttccttcctggctcctgctgtggtacttccccgggatgccacatctcaggaggcgtgtagatgctgaagggctgtggttgtgtgttactggccttgaaaaaggtggtaaacaatgaggcgggtacagtagtggagccttgtggaaggcgcacaggcccttcgtaagatcccttttgcctcccactttggcaatttgaccctttctgagctttgtttcctaatctgtaaaacagggttggtacctccctcttaaggttttagtgtagattaaatatgattatatataaagcacctggcattgaaactggcacaatatggccaataaatggttaatgaatgtcagctgttgttttttagtatggggatgctgcttctatggtttaatttgggctgtgtcaagcaggcttctgtcccaaaacgttgccctggcagtctgtctctgttacagtgtctgtcaacccaccattagagattcatttattctcttggatcttgaaggctttggtttttaagaatctcttattcggatacaagcgcaaggaagtgtgacatggtaagctgttgtcagctaacaccttagctaggatttcttgccagtcacttgagaggaaattggtatttggaatgatggtgatagggagaagagagcactgatgatccagcgtggaaggcagccctgagaagccagctgggaaggcaccagagcacggggtttacttcacagctgaccaagggctggcctgcctctctctctctcctgttcaggacactgcctaggcagagtgaggctagttgtgcttgttcttttactgggactatggtttcttacctggcccatggaagtctttgccgaggaagggcatgtgctggtagatatgctaaggtgatctcagtatcccgcgtcattccctcagctctcagggcacaacttattaggacatctgaccaagaaagaatcatagcagtgagtcaaaacttgtgtatgggctttggagccaggcaggtctggacttcaatctctgctctgcttttctgagcagtgtgattttgaaaagccccatatctgtcctcctatgggactaatatgatgtgcttcacagatgacacttggatgaattgaggaatggaaggcaccttgccccagtgcctgacatatgatcagggcttaataaatggtagctgctgttatcattacaacctcatcctcttgatgctgctttttctcaaaaccttttctggaactctgcttttgaactcactgtccagcctgtggtttgttcatatcattgaacctctctcaaggcttctgagcccttggcctttgaggatagctaggtgtgttttgggcaaagcatctaaagacttttatagccagggctcgtaaacagggtaagcatagataggggagaaccaattttgtgtcaatctccactaaaaactgaggtgtactttaaaatatacttttaaatgtacaggttttgtgtttgtgtcttaaaatctgattcaaagatgataccaaaaggaggtgcaaaaaacattttgaacagtgacaggattgttgcaaaagagtctggcctccttaggacttgaagcatgtagctcggtggttcatcagtctcgttctaaccctccttcttgaatccactctattaatcttgttaatgaaatctagaaaaagaggctttccgaacccttagtagttaaaatgaacatcagcctacctggattttggaggatttcctgtgctaccttcttatcaccatctcccttacccctttctgcttctcttgatgagaattttgctgcttgcttacagcctgccagaaattacccggctaataggtaaactgaaacaaggattgaggctgggtgtggtggctcatgcctgtaatcccagcactttgggaggcagaggagggaggattgcttaagtccaggagttcaagaccagcctgggaaacacagggagaccttgtctctactaaaaattaaaagaaaaaaagaaggttgcaaattgatgcttagatattttagtttggccttcttagtgttctaaaaataagaacatttcacataaaaatctggatttctgttttcaagttgaatgcctgcgtgacagtggtagaccagcggagtagcagctgcttcccttagtcaaggcaagagggctccagtttctgcagtcccaccactccctattgtttacacctggtccactgatttccctgcatccctgcctggcccctggggcatttcattgacacacctccaaggtaaattttattaactttctcctggtcctgcagtctaatgcttctgaccagggctgatcctagtgtatgtaggctctgggtacttagcagacagggtggtctttgttctggaatgtgaggcaagtacctggagcagactcaggtgctttgggctttcctcagtctaaggcacccagaagacacacctgcctatgggaaggggcattcattcatctgttttttcagcagcttcaaactaagccctgtgctaggcatgggggtgatgaaggagactgacatggtgcctgccctctggaaactcagctgttggaagttcttgatgtccatgtcctcagaatggaggatgcctcctgccagtcagtcttctctgtagtctcataagcacacctattcttctattcctagttttcttttgagctcagatttgtgcaaactttaagttgaagggataggaggggtttgaggcaccaggctgcgcaggtgacctgcttgaatgatgccatattgtatagtcactcctggatgtcacaacacagcctggaatctatgactgccttcataagtaatagtagcagccaccatgtacccaaagccagtggtttacaatgtagtacctcatctaactatgagctagatgttgttattattttcatgttgaaaatgtggaaactgaagcttaggaggttaaataactttcccgagacacaagaaactgggatttgagttattccagcatcttaagcactatgctggagtcagtgcctctcataactatgcatattacatctcccaggtgtggttagatttgagagcttcttcttgccaagatattttccttattggtccttagtaaggcctgaaattctgccatctaaatttcatgcctttatttcttgttaaaatgtaaaaattcttggaggggctctacattggcatcaccagcaccttaacattttaacttttcctcgacaactaaagatcagacattgagggacccaggcaggagggagtccttatctggagccaggcacttttttttttttttgagacagggtcttgctctgtcacacaggctgaagtgtggtggtgccatctcaggtcactgcagcctctgcctcctgggctctaacgatcctgttgcctcagccgcccaagtagctgggactacagacatacaccaccacacctggctaatttttttgtattttttgtagaggtggggttttgtggtgttgcccaggctggtcttgaactcttgggttcaagcaatccacctgccttggcctctcaaagtgctgggattataggtgtgagccaccatgcctggctgagaatgaggtgttagttgaaagttaaataactttacagatgtatgcatataacatctcccagttgtggttagaattgttgggagaccaaaatgagatctatgtaaagtacccagcacgggtctgggctcataggaagattccaagaaatatactttttattactaggggagggattgggaagcagagaaaaagcgatgacaggggaggtgggcaggctgaaatacctccccatgtgctaatgtgggttcctccttgttttcccaaatgtaatttcccagagctccggaaccctctggttcgaatttcctgaggccttattactttttttgcaagaacgggtttaaaaatgggataggaaggatgagagtccaggaaagagcaaaatgaataatactttgtatttatcttgcatcgctgtctcctgagctgagaatgctccagagacaccatctcattaatcctctatgttctacacagggtggaaggcaacaggttttaggaagtggtttccaacctgagcatcttcctccctcagcccagctggattctctccttcccacttgcacgcttcctccatggtttgcaatggctcataggcacactggggaattgtgccctgctgggctgcttgggaatcagttgggccttagctgccagcttttgtacatctgtagtggccatttgaggccttactctcccattcatgtatgtgtttttttcttttctaaatatgtttatttttattgtaaaaataatatgtgcgagttttaaacatcaaacagtataatagcatgtcaaaaagtaaaaggctcttattgtttcgttttgccagcccctgtccctaatgtgttcccttaacctgctcaagatacatgggatcttctagagtcattccctgtgcattttcaaaagtaccacatacgcacaggacaacatgctgcattcatttagccatatcacctcacatgtgctggttctgaggctgaccttgggaaaggaattgcgagtgtccagacatatcaggctgtgggggagaggggcatggaggaaaagaacgtgccaccctaggccattttttttctgcttacctggcgcctagttgcagtgggtcatgccctgtgttttcttttctcagaaggagtttgccctgaccaacccagagaagagcagcaccaaagaaacagagagaaaagaaaccaaagccgaggaggagctggatgccgaagtcctggaggtgttccacccgacgcatgagtggcaggcccttcagccaggtatcaggcccagccctgtccccacaaaacacactttgaattcaaactgcatatgtcctttgtccccagagggctgctccttcaggctgctcttctctggcctgcgggagggaaacagcatggtccgtcagagtggtagctgctgctgcagggctcagggaccttcgttttccagcagaacagagattgcagcatcttagtgccctggaaggaaggcaggtggtgggtggccgtggtttctgagcaagtgattgaaaactttctttccctgcacttctgaagcaccagagaggcagtgacatgtgccttgctctgcaaatgctattttgggctctgctgctcggctcagtgctgctgaaatattgttcttgggagagtcctgagcactggtgtggggcaggagtattctgttgttaaaggaacctgtgccaagaaacaggctggtcctggcctggtttttaaatagtgcatcctcagaaggaacaattttctaaccctttcatgagcctgggcccaaggcttaaaataatgagaatagtcaacaattgcagagtcttcaccatattcaggtactgtactaggtgcttcgtatgcataatcttgttgaattttcacaataataggaactattattatccttatgttcagatgaaagcactgaggctcagtgaggttaagcaacttgtcctatgtcatccagctaacttgccctatgccattgaccccagagcctgggcctactctcttcccacttcttcccagtcctagctgtccttggctggagcctactactctgacacttgggactgttctcaggagtggcaaggtggatggcaagccccagcagctgccacagtgtagtttcaccagcttcttgctgatattcatcaccatgtcctcactgcccccactgctgctgtgctggcagggcagcatttgctgtgccagccagctttctggtagcaatattgctcctgctgtgtttgcacatgggtagttgctgccacagaagagtgatgaagcaccgaggaagccaggtgggagctaatggcattgagcagagggaacttttaggaatagaggtactgggttcagcagatccaacctctgcctgccaccacccaccccttgccaacctggcttcacttgagaacttagtcccactggtccttaaggactaaaaccagaggctgtcaggggtagggcgtggaagatacggactatatccgctgattttatgtatatagtgttgcttgtatcactttcacttttttgagacagggtcttgctctgtcacccaggctggagtgccatgttgcgatcttggctcactgcaacctctgcctcctgggctcaagtaatcctcccatctcagcctccagagtagctgggactataggtgcaagccaccacacccagctaatttttgtattttttgtagagactaggttttgccctgttgcccaggctaatctcgaactcctgggctcgagcaatccacctgcctcagcctgccaaagtcctaggattacagacgtgagccaccgcacctggctttcttgtaccacttttaaccaggcaagttcctggagcagatggaagtcagtgtcctgtggcctcgactcctactctatctgtttctgtggttgagtcagtagctcccttcatccagtagcatcctggttcatgttgcagactgaacgatgttgatggttctgaccctggccccttgcccaaccctctgggcagtggggctgctattaatggctaaaaagagcccctctctgtatccttggggagggacagccagagcctgtgtgacaagagtggactgtggactctgagagactcctggagaattggagtagagcactgatttttacagttaacttgatgtttcattggcatcaccctctgccttggagtttctcaagagtccctggtaaactcttctgcacaaaattcccttggagttgtcccaaaggctggtgtgttgcagttgcacccagacgcagaggccctgtagctcagagggcaaagcaactctggttccggtcatgcctgccccatcccaggagcattttttgcctacactacatctcaaaagcaggactggtgaggggaggttaggtgggaggcttgttctggcctcagtatctgatgtggggtgattcagaatctggtgtcatggtgtcagaccagtggaggccccagtaaagaattgacatgttttctatgtatactgttaggaaactgacctctcaagggtgtgtgtggatagctggcacttgccttcaaccagattatggtacttaatttaccacattctgaattctgcctgggagcttcccaacacatctacctaaagattaaaaggaatgtagccagtcctgggaactggatgggtaggtaaatggggaggtggtataatttagtggtaaagaggacagactagattcagccagtttggggttcaaaccctagccttgatacttaggggatcttgggcaagtcacagaatatttctgttccttggttttgcatggggtggcatgggggaagtgtcctgccctgcctgctgcggaggctgttgtatggagtgagatggtagatgcaaagccctctgcctacttcctaacatggagaaatcactcagtacacagctgttctgattttcagtggtaaattctccacttggccatcccttcaatcccattgtggaatcactggatgccggtgagggtacatgagcatgtaggcttctgtccctatggctttacatgggaaagggaacttacgatgtgaagaagagacttgcatgttcatgaaatgtcctctctccctcaacagagactttgatcaaggagcaagggtaagcacgagcaaaaggggttagcagagtgtttcctgtctgagagtcagtggcatggcacaggaagacggtggactttaagaaaattgcaagtttatatggacagttattgtccccagttcagtaccttctgtcccctcagggctcttaagggaggaccacagctgtgttgtccttaggctcccaagaggggaactaggtttcgtgggctgttttggctgtgctcatttgaaggcagatttccagactgcctgctgcctggaacaccaggggacaaactcatgacttcgtgggccttccctgcagtccaggtaggaattgggccccagtcactcagtcctggaacagctgcaggtgaatctcctgaagtctatctgcccctgttattactgtcagcatcctcactgggagctgcttgttcctagaagtgattttcctgtctctttcttctggtttattttgggatctgcctcaccttacggaggcacagcaagcatttgagggtggatacagcattagctgttcacaagcaagcagaggaaagctgtttgctggcaggtcctgggggttctgggcagggaactcaggaatttgtcctgaggctgaggacctgaggctgaacactaggactttggacctgtgcagttggtattacagaatgctggtcacagccacttcaatgggctcctgcaccctgggcatcatctatagccagagatataggtaacagctcacatttactgagcactgactctgccaggcatcctttgagggcaggtgctataactatcctcatttttacagatacaactgagtctcagaaggaaggactcagccaaacaaccaaaaagtggtagagttgggactcaaacctagatttgtctggctctaagccccagctcctaaccactgtgccatactatcttcttgtgtagcaaaaaggacgtgacccctgccctctatccagctcataatcttacaaaggatacagagaacaaagacaaaaacagccaccaaagtgttttggatgtcttggtggaagtattttgtgctcagtgagggcataaagatggtatggcaaggccagggccttttctctttaaccctgagatctgtgtggggcagttcatcaaattttatgatgctgaatctccaactccatctgcagctctctctttgagctgtgtggccttgctcaggttgcttagaatctcagaaccttagtttcctcatctgatgatagggatgaaaatataatacctacttcgcagagatgatgtaagaatgaaacaaggttaacatatgtaaaatgttcaacacagggcctggcacataggccatattcaataagtggctatagttgtcatttaaaaatatatacctttgttctgggcacagtggcgtgcgaatgtagtcccagctactcaggaggctgaggtgggaggattgcttgagcctaggagtttgcatcattggtaacttggtgtctgtgaatagctactgcactccagccttggcaacatagtctttttaaaaatatatatctatgtatatacacctttgctacctccctttccttggggacctgaaggggaagtggaggtaaggaggcagccctggcagagggccccttgttctgctcattacccagtgctgcatgttggccccatgtgggctcagggaagcgtagccagccaggagcagacctggggctccttattgacctgatctgactccaggcggctgtgagagtctctgaaatattggcattagcacaaagagcccactcaatgtgagcacgcaggaagcctgtgcaggaacacgttcatgtgagggggaaaaaaaagaaaaagaaaaaaattccaaatcatcaacaactgatgagagcaatccaagaattatagagcaccagccatctggtcagatcatttcagatctgcacgagcaataagagggaattgaattttaaaaacctcatttatagtagaccaactactctggtttcaagtatttaagagaggagtctgatttcctgcaggccctggacatctgtctgaaggagcacctgactctggtctgggtgactctgtgacactgtttctgttgggcctctggctctttgcagctttggaggggcggcgtggttctccactcctctgacaccaagtgggtgtgcaacaattcaattcaaatctgccaatgtctatgtggaattagtctcagatccctcaagttaaagggctaagtccataagactgcttccatttcatatggcagttgcaagtcctgggccacctgtatttctgactgaccaggtataagttggggattctcacaatctccttctcaggtttgacattaataatttgctagaatggctctcaggaaaacactttatgtttattggtttgttatgaaaatgcaactcagtgacagccaaacggaagagtttagatgcggcaagatattggagtgggggtagggagtggtgtgcagagccttctagcacttcagtgtgtccgccaaccctcatgctcaagtggagttcaggaagctctctgaatcctgttgtttcagggcttttatggaggttttattatgtaggcataattgattaaagcattggccattgataatttagctcaatctccagtcctccttccctcccctgaggtcagagtggggctggggctgaaagttccagccctctaatcctgggttggtctttctggcaaccagcctccatcctgaagctatttagaacctccaaccaagagtcacctaatcagtataaaagccccatagttgaaaggggtttggtaggaataacaaagtacactcttatggctcaaaaaattccaagagttttagaaacaatgagccaggaaccagggtcaaagactacacatattttttattataccacagttgcaataaaagtgagactaaggggggcaaagctcccagtgtgttctgccccctccccaggtctgtggttgggaggcaggtgaccctccctccctccctgatcctggaaggatcttccttacgggtcttctcattccccatggtccccaagagtataatctcttctgtcccatcctttatacatagacatgcacacacatgtgaggcccaagaaattgggtgggagcaaggttgttggttcaggacacttcatgcctaagcccctgcggctcatcaaagtgtgacagtgggacttcttagctgctgttaaggaagtaatgacttaagggagggggatagccaggggtctttgttggatgatgtttcaccctggctcaagcacagtgctggaaatgtggggcaggggctaaatagaagaaacagcctgattctgttggggtggtctgtcttcttggacataagttgctatctctggcaacttttcaggatgaagtattcaacagagcttacttttggtgctacttctttctgcacagtgccacccttcttactttgagggctttctagtcttctggggatttccttagaacttcatttgttcctcttctacctatacttctggtccctccctctataacttccaccttcccagcctttgctaagcattctcgactctgagcatctcctttgctccttggtaatacaagcttgttagggagaaccacttgggggatggaaggatgccaggtctcttgaggcctataggagcagtttctgaggcttcaaattatcctgtactgggagagaaaaaaagatggtgggctggaatacaggaaggccccaggaggctccatgaggatcatttagatctcttcattgcagagagacctcatttctcatgtagggaggtctcttcactagcctctcaggatggctgatcactgcccctcagcagctaaatcccacagccccctgggagagcaggtggaggccaggccaggaaggactgcaacctccatggcagccactgccaagactgaggccactttgcagccggctggctgagttctgctctgacaccaaagcatgtctgccctggctttggccttcattacccggatgggacaggccagggtccagtttgcaatctgtgcatttgggtggtgatggagagcagctgttggccatcctctttctaacaagcatttgtatgcttaacatgcaccctgaagcccttatcctccccttcctctgcttctatccacctgttctctctgaggtttaatcaggagtgctgagcagagtggcatagcctcaactctcaaaggttgggacacccaaatgtctgagatggaaaacttagaccaagtagggatgatggaaaactagctgccaaaatagtcccagccctcatgccacagactttgttttagttcagagaacctttgtagctctgactttgcttccttttctaatattggcctcaccccactggccaagacagcccagggcatctccacggttaagactaaccagggctaggagtagttctcaagggctggcctagagcttgaatgagaggccctttcccagaacctgttgcattcttagttttgtcagagccttggaggtaggaattgatctataacttagagacagtacttcactagatagagaagagaacaaagtatgagtagtggtgttggtggggataatatgaacagagacctgaagtgagagtatatctgcttgtctggagtggcaggtgtgtgtaagggaaaaatgaggtggtgggggtgggcagcatccactctgtcagaggtgggggccagtgagggagagggaggagatcaggaggagaactgacaagccagtagatttaaaggtgtgaaacttttttttttaaatttatttatttatttattttttattttattttttattgatcattcttgggtgtttctcgcagagggggatttggcagggtcataggacaatagtggagggaaggtcagcagataaacaagtgaacaaaggtttctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgtttcagagagcacagggttgggggcaaggtcatagatgaacagcatcccaaggcagaagaatctttcttagtacagaacaaaatggagtctcctatgtctacttctttctacacagacacagcaacaatctgatttctctatcttttccccacatttcccccttttctgttccacaaaactgccattgtcatcatggcccgttctcaatgagctgttgggtgcacctcccagacggggtggtggccgggcagaggggctcctcacttcccagaaggggcggccgggcagaggcgccccccacctcccgcacggggcggcggccgggcggaggcgcccgccacctccctcccggatggggcggctggccgggcgggggctggcccccacctccctcccggaggggttggctgccgggcggagacactcctcacttcccagacggggcggctgccgggcggaggggctcctcacttctcagacggggcggccgggcagaggcgctcctcacctcccagacggggtcgcggccgggcagaggcgctcctcacatcccagactgggtggcggggcagaggcgctccctacatctcagacgatgggcagccgggcagagacgctcctcacttcctagacgggatggcagccgggaagaggcgctcctcacttcccagactgggcagccgggcagaggggctcctcacatcccagatgatgggcggccaggcagagacgctcctcacttctcggacggggtggcggccgggcagaggctgcaatctcggcactttgggaggccaaggcaggctgctgggaggtggaggttgtagctagctgagatcacgccactgcactccagcctgggcaacattgagcactgagtgaactagactccgtctgcaatcccggcacctcgggaggccgaggctggcggatcactcgcggttaggagctggagaccagcccggccaacacagcgaaaccccgtctccagcaaaaaaatacgaaaaccagtcaggcgtggcggcgcgcacctgcaatcgcaggcgctcggcaggctgaggcaggagaatcaggcagggaggttgcagtgagccgagatggcagcagtacagtccagctttggctcggcatcagagggagaccgtggaaagagagggagagggagaccgtggggagtggggagaggggagaggtgtgaaacttaagtgtaacagattagtctgtcatagaatccaaccaggagctgtgctgggagatgaggagatgaagaaagatgatgtaaactcctgggtttgaggagtttgatagtagaagaggagaactgaaagggcaatttcagttagcgatagccatatcaaaaaacttgttcatttcatattccatttgttgaactcctggaagtatagtgcttgatgccagggataccatggtgggcatgacagaggttgctcacttgggcttatagtgatggaggaccccctacaggaaggtggctcagtgagaatgcagaggacactgaaggaaaggcttccctgaggtggggtcattggagctggatggagagaggttttctgtatgttggaaggcagaggggaaaggaatcagtgttgacagatttataatcccatagaggagatcattgatggggcaaagttatttaggtagcagatggacagtcttggcttcataaatgtgatgagactgagaaattagaagcagaggctagaaagggacacagaaaggtggtagggatatagacagaaattgaagaagctcctattagatgtcttcagttttctgagccaagctgagggtggtcttctgctttgagcaatgaaagagaagtacccatttgggtgcttgagaaatggaaggttgggaagaactactgtggggaaggtgcttggacaaccaagaggtcagaactgagcatcacccagtattaggaaaagtccagttaacatctgacaacctgacactgtggtgggtgaggtttgttgacttccttgagtaatctgagccctgggcagtgcatacataggtggacagtgagatggctggagtctgaggaatgataggcagatcattctggggactcttgggttgtctctgggtatggtaagggagacttttgtccatctggcccatggggctttgtgaagccaggtttctggcaagctctggagagctttttggaagctcctctgaacctgctccaaccttccctcttctgaagacagggaacatcaagggaactctttgaggccctggcagtgcacagggcagggtgggggtggcaccccactagccactgatcttttggcagcctgtcaagagcccacatgaagcacagccttgtgtgcaggggctctgtgagccttttgttgcctgggtgctaatcaagctgattatatttctgttcatgtgggggttttgttttgttattattcataaactcataagttgttggtttttccttatttcccataatatgtggatttgggcaaacaaagattgagttttagtttaatttatttaattcccagaacagtctgtttatggtttgtgtaatgcagctgtttggaagaagagaaccatttctttggattaaaagtcttcagatttgattacctatggccataatgagtttatctgggcaggggtgagtttttaaggaatagtaatatggtatatttgtaaagttctttttccttaggggaaaaaagaaacgacccctgctccccaccccagtagccctctaaatgttatataaacatcatctttttaatctctattccatcatctcccagtttggtcaagtcattcaggctcttcttttttttttttttcgagacagagtcttgctctgtcacccaggctggagtgcaatggcgtgatctcggctcactgcaacctccatctgccgggttcaagcaattctcctgcctcagcctcctgagtagctaggactacaggcgcgtgccaccatgcctggctaatttttgcatttttagtagagacggggtttcaccatgctggccaggctagtcttgaactcctgacctcgtgatctgccagccttgtcctcccaaagtgctgagattatagacgtgagcctccgtgcctggccaagtcattcaggctcttagaggatgaggaggttgtctagtatctcatgaccaagaaatgactgagaggatcctagaatggaaggggtttaccaaaaaaaaaaaaaaaagacagaggggaaataggacccaggaattccagtctagcagttggatggggaaaggaagaaaactgctttttttttttttttttttaacatccccttgtgctaggtgctttgtgtatattaagtcctcaagataccccataagggagtagttatgttttctcttggtctcttttggagcccatggtccattggtaaaggggcttcagatctcattgcttttcccagatttcctttcttctgaagatggaatctgcggggtcatgatctgaaagcagttttatttgacgtctacatgggaacaaaataatgtgaattttgaaggcctttgacactgagagggggaaattattcaagcagacacagaattatcaagctgccctgtttgggtttctaagttggatcttagggattaattcttatgtccctaaacacagcagagtaagcagccctgtgtgcagtgtgatttgagggctgttagctggctttagattcccactgggttaaattgtagatgtagaggctggaggaattgttccctaaagatggttagcattttagcttccagtatttgatcaaagtatctagctgaggatactttggagttaggtatagaacagtagatttcaaaggagagggctcttttacaaagctggcagtaatggaggcacccagataaagtgtttcatttacaggagtccatcttagttttgaagttaagggatgtactttgtggggtgaagagcagaagaaaagttctaaggaaggctgagcatttttcacctatttgctggcttcatctgacactgctgatgcatatcaatgaaagtcttggttctaaagtggccgtttgaacacaatactcttttttttttttcttttccttgttttcatgctctcagttcttttcccttttcccctccttcacatcctgccctccctgccaccttaccttcctagctgcctctacctgcagctgactggcaggtggcagggatgaatagatggagaggtctgtagctgggggaatattttctcaattctgctagcatcaaagaaatgatttcccagcctattcttccagccacgtatttcgctgatcagtcagaactagaggaaaaacacattagcgttgccagagaggggatttgggaaaaatcaagtctgtggaactgagtgatctaaagtcataagcattaaaaacaaatcctggagtgcagctggaattcttcccagcctgcctcccacagccctgtcccttgacacacacaccatgtgccacatgaatagtttgtacctcaactttcccaaagatcctaatactaacgacaaggtgtccgtttgtgttgcccatcattggatatttctgggcataacatgggaaaaaaagcaatcccaggagctttttcccctttttgtgacctccgtgtttccataggcttgaaaaggcttcggaatagaactctcttgaattgagcacacctacatgctcatctatttttccctccatctggcaccagtccagagtgaggtctcaggagaacaatggccttttctttacccttaatccaggaaggtgcttcttgtcaagagaaaaaaaatcttctggttctatgggcagaaattcaagtggagtatttcgtcgtctttggaagaaagataaagcctataatgccctttcttcaatgagacacattcttcggagagggaatggccaagagctgagcccagattgtattttggcatttgattgttgctgccgtgccttgaatatagcatgtagtatagtgttttagagtcagtctacctgggttcacacctctgctctgtcttttatagctagtagctgggcaagttacttaattacagtaaagattaatgaactatccctctctgtaaaataggggtagtaataatgcctacttcagagggttattttaaatagtaaataaggtaaacatgaaatgtttactgtgatgccaggtgcatagtaatagctcagtaaatgttagctgttgttttttctgttgtattaaaaatcagtggacatcagatgaacccaaattgaggtacagtctgcagaataactaccagcacttttcaagtatgtccaggtgatgaaagacaaagactgaggaactgtcacagattggaggagacaaaggagacctgacgaccaaatacagtgtgatatcctggattagactgtgcaagagagaaaaacattagtggaaaaactggtgaaatccaagtagagtctatagtttagttactactgttgtataatttcttagttttgataattgtcctatagttttgtaagacgttaatagcaggaaaatctggatgaagagtatatgggaaactctgtatttttttttcttttttttgcaacttttctgtaagtctaaaattgtttcaaaataaaaagctaaaatagaataatgtctaagtgatctttttaagtaaaggagaaactcaccagggtatagctgtgcccccagcataacaggtaacacctgagtcagtcttgcctcccatgtcagaaggagggctcttactcagggatcccaacacctgcctcttaagcacctgcacacctgctgcatcctcaggcaaggtctgttctaggcagataattggtcagatagcaatgcagacacacaccccagatcagatcctgcagcggggccatacagcaactggggaggaggccactcatgtggcattaggactctctgcagggctgagtgatcagggcacttgtctctgttctttggaatataaatgaaattctgcctgttttatcctacctaagcaccaatcactatggcagtatgtttgtggattgtgatgcctacccctacgctcattgtttgatcatccagagaaagaaaaataatttcaagcctttgcagtaatttattattttctttcctgccaagtggcttgcttttgcacaaagcaggtattttgcttgcttttcttaagtgtaaaaggtacatgtgcttttcttatgactgatgtggccatccctgtcatgctaatagcagggtttgtagaagaaagccattatcatcattggaagaatgtgagtcttggagtttttatttttgctttgaagtcaggtatcgggggttctggaaagtatagagtctttcattctagcacacaactcccttacaagcatttaccctcagaagcccatattttctaagttaaaaaaaatcaatgctaaaaaacattctttgtattttaactcaatggctaagctatgctgctttttgctgttgatttacacatcttattgtcagacccttgggatgtatgtggattactcaatgctgtgacaaatggctaggctccgaattgtgtattatattacaggatagttcataaaccatatttttctgtaggttattttaggcataagactagtgaactgccatttctcttttagtcacacgtgactttaaaaaggtggaggatgccagtgggaaggagaagtggctggctcaagattgaatagccagtggccccaaaaccttgtgaatgcagaggcttgaagtggacagaccttgagtatggattgggaggattgagagagcagagagaatctgctggaaatcaagccttttgctatacctttgctcaggctagagcactagcagaaaaataactggcttctcctctcctggggcttctgagtcctgagaatcctgcaccatgagtgggccttccccactcctgcgtccccctcccctacacagccacttatgctgatggatgtgcaaatcctttacagacagtttggcacggcttcgcttgcagagatcatctgtctcttttgactgagcaactttatgtttgcggctccttttccctgcacagagagaaattgccttgtgccggcttctgccttctgatggaaatgtttaccttccctagggaaagccactattctttgggggtaatgtttgctggtgctctccaccccttttgggaacataagcctgtgctcaagggtggactggaggaggcggccgttggagcgtgcacgattgctaccggggcagccatctgccagtgtcgcggctcacagcctgcctctgagcaggccgccgggagggaatgtctgcactcccgggcctgcatgcattatgcacagcccattccctaaatgagctttctaagggtatataactcctttctactctgttcttgtatggcctgcctcaggacacctttcagaatctcccctaattatgcttctagtgccaagcatttagaatttctggtaacagctgaattttttttttgatagatttctgcaattgcagtgagggattgatttatagttatgggaggatttgcttcttccagggaaattatcaacactgcgatgatacagtttcatgtcagtggtattttgactatccaaagccacagtccagcctccttggcctgcctagcttcttctggaatggaccccttgtaatttgaggaggctgttctggcattagaatgaaatctgggcttccagttgccgaccaccaccttccccacatatcgcccccctcttccccaccttctcttcctgagatggaggagttttttcacatgctgcttagaaaaaggagattcataacatgactcaatcctcacccacggatctaggattcctgccatccagtaaattttggcaggcaggctgtgtgtacggagagcgagtcctgccgccctatccctgccctgctcccctcattgcgtgtgcttcttgggtggagtctgggttgcctagcctctcatttcttccgcttttcctctaagcagcccttccttcttctctaggattggccttcagtatctgtcaggaaaagaggacagtctctcacgttcctgggacttcacagagagacccttaggaagagttcaagtcctgaggtgtttgggtacttgccatgtgcctactgctgcattaaatacagtgaggtcatagcagagtgcctgggccttaagtcttaatccttaaccacagcctacctgggaatcaattcaaacaaaaagattggcagtcttactaacccactcaaggatctggatatacaggtgtccttgtgtctgtcattatgttgatatgtcagggtcgttgaggcctccaggctagtgctggtgatgctgtgatactgttgaaagtgagttactggtaacgttgggttttcctttgccctctgctaggggagaggagaggaaaaggggcattaggttctagaaaatccttgtctgtgaagactttggttaaactttgtcttccttttacccatctctggacaagacaaaaggaccctgaataacagagtagggagcagagtgggactttggggaatcagaggcagtgagagaccagcaggaacagagagaggacttctggcctaccagcctgttagaacaagagaaaggagtcccttcttcagcctggctagccagggacacccatgctcgacccattgttggcgtggtctaggaggagccaggaggcccctgcccagtctgttacctacaattattgttgctacctctgagccacgtgctgccgtctttaaaggctcacagctacagcagagtgaaaggtcctgagctgcttggctcctgcagcatggaggctgacacacagggagagacttaggacaaatctggaccagaccaggtgtggcttctttttaacctagccaataggaagcacttgttgtaggaaccctcaccccagtctgtgtagatgtgtctagagctgagcctctttcttccagtttggcctttgtgggctctccttcccatttctggcctcaacaaactgacctgccagcaggttctggagccttcccaggcctgcagcaaatagggcttggcaatgacaagatctgtggtagggcagcatttattggatgtcctttgaaattaactttcccatggtccataagtgcctcctgggagtttcttcagggtcctggcttcccttgaacttcatgcttatgctgactcccacacacatgtctgtgtttttcattttaaagatgattggtaatgaattgggggaggggagtgagaatttgctttcctctgcaccagaagtgcagtgctgctaatttcattctccacactttgtctctgagatgagcagggtccactgtgcccatgtttagtactgctgtgttgctggactctcctggcaaaaattaggctaatgtctccaacaactgcattagccactgaaatgaggttctaaattgaaggtactacaccaagtctctctccaaggtatcgccttgttctggcttttattattcaaattcattctctctgattctccacagactgactggcacgctggttcagtgcagcacattgtactagccgaaaggcaagatcaccttttaaaaagagggaggaaggaaaggggcagggggaaaggcaaaagaggaatacttgctgtggtgcaaagaatcagaactcttattctaagagctgcttgacaggcctgtgcaatgctcagagataggagagaaagggatcagacctagaatagggtggagcggtaccttgggtggggatgtcattgcggtagtggtatctatgccttgtaagttcactacatcttcttccttccctttcttgtttactgagcgcctaatgcctcacagggtgctgagaattttgaggtgggagaccaaagatcaaaaggacaggatctttcccttaagaagctcttgataggctgggcatggtggctcacacctgtaatcccagcactttgggaggctgaggcaggtggatcacctgaggttgggagtttgagaccagcctgaccaacatggagaaaccccatctctactaaaaatacaaaattagccaggcgtggtggtgcatgcctgtaatcccagctactcaggaggctgaggcaggagaactgcttgaacctgggaggcggaggttgcggtgagctgagattgcaccattgcactccagcctgggcaacaagagcaaaaactccgtctcaaaaaacaaaaaaaaaaaaaaagaaaaaagcagcccttgatcttagtttcatctgttttctgtcttgggtgctatgggaggggaaggaatgggaggagggggctggaccttaggattcttgcatattatattggaagtaggatactttcagcagtcagatgcctagagagttgagaatttggctcttatatgtttgtttttaaaatgactttctctctctctctctctctttttttttttttttttgcctgctgacaaagtaatatgttttcaaagcagaatacttggaaaacatagaaaaacacaaagggagacaacaacaacaacaacaaaatcacccaaatcccactgtgcagatgtaaaattaacattatggcttgtgttcttccagttgtttgcacaaaagtgcagtcatactgtacagactattttgagacagatactttccctttagaaatggagactgaaagttagagcctccagcatataggtataaagtgagccttaggcataaagtgaacattttccaggtgctgttctttaatatattcaagtgtatgaatataccaaattatacttaattcttacggttgggcatttagatggtttccagtttttcactgttgtaaataattcattagtgaatatacttgtatttattttgatgtattctctgtgttcttaggattcacacccaagtgcgtgtcttttctgattcttttcacccagcatttcagcgagggcaaactcttttccaggcgttttagataataccatgattttgagtatctctctgcactaacatcagatgccctggaatttcttctctatgtggtccctggattcttcttctttgtccaggaaatagctgggttcaggtgagatgggtagcaagaacagaatacacattctcattgttttgtgccaagatcgtaaggtccccagagacctcacattgtcatcatcccctttgatagcaagcagttattgaatgcctacctacctgtgtctaacccagaatcaaatggaggagatacaaaacaggtctctactctcagggagcatggtgactgattgaataacagaattaacatgaaagaattcacacacaatttattgagcacttgctatgtggtaggtatttgttctaggctattttggggggaagagaaaaggtagatgtgcttttcttcttaaaggaagctacagcatttatacacagtttatatacagttagccacacaggtcaataactgataaatatctgattgtacagacattaagttcaacgttggtagtcattgaagtgttagggttgctttggtggagaagctcattcactatgagagtaattaggtaaatttcagagaaaagataggagattaattggggcttggaaaagctggtatttgatgaggtggagtataaagggttttccaggtgggaggagcagcttgcaaagaggtagtggcagtaatgactgtcttatgatggtgaccaggtgtacggcagcacagaacagaggatggagaattacagagaggtgagggagagttaaggttatattctgagagttagggaatccagagcagtactaggtacacagtggatgagaaaaaaaacttgctacatttgtatctgattaaagggaaggtaagaaagtcttgatttttctcagtgccagaacgccccaggctcagtccttggacctctgctcttctctgtctacacttaaggcgttggtgactcatctagtctgatggcttcatgtttcatctgtatgctgatgactgctaggttttttttttatctccaacctaggcttctctgaacttcagatccatctgcctactagacacctttacttggataggcatcttaaatttaacatgtctaaaactgagctcctgcagctttccccacttcagttaatggctattctatccctttaatttttcaggtcaaaatcctcacagtcattctcgacccctttctttctctaagaccccacattctgtctgacagccgatcccaacagctctgtcttcaaaaaatatatccagaatttgaccacttctcatcacccgtgtgatcaccatgatctctcacctggattattgaatagacatctaattagcctccctcattctgtcctaattacctgcagttatttctcaacacagcagccagtgatccttctaccatgccttcctgtgcttagaaatatcctctggtgttccttctcacataaagtaagggttagctccttctttggcctgcacagctctgtgatgcggctcaccattacctctgtcatttcatttgctgctactctcccttatatttcctctcctctagtcactctggtcttgctcttgttccctaaacacatcaggctgtcacaccttgggacctagaatgttcttctactggatggctttgtggctagctccctcacttcccttagtctttcctcagaagtgactttcttcttttccagtgtccaaagctggattgatatgaagcaacaaaataagtaaggtaatattggattataactcaaattataaaataaatgtacatgagtctaaactcatttaaataaatgactaggggagaagaagttaaatctttttaaaaaaatttcatgttactttttgtgcatacattataggtgtatatatttatgaggtacatgagatgttttgatacaggcatgcaatgggtaataatcacattatggagaatggggtatccttcccctcaagcatttatcctttgtgttatgaacagtccagttatactcttttagttatttaaatgtacaattagattattattgactacagtcaccgtgttgtgctatcaaaagtaggtcttacttattctttctatttttttaatatccattaaccatccctatctccttgttccccttccccactccctttcctagcctatggtaaccatccttctacctgctgtatccatgagttcaattgttttgatttttagatcccacaaataagtaagaacatatgatgtttgtctttctgtgcctggcttatttaacataatgatctctagtttcatccatgttgttgcaaatgataggatctcattctttttttttaatgactgaatagtattccattgtgtatatgtaccacatttttaaaaatccattcatctgttgatggacacttaagttgcttccaatgttggctattgtgaacagtgctgctacaaacatggagtacagatatctctttgatatactgatttcttttcttttgggtatatatccggcagtggaattgctggatcatatggtagctctatttttagttttttgaggaacttccaattattctccatagtggtgtagtaatttacattcccaccaacagtgtatgagggttcccttttttccacatcctctccagcatttgctattgcctgttttttggatataagccattttaactggggtgagatgagatgatatctcattgtagttttgatgcacatttctctgacgatcagtgatgttaagtaccttttcatatacccgtttgccatttgtatgtcttcttttaagaaatgtctattcaggccaggtgtggtggctcacacctgtaatcccagcactttgggaggctgagagggggagatcacttgaggttgggagtttgagaacaacctggccaacatggtgaaaccccatctctacaaaaaatacaaaaattagccaggcctggtggtgggtgcctgtaatcccagctactcaggaggctgagacaggagaatcacttgaacctgggaggcagaggttgtggtgagctgagatcacaccactgcactccagcctgagtgacagagcgagactccctctcaaaaaaaaaaaaaaaaaaaaaaaaagagtaagaaaagtctattcaaatcttttgcacatttttttgatggaattattaagtttgtttttcctatagttgtttgagcttcttagatattctggttattagtgtcttgtcagatgggtagtttgcagatattttctccaattctgtgggttgtctcttcaccttgtcgattgtttcctttgctgtgcagaagctttttaatttgatatgatcccatttgttcatttttgctttggttatttgtgcttgtgtggtactgctcaagaaatctttgcccagaccagtgtcctggagattttccccaatgttttcttgtagtagtttcatagtttgggatcttagatttaaacatttaatccattttgatttgatttttgtatatggtgagagataggggtctaattttattcttctgcatatggatatccagttttcccagcaccatttattgaagagaccatctattccccagtgtatgttcttggcacctttgtcaaaaatgagtttactgtaggtatgtgcatttgtttctgggttctctcttctttccattggcatatgtgtctgtttttatgccagtaccatgctgtttgggttaccatagcgctgtagtataatttgaagtcaggtaatgtgattcctccagttttgttctttttgctaagaatagctttggctattctggttcttctgtggttccatataaattttaggattggtttttctatttctatgaagaatgtcattggtattttaatagggattgcatgaatctgtagattgctttgggtactatggacattttaacaacattgattcttccaatccatggacatggaatctctttccattttttggtgtccttttccatttcattcatcagtgttttatagttttcattgtagagatctttcacttctttggttaagttaattcctagatatttaattttagtgtgtaaatgagattactttttaaatttctttttcagattgttcactgttggcatatagaaatgctactgatttttagggctgggcacggtggctctctcctgtaatcccagcactttgggaggccgaggtgggcagatcatgagatcaggagtccaagaccagcctggccaatatggtgaaaccgtgtctctactaaaaatacaaaaattagccaggcgtagtggcgtgttcctgtagtcccagctgcttgggaggctgaggcaggagaattgcttgaactggggaggtggaggttgcagtgagctgagatcaagccactgcactccagcctgggtgacggtgagaagtcttaaaaaaaaaaaaaaagagaaatgctactgatttttgtatgttgattttgtatctttactgaatttgtttgttaattctaatagttttttgggggagtctttaagttattccaatgctgtaaccattccctggctattgcctatgttcactcaaggccctggggttctacaatgagcaggtagcaaagccagccaggcccatatccttcccttcagggcagccagctcccccaggtgctatgtgggacatcattcccagacggcacctcgctctagaggtgccgcctgggagtcagggactagagtaaaaaaccttagacatctacctggtattctgtggtattgcagctgaggtggcacttaaaccacaagacacagtcttccctcccctttccaaaggccacctttggaaagtgtggccaccaccactacaggcccatggggagtactgccagactaccaccgatgttcccttaaggcccaagggctcttaagtcagcttgtggtaaatgctgcctggcctgggactcacccttcagcgcagtgggctcccttctggcccagggtaggtccagaaatgtcatccaagagtcagatcctggaatctgggaccccagggccctgcttggtgctctacccacctgtggctgagctgtctcagaggcttacccaaggccctcagcatggtacctgggcatcattgctggttattcagggtctaagggcttttcagttagcagatgacgaatgctgccaggactgggtccttccctttaaggcagcaagttcccttttggccagggtgtgtctagaaatgtcatctgggagctagggcctagaacaggtgcctcacaactctgactggtgccctgttctgctgtggctgagccggtattcaagatgcaagatgaagtcctccccactcttttctctcttcttctcaagcagaaggaaggggcctcttttggagctgtgagttgtgcagcctagggttagaggagggatgatgccaggattcccttaggcgccttggctagtgtcttaggagattgtgtttcccactcttctgccgccccaccgtctactgtctctggttccagttcagcatttggactcacctgagagttacagtccttgcggtctagacaggctttcaagtttacttagagacccagagcactttagcctgtggcggcaaggtttgtgggaactcaggtttaaactgccgggatcggtgattccctgttggtgtgggctggtttaaatgctccctccatgggtgggcgtcagctgagtttggtccagtttttctatctgctctaataggacagtgtggagttcagtgcctcacagttgctgtgctctccctctgccagtgcccagagacattcttcataccatactgccactgttgggggggtgggcgttagcaatccaaggctatcttttctatctcttcagtgcgtctttcagcgacacagagttaaaagaggcactgtgaatgctcacctgatttttggttttcatgaaggtgcttttcttgtgcagatagttgttaaattggtgtccttgcaggagggacaattgatggagccttctattccaccatcttgttctgtgtcttctcaaaagttaaatctttctttctttaaattttttttttttttaaattttgacacagggtcttgctctgttgctccagctggagtgcagtggcacagtcacgactcaccgcagccttgacctccctggctccaccagtcctcccacctcagcctcctgagtagctgggactacaggtgtgtgccaccacaatggctcatttttgtattttttgtaattttgtattttttgcacttctcaaagtgcttggattacaggcgtgagccactgcacccagccaaaagttaaatctttcttgcagaagaattccaataatagggctgggcatgtggcttatgcctgtaatcccagcagtttgagaggccaaggcaagtggatcacttgaggccaggagttcaagaccagcgtggccaacatggtgaaaccccatctctgctaaaaatacaaaaattagctgggtatggtggcgcacgcctgtaattcagctactcaggaggtgaggcacgagaattgtttgaacccaggaggtggaggttgcattgagctgagatcgcaccaccgtactccagcctgggagacagagtgagatgctctcaaaaaaaaaaaaaaaaaagaattccaataatatatatatatagatactcccccctctagaaggtggagcttacatctttccagttgggctagacttactgactcatttctaaagaacacattttggaaaaggaaaaatagtcactttacagtggagaaatctggtaagtactacctgtgatcaagggtatcaagtgagccagggtaatatcaccagtgttgtcatgtggatatgatgcaccctatggtatgatgagacaaagggacactttacctttgtggtattcttcctcaaaaccaacgaccccagtctaatgagaaaaacatcagacaaacccagatggtggaacattctgtaaaatacctgaccagtactctgcaaactatcatggttttgataaacaaggaaagactgagaaactggcatagaccagagaggacatgacatgtaaatgcattgtggtattgtgaattggatgctggaacaggaagaggatattcatggaaaaactagtgaaacataaagagtctggagtctagttaacactaatataccaatgttggtttcttagttttgacaactgtactatggtaatataagatgatagcattaggggaactgaaactgagtaaatgttgtacagaaattctaggaactctctgtattatcactgagttttctgtaagtccaaaataataccaaaaacaaaactaaccttgtctatgaggccatctctgtctaccctttcaaaaatgttttagcctttcttaacatttcatatccctttccctgcattattttgctccttagcacttattatttaatctatagattttacttagtgttgtttattgtctgtttccactactagaatgtaagccctgagtggacagagattttggtctgtcttgctcacatctggatcttcagagcccagggctgtgcttggctcataacaggtattcaataaagattggctaatgaatgatagaatgaattctgttgtatcacctgtttattcttaaggtgtgtgaggagtttgtgtttaggcctttgtttctcttttgagatttccagtggtttcccattccaatggggacatgattcctattgtttcttttccacttttgctcagcatggaaatgagagtcaggttggaggtgggttgtacagaaacacgatgtgttcactccatcagcaggaagagcaaataaatagcttcatttactactttcctggcagaaattgtttccgctgcaggtgagggctggtttatgatgataccctccccatttcatgtttaaacctgaaacatgatccaggactggcttcctgagaggaggaacacttatttctgattctagttcagcccatgacagatgtggagtatgtgtggatttgaagacagtgggggaaagcatgggactttttgatgtggagtaaagccagagaaggaaaattcatctactcacagtatgtattgagcttctctttgccatgcactgaaaatttatagggtaaagatagtgggaatgtggactggttcaacaaatcctgttcagtagagcctgacatcatgtgatcccaagggaattaaatttgggacaaatgaaagaaaatttacctcacacagtgtgttgtagatacagagttgaaaggatttaaaagtaccttagaaaaatgtaatgggtaagggattgaaagagttttgaagacctccattaaccatcacggagaagaaccaatctcttctatcctcagcgcaatggccagggtatggagattgtgtcaggttattaccttttcacacacacggactgggttagtgtgggaagagagatggagctaactgcgctctgaaggattgtggacggcacctgttcaataacacctgtctccctgtgttagaacttgatttatctctgtcttagtacattttatgctgctgtaacagaataattgagactgggtaatttctaaagagcatagatttatttcttacaattctagagactgggatatccaagtttgaggagctgcatctgttgtgggcctagttgctgtggcatacgtggccaaaggcatcatgtggtgacagagcaggtgctggagagagagcagaatggggctgaacttgccttttgtgggggggaacaaaagagacggagtgttgctatgttgcctgggctggactcctgggctcaagcaagtcctcgcgtttcagccttccatgtagttgggaagctaggactataggggcacaccactgcacccagctggacttgcttttttaataaactactcttgcgaaaacttacccactcctgtgatagtgacattaatcattcatgagggcaaagccctcatgacctaatcacctctttcaacattgtcacattcaggattaagtttccaacacatgaactttggaggccacatttaaaccatagcaacctcataatatattttaaagcttccatagaatatacttcccaaagaatgaagtcatactgatttgaggcctgaacaaggtcattaggagcaacaaaatgtaagataaaaggtatttcccttgtgcctggcactctccatctcctgttgttttcatgttcccgttgtcttgagcccaaagatgtagcggttctgctttctgtttttggtgtggtgcccatcatacctgtggtgttctctgaacaaaggcctgttcctgctgggcacaaaaattgggctgggcttggggctatagatttcttttggagataaataagcagggtatcttgcatccccttccatttcgcctgtctcaaggaagaggccaagggtcccctctttttgcaagtaaaacagaatgtactttcttaaaacgatttaaatatcacagttgggttcaatttatctacagaaatagacttatataaaaggaaaacttacaaaggagaaatttctaccaaataatgggctccctttttgttaaaatttttttcctacctttttcaaggtcatccagtttaaagtctgagtgtccaagaaagaagggaggggaggcctagagggagaagggaaagtagaagaaacagaagtacttatagattctttagggtaaatctgaagtcttagtgatcatatgctttttatcagtaccagcgatgcagcctgccaggggtttcccctccttgacctttttcttcacctcctgctcccatactcccgttggatggtcaggcaaggagggctggcctcaagaacctcagctattctaagtccttagctctgcctgtctgctgtttcagccaaactagatggcctaagatctcacacagtccacttactcccatttccagccttggtgtgaaccctttcccccatctgcagggctgtattgcaaattacagctgtgaaacaaattgccaccaacttagtggcttcaaacaccgtctcatttattatttcatagttgatgtaggtcagaaatctaggtcctggttagccgagtcttctgttcagggtctcacagcctgaaaccagggtgttggccagcctgtgtccctttctggtggctctggaaaagaatctacttccaggctcatccaggttattgccaacatatctttgcagtcacttcctagaagtcagacttctgggtcagagggtaaatgcagttataattttattagatgttgtcaaattcccctttataggggctgtatatgcaaatttcatttccctagtctcgcctgcaaagtacttacaacctaataggtggaaagcagttttctactgtagttttattttatctttgtcatgtgatgagcaaagttgaacatcttttcatagagtcaaatagcattgtatttctttttctgtgacctgcctgtttatatctgtagtcttttttttctattgtgtttttggtctttttctccttattttttaaaagttttttatatattggggatattaacactctatgatattaaattgcagatactttacctagtttgacatttgtcttttttgcttatgatatttttccatgcatttttattttttataaaactttttatttttgcataatcaaattaatatttttgtgatttcttttggattttgaattataattaggaaagttatttactttcaacaagttgttgccaccaacttataattaggaaagttattatttactactcccagattatagagtagttgacctatgctttcttttggtacttatatgttttcattttgtatatttaaagatttaatttgtttggaatttatcttgacatgtaggcataagacatggggttaatttttacctttttcagtatgtctgttgagttatcccaacactgcttattaaaaagtttgacttggccaggtgcagtggctcactcctgttacaatcccggccctttgggaggctgaggtgggcagatggattgaagccaggtatttgagaccagtctgggcaacagagagagatcctgtctctacaaaaaagaaaaaaaattagccaggtgtagtggtgcgtgcctgtagtcctagctactccagaagctgaggtgggagaatcgcttgggcccaagagtttgaggttgcagtgatcatactactgcactccagcctggccgacagagcgagaccctgtctaaaaaagaaagtgctttccctatagatttgagatgctgctcttactgtatattaaatttctgtgtgcagttgggtctgtttttgaatgttcttttctgcttcattggtaattctgtctattcatgcaccagtatcaaaccattttaattgtagaggttttgcaatatgttttattatccagtaggtcattctagttttatttctgtgcgctcctgtttgtgtgtatgtgtatctagatggcagttggagacatgagaactgatgagccccagaagagaatcaagagcatcctgagaagtttcaactcttaacagtcaggtagaagagggtgagctggcaaaggagaggctgtagtggcaggaactcatcaggtattcagtctcaaggaagtcagggcagaatacttactttaggactgaggaactggcctcctgtgtcatgtgctgccaagaaatctcaggaggggaggagtgagaagcatcagtggttgtcactgggtgagagtggagtggtgtggagtgggctttggagtgaatggcgggtaaggaggtctagacattccttgagaagttatcagtataagaaaaatgaaaggagatgagaaaagatgctacccagaagaggtctagggaagtttttctttattctttttcttacattgaggttaaatttatataatataaaattaatcattttaaagtgagaagctcagtggtatttagtacattcattatgttgtgcaatcaccgcttctatttaatccgaaaacattttcatcacctcaaaaggaaatcccatacccgctgagcagtttatccacatttccctatcctctaacatctgacaaccacaaagctcctttctgtctttatggatctactcattttggatatttcatgtaaatggagtcatacatacatgagtttttgtgtctgtcttctttcactgagcataataatttttgaagttcacccatgatgtagcatgtatcaatacttcatgcctttttatggctgaataatgtatcattgtatggagataccattgtatggacaaatttgtttattcatctgctgatggactctttatgtcttttttaacaaaaagaaactatttataaatgctgatgagagactctagtacatagggacaggtggaagcttcaggagagagggtgggtaagaagtaaagttcttcaaaaggtggactccatctgtttgctggtgggaagctggggagaccctgtctgacagcttctgtttgctctgtgatgtagaaggccaggcctccactgagagtggagagtcagaagttcaagggaagggtaagaatctgaactagtgattgagtagtgagtagtatgtgctaactagagaatgtggttatgatttatgggtggtgctggacagttgaaatcttttcccactgtttcagttcagaaaaggccttctcaggagtctttcaaatgttaaatagtcacagaggggatatttactatttctgcctcctcctttctaagacagtgttccaaccgtatatactagagcttggagttctgccacaaacagaacccacaaggtgtagcagcttctcaaatttgaaaaacttttggtaagtgttgtgggttgggttctcctgaagccgatgctgagatagaggtttgaatgcagtatgtttattagagatcgacccctacaaaaggaagggggaggaagtaggatcgggcagaggaagcagtcaaactttgatgtaagcctgatgaagtcttgtgcatcccagtgaggagttctgaagtgagtattgtccttcagatgatcctgaattaggctaaaatggttaggtttttatatccatgcctggctcagtcactagttacaggctgtcctaaacaatcatgacttcatgcaaagtagctctctgcaactgaggcagaccctgcaggagctgaaaagtgtagactgtctgctgaccaaagccaagtcttcccttgaaagggccatggaggattctgggcttatctgccacagtataggcagtctagttgggagtccagctggaatagcttggagtccaggcatgtgcgcactggacttccttcacaaggactcttcccattattgccccagaaattgttcttagaaactgagctgatggacaggagctgggtggggtagtggaggtggcatcagaagttacactctgcttttcaggtagaatgagctcagccctggcatttgaggacagggcatgtgttcccatggggaatgaaatcccacttattagaaaggctttattgtcagccagtcaactgaccaggaatgatttggattttgaaaatgtatcatgatatttttgacttcactgttatttgtcagagaaatgacaaaaaggaaagggcacttagtcagcagtcagcaactgtttgctgaacaagtgaatgaaagaatcattgtgggcagaacagcagcaggaagcagagggtcagattctctgtcatcttttcagaggagtctgagctccagtggcagcagctccacgggcctaatgattgcttagcatggaaagagagggcaaaggatagaacctggagcagaggcagtgttccatggtgggccagggaggtacctacattatggtggacatggatgccagctgccttggctggtttggaggagggagggagtgagcacctggctgtgggtgggtggctggatgctagccacattagccacttgggatgtggaggggtggtctggtaacctctccctgaggaggctttttcttcttcccattgtttgagaacttggtgtaagggagaaggttttctcttaagcccagttgctcctatatcctgagaaactctagggtccatacccacttctcctgtggccttcccctacttttgacattttcctctcataacctgtcagcctcacctcctctattgtcttctctcccagaacttaaaacagtatgactgctccctcaaaacagtatgattgctcccccagttcccataagcctattgtttcacctcagggagccaggactgtagcccatcagcagtcatcttatttttattttttgagatagggtctcgctctgtcacccaagctggggtgcagtggcatcatcatagctcactgcagcctggaaactcctgggctcaagcagttctcccgcctccgcctcctaagtagctgggattataggcctgtcttggttcttagagtctttcaatgtccttgtggcctcactcttccccacacagcatggacctcatggcacctatcatttctaagatacttaccaacccctttgattcccttaccctgttgtcatatgggaaagagatgggattgtagcaggatgttggattaggaatgaagtaatgcctagagggtggaagttaggatcctggggtctgggctggtgttgatgtctgattgttggcctgaagagtggagtatgagttggggatgaagaaagaaatatattggctaggtgcagtggctcatacctgtaatcctactatttgtggaggctgtggtgggtggattgcttgagtccaggagttcgagtccagcctgggcaacatggcaagaccccatttctatttatataatttttttaaaaaaagaaatataattaattattattattatctttttcaaatggagtctcactctgttgcccaggctggagctcaatggcgcgatcccaactcactgcaacctccgcctcccgagttcaagttattcccctgcctcagcctcccaagtagctgggattacaggcatgtgccaccaggcccagctaatttttgtatttttagtagagacaggttttcaccattttggccaggctggtctcgaacacctgacctcaagtgatccacctcagcccccaaagaactgggattacaggcatgagccaccatgcccggccaataatttattttaaaattcatttatggccaggcgcggtggcttatgcctgtaatcccagcactttgggaggccgaggcagggggatcacttgaggttaggatttcgagaccagcctggccaactggtgaaaccccatctctactaaaaacaaaaaaaattagctgggtgcatgcctgtaatttcagctacttgggaggctgaggcaggagaattgtttgaacctgggaggtagaggttgcagtgagccgagatagtgccattgcactccagcctgggcaataagagcaaaactccgtctcaaaaactaataataataaaataaaataaaaataaaaaaatgaaactcatttatgtagaagttaaatttggcaaattgcttcttcttcttcttcttttttttttttttttttaagacggtctcactctgttgctcaggctggagtgcagtggtgcagtcatggctcactgcagccttgacctcccagattcaagggatcctcctgcctcaacctcctgagtaactggggccacaggtgtgcaccaccacacccagctaatttttttttttttttcggtagagtcggggtttcagtatgttgcccaggagagcagttggtctcaaactcctgggctcaagccatcctcctgccttggcctcccaaagtgttgggattacagatgtgaaccaccaagctggccggcaaattgcttctacatctgttgtttcactggagtccattgttagctctttcctgactccttttcttctttcatctggaaagatgtagccatttatcaaggctgtcataaatattgtttcttctgtcttcactttctccctcagagatttctggctcgagccctcattgccatgcagatgacatccaagcctgtgtttccagcctcatcctcacttgctgtgccccatcccatgttttcagcccctggtatatatttgcctgtcccattcatgctccacagtcttctaaaccagccttatgataatttccctccaaacttgttcttcctgttgaatcatgacatcagcattctcccagttacctcaccttgaaacttgggcatctccttccttcctttctcccagcctagtcacttgcattgctctgtcccatcacttatttccattcccactgctctcgtttccactccatgacttctttcaaagccatgccaacagctccctacctagttttcccaacgccaggtgtatttgcctctcagtgcatcatacaattgctggccaccatattagtctttcaaagccactgttcttattgtcacaagatttttccctgaagaaaccgaagtggtttcccactgtttagagttaagatccaacttctcaacctgaactgtgaggccccacgacctccccctttctttccactgtggtcctgtacacactcacttcattttctagccatgggactgcttctgtttcccctgattgtgccctggactttccttcctccctgtttttgttcatgctacttttcaccctgtagctttttctcttctctccttctccactcccccgtcccttagcctgtatcatttttacctgttaaaaccatattcttttatatccattgcaatggaatactgtggcactgttgggatgtacatttgttgccacagaatgctattcacggcatgctgctagatggtgaagcatgttgcacaacagtatgtatggtatgattccattctagaaaaaattattagtgataagtgtaaatgtatatagagaaaaaaatcaaaactgtgcccttgttaattactatacttgagaaatgatgattatgggaattacagtgtgagaatatattcctgtaacatttgattttttatttttttttatttatttttatttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagttcccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacatttgattttttaaaaataatgtttgtgtatttttgtagtgatgagaaaacataaagcaagaaaaaaaattgtcctcaaccttcaaggtacatctgaattttcacctccctagtttctcccagtggcaggtgctcttacttatattccccttcccctccacaccctctttcatgaagctcacatcaagcctcaggttacagtaatttatggacttgctttattccctgcttcttgctcctaaatcaggagcagttggtatcatttgaatccttgagcccctgcagggcctggcccagtgcccatgctcaaagactgctgcttcagtgctttttgagttggcctgctctctcctgggtatcctggggccttcctgttcgtctagttcgggagggactgactttccatggctggagctatatgactgatggggctgatctgatgggcttaatccatgatcagcttcctgactaggatctcactgattatgattgataagaacgtgattggaagtttcacgtgtgttcctactgatctctagaggaatccattcccacatagcaaccttggccctaacctggcattagataaattcagttcagcagttcatcaagacaccaagtaattgaagtgtggattgctgccttccaagaatgacaggaagaatgatagaagggctttggaccaaaggggctgagctgttcagcccttagggaatccattattataccagtctccaccaatttctcttttgagctttaataatgtctgctttgcgggggcttccaggccctatcttggaacatagattctggtctttgtatcaaatgacttgtagcacatggggagagactttcctattttgtttcaatcagctttcttggggtgggcagggaaggtgttgacagctagtcaggatttggttgttcctgaggtgctgtcagactcagcataccctcacactggctcagacacagagaagaggcagtgttgggcaatggaagagctgcttttgaagccatacaaacctggttagagactcagttctatcatcagcctgaaggctgctctaggcagggaccactgtgagttgcaggatacaaaatgcctggtaatttctgtttggtaaacatttgtcgaattgtactagttgtgtaaccaaagaattctcatctgtaaaatgggaatacctgccccatatgattgttgtgaaaattaaacaagatgatgtgtgtatagcagctattctgatgcccagtaccaagtggtaatttgtaatgctagatttcttttagaattctgccctcttcccccttatgctgttaaagattagaagtcttctcacttcctctgtacatatttactaggctgcaatgagaatggcttgggctggtctcagtgtgtttttgttttttttgttttttttttttaagacagagtcttgctctgttgcccaggctggagtgcagtggcacgatctcagctcactgcaacctctgcctcctgggttcaagcgattctcctgcctcagcctcctgagtagctgggattacaggcttgtgccaccgtgcctggccaatttttgtatttttagtagagatggggtttcaccatgttggccaggctggtctcaaactcctgacctcaggtgatctgcctgccttggcctcccagagtgctgggattacaggtgtgagccaccgtgcctggtcttctgtggttcttgtagccattcacatagtctacggaggctccattcatgacagtggttcatggcacagcagggtggtacactgtagagggccaagaactagggagggtttcttgagctctttgtcatgttttcttatttgtagaaaatatctgccctgtctaaaatttatattgttagctgggtatggaggcatgtacctgtagtcctagctacttgggaggctaaggcacgaggatggcttgagtccagaaggcagaagttgcagtgagccataattgtgccactgcactccagcctgggctacagagtgagacccagtctcagaaaaataaataaaaaaatttatattgcaggccacatctaattgtttttgaaagggcattttctcaccttcattattcttgagtgactctgtgtcctgtagcatgctgcccttcccagtgccctgcctgcacccacttcccttcccttgaatgtctgtcgtaggacaggaatttatcacgtggatcaacattgacgccatattgcgataacagtggttaatgctgtgcttagtgaggtagtccaactcttttttagggctgcctgctaataaaaaggattttaattagcttttagtgaaatacacatatatggaagactgcttaaatataaattgaaactaatttaaattctatgggtatgggactggcgaaaaacaaatatcataaccaacttggctactttggttataggttccaaatattaaatatagtttctgaacatcctggtagccaagacaaaaagggaaatatgatgaatcacataattgtcacttaattaaaaagctaatagttctcagcagtcagttgtctgctgagaaagcagctttttcctggtgctggtaagaattgatctaaaagcatttttatcatagagattaaccatgtactggacaatgacaagcttgtttcagaaaagacaggaatggattttgcagtctgttccttatgtaatagaccctgaacaaaatttgaggacatacaagtggtgttgtatgagtttgtcttttatgggacaaatctaatgtgtatgcttctgtcttaagctggtactagagtgcaatatagaatcctcttagtagaatacatgaagagcctgtcctttaggctatctttctcaaatatctgctctgtcaggttggtttttggcagagactgaacagtagtcagattaagattaaaagctctagccaggacttggcataatctagctagccagtgttcaatctttcaggacaacattagcccacagctttttctgtggaatgatccatttgtgtccacactgtatgcattgtgtgaaaatgaatggacgtatgttgacttcttaattaaaaaacctaatgatttaactgttttcattagtgtgtccaatgggtggtaaaatctgtatccagcaagttttatgtttatatttagttttatttggagaaaaatacatcattcacggtctattgccaagtacaataatatgtgccaccccccacccccagtaaagttggtagctttcagttatgtaagaaattattttgtttaagatcagaagtgtaaatataggttttggagacttgctgagagatgatagctgtggctacatgagagaaagtaggaatcccaggttttcaagtacttgcttttggttttctaaagttggactttgtgtggggaagaaaaaagtcattgtaaaatgttggtgtagccagtgcatatttgctaatggagatgattccttcaaacctcagaaatggggaaaaccccaagggctgtatttgaataaaatggttgtgaagtgattttcttacttttttgaacttttggttttagttagtcttataagacattattcagtagagtttaactttccattttgttctatttgcagccacttgaactaaaatacagtgcagttcattgtccctttgccctttgttagtaagttattttctatcctgtcttcctccatctctgaaagagttctcttgaattgtttgggagggcagcacattctgtacttgtttttatccattatttatgtttgcattcaattatactcagccttcctttcaattgtggagatggcccttgagcttttttgtttcagggagttgggtatctgctataacaattagctatggagagagcgaattacccataattcttgtcctcagaagagatgtagtgctaatgggcccctggtgtcctagctgactactctggagagccactgctctggtttactccttggctcagggtctcctgaattggaactggcaggaggtactcagtgtggtaaaccagatttgagtcccccaaaggggcctttgctgcaaggcgccaggattccactcatgcttgtgctgcccaccatgcctctcaaagccccttttcatctgatgtttcactgggcccccacaatattccagggatgcactatttgtgaaatgaagatctacttctgtgctatctgatatggtagtcactaaccatttgtgattattcaaattaaaattaacattttaaaaattaaaaattcagtttcttagtatcactagtcacatttcaagtactcaaaagccacatgtgaccaggggctactgtaagggccagcatagatatagaacatttctgtcattgcagaaagttctattggacagtgctggtctagaaagtgaatggccaatactggtctagcttcattgactgctgatgtggaaacacagtgtcccctctctcactgtatctcttaaacagctgcttggtgactatcattattatttggcagttttgttaattgaaagtcatcaagtgaaaagtgctagatttttctagctaaagccactggcaataatgccaggtctctgcctcgtgcctggcatttgatgtgtgcagtgtggtagtggttttttatccactgggatcgggaagagttgacatgcaggttgtgaggccgagcagagaagccacaactggtagtgcagctggcctgtgcaagttgccttgccttctcctgctgttctgcgtctccccagcaggaagtggtggagaaagcaggtctggtgaaacctaaaggatcagctgagaaaatgcttagctttcaagacctatattctaaaaatcaagtctggagggcttcaggagagatgattccagaaattaaggcctccccttttttttttaaattcctttgaaacctggaatgagaattaggaagttttttgtcaattacaatttttgcccattataattctttgtaacttaaaaaatttttttttggtagagatatggtctcactgtgttgctcaggctggtctcaaactcttggacccaagagatcctctcaccttggaaacccgaagtgctgggattacagatgtgagccaccaggcttagccctttgtaactatttttaggcaaggtgagattggtcaaagaaaagtgtgcagtaaccaaatattgtttgtgtacccagagatgtgaatgtgagattttgcatggaaaaatacatccatattgcacaagtggctcaggacccaaactaaatatctcatctctcagttcccctctggatgggtgccttcttgctctgtgctatagtttgtctggagtgtgatagagagaatgaggatgatgaggaagcacaatcatgtataccactcccccgcaacactataatctcctcctcctagggtgcactaaagcatatgatttggcctagcataatctgaagatttggatcaaagagctgactctgtaacaatgagatttgattagtaggattttgggtgtgttggggttatcaagtgtctttttgatacctctcaactcccatcactccagtgactgttttggtgcctctgtgtggaactgtgccctctactctgccctttcaggttgaggttttctcaaagaggaggcttttgggaaagttcttgctgtatggtgagatctctgtttctgagcttaagaggtaaggtagtagctgttgggaaaagctaagggggttaaacagtcagttcctgagagaattaaaaaggttgctagactggaatcacagtccgtaaaacaacagtttagggagatggagttttgttgtagattgggtcactgtaaagtgtctaaaaatgtaaaataacaagaaaatcttggcttgggtttggatagtagaaatgtaggggaaattgagatatatatcacggttttattctttttgtagtttggaagtgatttatttattttgtatccaaaaaaggaattgtattttgttcataaaggtattatgtattaagccacatgaaatcccagaaaaatttgggaaacaacttgtttttagattgaatgtgggggagggaatagttaaagaataagaattagccctggggcagggtcagaggtggtggggaagaattgctttttcttttttgagatggagtcttactgtgtcgccaaggttggagtgcagtggtatggtctcggctcactgcaacctccacatcctgggttcaagcaattctcctgcctcagcctcccaaatagctgggtttacaggtgtgtgctgccatgcgcagctaattttttgtatttttagtagagacagggttttaccatgttggccaggatggtcttatctcctctcctgacctcgtgatccgcctgccttggcctcccaaagtgctgggattataggcatgagccactgtgcccggccgagaattgcttttttctttctttctggtgactcttttgttgctcagtttaggtcactgcggtctttgagtaagagtgaccattagccataccaatagaaggggaattggtttcttagtccactgtactggtgaaataatgaagtggctataaatttgagctttttgacattgtgtcctcagtttttttatgtctactcacttgttacaggccctaggaataatcagatttactcctccaaattggaaatggaggaactctgaggtactgtagcccagagattgattgcaggatggggcaaagcgcaaatgactgtatcagtatcagctttgctattcccaaggtctatatatttggctgttttagtggctttccatgtaatgcatttgacttttagcttctgttactaaagtgaaatggtaacatattctgttttccatttgtttatttatggtcttgttttctacccttgcaaaacttgatataggtacaaagcttcagaaatgtacacataccagagtaatagataactctgattttgttacaaggcaataatttaagttgacaggtttagctgataacaaaacacaagagagaaataggatcagtttataaatgtcagcagaacccctgagagtgagttgctgccttggaactgattccggtactgttgttttgtctaatatattataaagtgaaataaactgatgtctgtgaaaatctggctgaccaagattaaaagaataggactgtaaattagctgcttcccttatgtcactttaagcaactttcagaagggactaaatgacaggacattagggtcttgggaaggacttgaagtctagcttctctggaatttcaagataccaagagcatggatgggcctgcttggcagatcgtattgggaatgaatcacaactggccagctttccatgccctactgtgcctctttcctgggaaaatggaaccttagaatggaggagattgtgaagtccagatgcctggaaagtagaccttgtgaaaggtcattgcagattctgtcattatgacagccacagcctccaaaaggagattgtgaaatattttagtgatttggcaaaactaaaatcaattcagtataatggggcattgacacacagaatcaccatctcccacatagaaaatagatattcctgctttaccttgacatttattccccataaacacactagcgtttatgtagcattaccttatgattgtgttttattccctatgacatgctctgttactgatgtctgcagagtcagggaggcggcagcgactgtgtagggtgtccaggagcagtttgtttttaaggaactagtttcagttttgcatagttagtaggagtagacataaaaactaggcacacgtatcattttcatgcatctcagtggttgctacatactcagaaaagtccttggattattgcttttcctctatagagtagtttggactaatgtccttgttttgagatatctcctgctgcagagggaaaataaagttctaggggatgggagtttttaaaatgtcatgcttccatccatctgcctccaggcagaactgcactgaaccctgtccaggttggttaggacactcttctttcagaggtttctgtggatagtgctttcagactctggttggtaatttctgcttctcagtcataatgggtgtttagtattaaacataacctcataaaaagagattctggccaggcacgatggctcacgcctataatcccagcactttgagaggccaaggcgggcagatcatgaggtcagaagttcaagaccagcctggcaaacatggtgaaaccccatctctactaaaaatacaaaaatcagctagacatggtagcatgtgcctgtaatcccagctactcaggaggctgaggcaggagaatcgcttgaatccgggaggcggaggtgcagtgagccaagattgtgccattgcactgcagcctgggtgacagagcaagactgtgcctcaaaaaaaataaaaataaaaaagacagagagagaaagagatgcttagttctgaaggcaagaggggatgaagggaaatgattcctattttaaaaaactctttaatcccttccactcccacctcacaaactacggccaatgtgggagcaaatcctcctgaagtacacattctctttcactctggcttcactgtgcgatccttgagggtcagattggctggtcaggtgagggctctgttcaaggtcatgtggaataaaggcattgaggttgaactcagcatcttgttcgttgatttgcatttgtgcaaggcccctgttcccagacttctggaccatttccttgtaaagcctaaccctagcaaaatatctgtcaggtatttcattgtgaatatatagtttatatttttatttatgtatattatttgttaaaaattgacaggaaaatttgtatgtattttccatgtacaacatgatgttttaaagtataaatagaccagccatgatggctcatgcctataatcccagcactttgggaggccaaggcaggaggattgcttgaacccaggagttcaagaccagcctgggaaacatagtaagaccttgtctctacaaaaaattaaaacattagctgggtgtggtgatgcatgcttgtagtcccagctactccggaggctggggtgcgaggatctcttgagtccaagagttcaaggttgcagtgagctgtgattgcactactgcattccagcctgggtgacagagtgagtccttgtctcaaacaacaaaacaaactaaagtatagctatgttgtggaatgactaaatctagctaattaacatatgcattacctcacatagttatcatatttttggtgagaacactttacattctttctcttggcatttttcaggaatacaatgtattattattatttatgtatttttttttttgagatggagttttgctcttgttgcccaggctggagtgcaatggtgtggtcttggctcactgcaacctccgccccagcctcccaagtagctgggattataggtgcccaccaccaagcctggcgaattttttgtatttttaccatgttggccaggctggtctcaaactcctgacctcaggtgatccacctgcctcggtctcccaaagtgctgggattacaggtgtgagcaactgcacccagccacaatatattattaactatagttaccatgttatacaatagatctcttgaatttattcctcctatctaactgaaactttgtatcctttgaccaacatctccccagcctctaccccacctcctcaactaccgcagtcctggttaactatgattctgctctctgcttctatgagatcaacttttttagattccacatgtaagggagataatgtgtatttgtctttctgtgcctggcttatttcacttcacataattcttctaggctcacccatattattgcaaatgacaggatttccttattttttatggttaaacagtattccatattttctgtattctattcctgcattgatggagattgaggatgattccatgtcttggctattgtgaataacgtagtaaacatgggagtgcagacgtctctatgacatgctgattttatttcctatggttatttacccagtagtggcattactggatcatatggtagttttatttttaatttttaaaggaacctccatactatttttcataatgactattctaattcacattcccatcagcagtgtacaaagcttctcttttctgtacatccttgccaacacttttcttttgtctttttggtagtagccattctgacaggtgtctggtgatacttcattgtgattttaatttgtgtttccctgatgattagtgatgttgatcttttttttatatacctgttggccatttgtatgtcttcttttggcaactgcctatttaggtcctttgcccattttaaaatcaggttatttgttttttgctgttgagttgagttccatatttattttgggtatttatcactatcagatgtacagtttgcaagtattttctcccattctgtagattgtctcttcactctattgattgttttatttgctgtgcagaagctttttagtttgatgtaatcctatttgtctatttttgcttttgatgcctgtgcttttaggggtcaaatctaaaaagtcattctcagactaatgtcatggagctttcccactgtattttcttccagtagtttcatggtttggggtcttatatttaagtcttcaatctattttgatttgattttgcatatggtatatgacaaatataccaagggtctaatttcattcttttacatgtggatattccattttgccaataccatttattgaagagactgtcctttccccattttatctttgtggcacctttgtcaaaaatcaattggctgtaaatgcatgtatggatttatttctggttttatattcgcaatatacttttgattcgttgaattcatctctatttcgcaggatgtgttagtacgtgtttgaatagtgtatgttatttatgactggtattctgagttatttttcattttagaatgtattaatatgttttaggtatataatttataatagaccccaattataacagcatattttaaagaagcccaaatggacccttcctataataaaagataccaaatgattggtttgttttttgcagctacctcccctttttctttttaaaatatatgccacagttttatacttttaatagttttgaagtaatttattttgtgcctagaaaaggaattatgtattttttccatgaatgtgtcatgtttttagcaacttgtaatcccagaaaaattaaataaataaaaatttgcttgccaggagcggtggctcatgactgtaatcccagcactttgggaggctgaggcggggggaccatgaggtcaggagttcaagaccagcctgaccaagatggtgaaaccccgtctctactaaaaatacaaaaattagccagatttgatggtgggtgcctgcaatcccagctacttgagaggctgaggcagagaatcgcttgaaccgggaaggtggaggttgcagtgagctgagatcgcaccactgcactccagcctgggcgacagagtgagactccgtctcaaaaaaaaaaaaaaaaaaatgctaataataaaaggtatgaatgctcactataaaaaaatcctaattatagaaatgtataatttaggaagtacaagtccttctaagtccagtttcttcaccagagataacatatactcctttaagactctttttattataaagttaaacacagatatagaaaattatacaaaatatgtagcttaatgagttattaccaggtgaagtcacacccaagtcaggaaatagaactttgccgagcacttcagcaggtccctccaactgtaatatttccctcctaccaaatgtaaccactctcctgatttttacaataattgctcctttgcattttcaaatagtttatgactaagttttgcacccaagactatagtgttgcccatttaagaaacgttgttatatcctttaagtctctttgaatctacaggttacctatctattccccacccccaccccctgcttttttttttcttcttcttcttataaattgtctgttgaagagctcaggccatttcccaggctaaattttgctgatttcataaatgatgcagttcggcatgtttctccaacctctgtatttcttgcaaattgtcagctggatccaggggctcaatcggacacaggttccattcctttgggaaaactataggcagttttgtgctctttcattaggaagtgcttaatgtctgattgattctctttttgtgggattgcaagagggtgatactcaaatctatcatttcttttttatttttagctgcactacttttataaagaggtatttccccatatatattattttgttactcagtggtaaaattcatacaggaaagacaggataaatgtttggttcttttttccttatttaccagttttcaagataatgagttgatcctctgaagatgaccaattaagatgttttttttccctttacaaactcacaggttcaaagcatattttatgggctttaattcattgtaattattacttttattgaagttgaaattgtttgatttttggtcagttgaaggttttcaaatgagttcttttcatgttactctaatagtctttgatagttttcttgctgtctggtttgacaagatattctaagctcgtcttgtacatttccttcccaggactggaattagctgtttctctaagaagttttaagactacattctggccattaggtcgctcattactgctgtgttggtcattgtttctaggccttttctgttgacaagagataggaaatatatgttataatcctcatacattcaagtgggtactgcctattcatattccggctggcagggtttttatttaatctcttcgatattacatctgcctctttttttcccacaccgagagtcctgattctggacacaggggattatacaattagaatatgtaataattttactgatttgatctgtctcattttgtacatgcaacagtttcagaatggcagtaatactatccctgatatgattactgaaaatagtttaaaacatttttttgtgtgtgctctcattgttcttaaccagctgtgttgtatgtatattctcagagtagccattatatacttcctttttagcccttatttaaggcatttatacaaataactatatatgtaatgtttaccgccggtcttacttattttcattgtctgggatgtattttctagtaaattcttcaggaagagcccatcgaaacagtaatctctgtgtttttgtatgttaactttgtcagtgttctttacatcccaaagcactttggtaggatataaaatccttggctcacattttctttctttgagtacttcatcttctgctggcagtaggctttgctgttaaaaatgctgatgacaatctaattttctttataagttacttgctgatttttgcttatatgcccaagtgatctttcctttgcctttaaaatccaattattttactagaatatgccttactgttggacatccctggtcagtattcttaggtatacagtgtgttatttcaatacatagttttaagtatttttttcatttcaggaaagctttcttgaattataattcttttttgttgctcgtttttatgtgaaattagatttcttgagcttttaaaaagaaacatggtttttggtattctgtttgcttgtttagggtttcttatatttatgttgggtcttcttttgtctttcttcattgtttattagtttgttacaaaccttactttttccatttctgtttggtttttccaactttcctccttttcatgttctatttatcttaaggcattttctgttgtgattatttgttcttttatttctgattcttcattgagttctagcacctcatttctttttatttaatttttttttagaggcagaatctcgctctgttacccaggctggagtgcagtggtgctatcatagctcactgcaatcttgagctcctgggctcaagtgatcctcccacctcagcctcccaagtagctgggactgcaggtgcatgccaccattcctgactgacttttttatttttagtaaagatgaggtcttgctgtgttacctgggctgatcctgaaatcctggttgcccaggctggtctcaaactcctggcctcaagtgatcctgctgcctcagcttctcaaagtgctgggattacaggtgtgagtcaccatacacagcctctagcacctcatttctgatttttgttattgagtatcttgtaccatttaacaaatgtctttagtgcattttgaaacaggaagttacagtttttatatgtttgtggccatgtctttctggcttactttcattgtatgtagggatgttattcttttctttcttcttctttttattataattttattgtataggattgtaccataatactttctattgctcatttttatgtgaaattaggtttcttgaacttttagaaaaaagcatggctttaattaccttttctaaatccatagtgctttctcttctttttttttttttttttttccttttcattctgagtcaagcttgagaaagttttctcttctcttgttttcaggtagtgttcaaaaacatggcagcttgctttatgaggtttcctggctctgttttactcctccagttttatctggactctgtttcctttatttctgtcgtccaagtctactcagttttgatttcacttctagccgtattttctcagtgtggggccctgtcctggtagggagcactggttaattttgagagttcaggggactagacagctgtggccccttgaagtcctaccccagacttcttgtccttgtccactgttagacataggttcacttgctgttacccattggcccactataatttttagtgaatgcctatcagctacttaggtgttttcttgttcttaggtctctcagccaacttgttgcttcccaatacctttgcacttggttttgatagaaatgttgctcatgggtttagttttgctctctagtcagtctgtttttatgtgaggatttggtagattagacgacgttgcttttgccacattaacatatgttctttaaaaagaaagatgaaatcatatatatgcaacttatttttgcttagttttagtgatcttgtttatgtcagtacaaagctccctcttttttgttgaagactaatatattccattgaagggatatgctgtattgtgtaacaaatcccctactgatggacatttgtattgcttctcattgtttacaattattagaatgctatagtgaacactctatccatatatcattgtgcacttctgtgaacatttctattagataaattcctagacatagcatctgctgggtcaaatggaatgaacagttacagttttgatagatgttgccagatgcccaaaagccttgcactaatttatccttacctacagttattaggatgccggttgctgcaaggccttgccattattggcccagaggctcttcaaggtatgagtgtttatgtatgtgttttgagagtgatttacagttttctctaagaaactcatgagacctatggacctttttagaaaaatgtaaatgtgtacttaaaactttcacatataatctcagaggcttcaccagctggtctctagtaatattgttcttattcttgttttcctaaccaccaaccacttctgcttgatgaactaggaaatacttgaatgtttaaggataaagagcagttgtagagctatgaccaatagttcatcaaatcctgttatcagaggtgataatactctgaagcccatgataaagtctgatgtgtgtggtttagtagtagttaagaactaaacaacacttctatcccattctattttgatgcttgcttgtttctgtctttgcaattctcagtctttgtatctttctcttattttccttgtgggttgaggagtgatgctgtggaattaaaatacatttaaaaataagaagtttattttccccttatcccaagttaaaggctatctttgcaacatccttctgccccacatttcagaaagaggaaattgtttttctttccataatgctcactcatctttgttttagaacatatacacaatggacattcgctatgtaccaagcactctgttcagcaatgcagggaatataaagatgttctgacttcaagaataatacaatctattggggaaaacttggcaagtattataatttttatggatttgtttccctcactagaccagtgatctcttcaagagtagagaggcaacatggcgaaaccctgtctgtacaaaaatacaaaaattatctgggtgtggtgtgcatgcttgtagtcccaggtaccagggaggctgaggtgggatgatcactcgagcctgggaggtcaaggctgcagtgagccgtgatcataccactgcaccccagcgtgggcaacagagtgagaccctgtctcaaaaaaataataaataaaagtaaagtaaaaagagtagagaggccatgtctcacttttaattttcctaaaacctggcacatagtagatggtcagtaaatgtctgtttaatgattaacaagaagccaaatgactaagagaaaatgaatagaggaagtgtcattagaaaagaataagcaaggcactagagattgaaaggatggaaagataatgtataaaactgcatggagttgttgctcaagctagcctattaaaaaatggactgtcacttgagcttgggaggtcaaggctgcagtgagctgtgactgcaccactgtactccagcctgggtggcagagcaagactccatctcaaaaaaaaaaagcattgaaatttgacaggcaaaaagcaaggaaagagatggcattaaggactaagaaaagcatagggggagtttagccagagcgtggggtagctgtggatgaggggcgataaggcagagaatatcagcaaggatttcattaggttaggcaggccttgaacaccatgagatagtattattggtacttcggagggcagcagggagccactgaaggcttgtaagaaggagagtgccaacaagcctgtcctgggggatgctgtacttaactgcagtggcacaaggagggaacatttatcttttcagtgggggctgggtctcatgatctcctgaagttctttctagctcagaatgctgaggtcctgaagttatgagggatttgccttctcttttataaatctgaaatggaagtttgaaagaggatatcagagagatgacttgttgggagacgacttctgtcaaaagtgatccagaccacaagtagtcagtagggcctgaatctgcctatgaataggagggagcaccaaggccagaggttccatatacttctgcctgggtacttggagaagactcaggagtgtatagtgggtagagtgtttctcatcaagtgacagcacagagttcccattagttgcccaggattgggtgtatgggggtgcagttgggggcagcatcagctgttgtgaaggtggggtggaggtgtgaggcaggctgcttgttggaagtgtgcacagcagcagctttgctggagcaccaaccttgtgtgcattggcctagaacatccaggcctccttgcccatgcttgggtgggcacctgtcagcacagccctctgaggagcagaaacccagagcagggtagctgcttttataagctctttggtgcattgttgcaaaactggcttaagtttgtgactgagctaagtttatcaggaaacctgaagcccttcttccttgttgccagctggcagttgtgctcctttaaatcctccccacatttgcttcagttttgctgctggatatggcctctttgatttctattctgatgtcttggggagtgagacagagactgacccatcttaagtgggtttggtggcctgcaggttggctgagccaaggaaagctgtagtgggtgttttcgatgtggtacaggctaagtttaaacagctcatttgctgccctctcagtttggatgccccgcagccctcattgttactgaattttttgcagccttaacaagacagcctgacatgaatattctaaaaaatcatgtactcttctttcctctgcagaactcaatcaagtatgtattgagagccgattaacactcagtttgagcatctatcatggcatggccctggtctttttctcatagctgggaaaactgaacaagtcacagagaggcaagagccaggcagagaacattattgagaactctctggtgtcagctctgagcatctcctatgcatgatctcttattcctggcagtgaaccctgtgagccctgtgaagtgggtactctgatgcccattctgcagatgagtcataggtgttatttgctcaaggtctcagagctattaagtggtggaactggacctggaaccagatcttcctgagtctgtgccctctgccaccagctgaacaattgcctaggtcatccgagtgctaaaggctgcaattccttctagtgaaaccagcaatacaagtgaagaaagcaaagcacaacactacttagtaggtctctcaataccaacgatccaaaactttaaactaaaaggcagaaaatttggattgtcattacactttgacaggtgaaaggaggctcaggtgaataacctcgttttgttaaagttgcctatatttaaggagggtgggctcccccaatgggaggtggacaaggacttaggaccagttgtttatatgactgccgtctctgcactgtacctgttgctccatctgcctcttctcccactctgattgtcattttcacctccctgatccctgcacacaccaccccacaacaataaatagaatgatgtggagtcccatcctttagagctggtctagagagaaattctaccctaagaattttgctgcaggcatccctatggatttttttccccttttcattgctgggagtatccaaactgaggggcttttgtggcagggccactagggaaattgtagaagtcagtagtagctgatactggtctgaaataattcatagaaccatatttgtctgtggaggtaacaggtgctgtaaacgagaacaataagagccaattatgatgacaggattcctggggactgatagggtacggggaaaaaaggattaaaaattgaagtacaatatcttggcactttgcttttttaacccttttattcaatcatgacttctgtttgaggaaaataaatgagaacaaagggtatgtttagaatacaatctctgttttaaatttgactaatgagtggttttagcactttcatttgggtctcagtcaacctgtattcagagtgtcaattaaccaataaatattatgaaaaacaagagtcagaaatggttgcaccactcctgctaatgagctgctaatgaaattgtacctgggtgggaaatgcaggcactctggaatcctcaagagtcttctccagaaaatgagcagtagtggtgctaaggcctctgggaaacagacacatttaactccttcacttccaatttgtttccctccttattatgaagtaaagctcattatcagtatctcagggttaacttcaattatagtgagaatttaaaaaaatgtatttttgactcagtaatttccaagtgggattagagagccggaagagctatagccatgctgtggtatactcccaactgcctgacctttggtttcttggaggaacatgggagacattgagggtagagatcaaaggggagtggaggcatcaactagctaggaaacaggtgtgagatgcccaggatgggtctccacatgaaagtggccccctttagccccagttttctttattccatccctggatttattaaatttgggggctgtggtaggccccctaggctggtggaaggagtgagtaactgcacatgcttaaaggtctgatgcttttctcagtaggagggctggcagggccacaacaagattcctagtttttctggtcaaaatactatcatcctttactgctgtctcaatcttcatttcctacccattcctctgggtcagggtttattatgtctgattaggacaatgataacagcctgccaagtggcctccctgcttcttgtctgcctgttttatatgctgagctccaggtgcttcatatggagttcctcattgcttgcttgaaagctgttctctggacttggaaatctaagtgttgctacttctctccccatttatgtcatacttctcaatggcaggcattggtcttgttcacttcccagtatacttcccagtgcccaacacagcagtggccctttgtgggcacatggtaagctgtggcagaaggaatgcctggaaaagagcagactcttgcccagtcctcaggagatgcttgtggactagccacttatggaaagaggctcaccatgtcctaaatgtggttactttgagccttgtgctgatgatggttcaaggtacctctctcactagaacacaggaaatctaagtagcattgatagtccttgtctgtggaaagcgttactcttgtgaattctgtgtagaatggttggtcaccagctgtagtttgtcctccttgaggactggaaaggagacatgggttagggtgctgtggatgagattttggagggtagtggggtagtggtgcaagggtatggtgggagctgtcagggtagctgttccctgggggaaactggcgtctttttttctgagcggctttcatgcagcttggggatttctacccttgcctggaagccatgctgggtaactcttctaagacccggcccagattctagattctctgtgattcagagtaaaaatacatttggagaatattcctatttttctcagtttgtcattgtttagtccttctaaaaaatacataaatatgactatgatccagaatggctcattatgtattttgctgtttaaaaaaaaggtctccatttttggttcccttaaaaacacaataacattaagtgttgtttcagggttcagcaccctagagaggtttgtgcacgttatttgttactggttccgttcaagtcctggagacaggatagatgctcatttgtgtaaggcagggatcttgccaagacttgttcgggggttttgaataaagaagcaggaggagagggctttagtagtcatggcaactgggcctgtaaagcctcagctctgaccagccctattaggagcttggaggccccagcgaggtgagtggcattgcttcctgttctatatttttgtattccttttggtctggggaagagggagctggcattcaagctgacctttatggaggcctactgtgtgccttgagctgagcttgagctgtgggcaccaataattggttcctgcccttcagaaactcagcataaccgggagtttttactcttaacacctacctgtaggacttgacaaataagctgtctttgcttcatccgggttgacatttacctttttgggttgtttttgggactgctttttctggtgtactttttatttcttctgagcactgacacagttcttttttcatttgttcttcacaacaatgtagcacattagggaaaacagacacgataaattcttttcagttgacacataagggcatgaagattcagaaacataaaggaatttggctagagtcacccagccaacaaagatagccaagtgaggagcagagtcccagggcttgcggcatggccagccggggcagcctctggctttctgccattgtgtccacgtatgactggaagtccctggagcaggaagtttccaggcaggagcctatggaggacatcctgtccttttcacccctcctgaagtcccataactaccaaagctcttaatgccaaggcagacccaagagcaccatgcattcattccagttggcctgtcttcgttgaagcagggcagccaggctccacagcaacctcactgtgggcaccacctgagcaggccctgtcactgggagtccaggagggacaagtttctaagcactggacactgggatgagttggggcaaagacagagccaggtataatttgttaataggtaaaactatcatttcagcagttacaaactggccatatgttttgtttgccttttctgtatttaaggtggaatacttttagaaggggcatttttcacagccctcaccattcatgttttcttacagatgaacctcctcactctcttgcctcctgcctcctgtgggcatttgacatggctcctacctcctgatcactatttcttacctgtccttctgccagggttcctcttgtcctggtgcttcatggcctcaggcttcctaggctaattttccccttcctaacgttccaagaacttcattcctgggtctgtgtctaggccctgagccttagttctctttcctggcccctagaaatatttactgtcacattgaactgtgtctgatagactaattgctgttcaaggatttaaaaagagatggtggaggaatatatttctacaaccactttatcgagatataatttatatactatccaattcacctatttaaagtgtacaatgggaataattctcaaatgtcctagggaagattggtagaatggagaggtggtttctaggctatggtgttttatggaccagaaaaacttaaaaaaaaaaaaaaaattggaggactaaggccaactttttattttgctgagttaagggccttaacatggaaacaacacactatctactatcattatctcatcttttaaaaggacattttaacacaaaaaagcaactatataatttcagaaaaaactgttatttatattgggcacttttaatttcttgtttcgggaccattggaatgaatgccacaataaacacctcaaatcctggtggcttaaaaaaacagtaactatacaaaaaaaaagtatgtaagagaacagaacactgttcttttttatagctccgactcttagaaccacagtaatagttcacatactcttcataggctcaccaaataaacagttaagccaatcaggatatggaggggcaggagccataaaatggaatacaaatactaacaaatgaaccaagtattactaattaataacataaccttaatgaattggacagggaagaactaacccaagtgactttgtgaagcaatattttgaccaggtactgtaaagctaaaaacagaactgtacatacatgctgtaatctagtttggtaaatgtatttctcacagggatatgggttaacagttttgaaactagtttatttgtatactagaacaaaaatatattgtagataataagagcaggtttctcagtgttagagaaagaagttataaataagtaaagtgagaagacaaatgagcccgtgtattagattggaatctgaactatcagtataaacttgtagttttaaaaatatatacagataaatagatatagaaatatagatgtgtggatatatacacacaacaataatatagcaagaaatataggtgtgtgcatgtatatagatgtctgtatgtatatatattgtacatctgttgatgtcctcttttgttacttttggcacagattattagagaaagtgaactcagtgtcccttaaacattaatgattgatgattacatggagggcctgaatgttattctaaatcatatatgtatatgtggtttagaatatatgtaatataatattctaagctgtatatattagtttccatgctgctaataaagacatacctgagactgggtaatttataaaggaaagaggtttaatggactcacagttccacatggccggtggggccttacaatcatggtggaaggtgaatgagtagcaaagtcatgtctttacatggcagcaggaaagagagcgtgtgcaggggaactgccctttataaaaccatcagatctcctgaggcttattcaccatcacaggaacagcacaggaaagacccacccccatgatttaattacctcctaccaggtggctcccatgacatgtgggaattaagggagctacaattcaagatgagatttaagtggagacacagccaaaccttatcaccacatatatatatacaaatgtatgtatgtctatgtgtgtgtgtacatatacatatatataattaacatttgtgtgtgtatatataatttgtattgtttataaattacccagtctaaggtattttgttacacacacacacacacatacacatttctagctccgcctactgagagggcttagaaataccaacaccctagtattaatgaacacacctagcatccagatcttggcttctaaacactgttctccaattgaaaaaagaaaaaagaaagaaaaagaaaaaaaactagggctcgttagaagtggctgattccagggctggggaaatgaaaatacaagatgaacctggaacatcttatggaaccagaaagtaaggaaatacttttaaaaagaaaatgatggtggggaggaagggtttttcaaaggaatgtaagagccaacctgaaggcacttctgattgctaaggctgaaacaatttgagtaacaaaataaataataatagtgttggacccatagaataaaatatccatgagttcatactcatacaaataattagaggagtgacaattttttcttggagtgaaataaatcccaattaataaatgtgtaaagaaggagggaagtagcaaattcccattagatgattaccacagtggtaaatgttgcagatggattcctctaatggcatgcaatggtttttagagtcaagggatggatttgtataatctgaaagtatttcccccatgatttttttcttggtaatttggtgtttttttttttagtttacccacagtgttgtgcaattactgccactgtctaactccagaccacgagtggtcaatcctcattccttccttcccacagcccctgacagccattaatctacggtttctatggatttgcctattctgtacatttcatgtaaaagtaatcatatgatacatgcttttttgtatctggctttcacttagcacaatgttttcaaggttcatcaatgttgtaggatgtagcagtatttattgctccttttaatggtgaataatattatatggatatactacttttattaattcatttatcacatgatggacatttgggttgtcccctgatacccagtatgatagtattagaaggtggggcctttaggaggtgatgaggtcatgagagttccacgcctcatgaataggattagtgaagaggcttgagggtgcctcctggccccttccaccatgtgaaaacacttagaaggcaccttctgtgaggaacaggctctcaccagacactgaaactgctggtgtgatcttggacttcccagtctccagaattgtgagcaataaatttgtattgtttataaattacccagtctaagttactctgttataggattcctaatggactaggacacactctaagacagccattaaagcagatgcttttggttccctgcccatacttcctgggatctccttttcctatagggggtgtttcttccccagcctctgtgggggttcaagactcactcttgccacctgttcctggacccctctgaggagccaaagcttctttgcccagagcttctgcctccacctgctctggtagcctgcggcctctgactgccaggagggggcaggtgggggtacaaagtcctccctgcctcctcatttcctgtcaactggagagcaccccttaataaaccatgtgcacatgaagccctgacttgtttcttctccgtgggtgtctcatccttcttggaccagaaggctagcagtgatgttcttttcttttcttttttttttttttattgatcattcttgggtgtttctcgcagagggggatttggctgggtcataggacaatagtggagggaaggtcagcagataaacaagtgaacaaaggtctctggttttcctaggcagaggactctgcggccttccgcagtgtttgtgtccctgggtacttgagattagggagtggtgatgactcttaacgagcatgctgccttcaagcatctgtttaacaaagcacatcttgcagcgcccttaatccatttaaccctgagtggacacagcacatgtttcagagagcacagggttgggggtaaggtcacccatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcgggcaggcagaggcgcccctcacctcccgggcggggcggctggccgggcggggggctgacgcccccacctccctcccggacggggcggctggccaggcggggggctgacccccccacctccctccttgatggggcggctggccgggcggggggctgacccccccacctccctcccggacggggcggctggccggtcggggggctgacccccccacctccctcccggacggggcggctggcctggcggggggctgacccccacctccctcccggacggggtggctgccgggcggagacgctcctcacttcccagacggggtggctgccgggcggaggggctcctcacttctcagtcggggtggttgtggggcagagggtctcctcacttctcagacgggttggccgggcagagatgctcctcacctcccagacggggcggcagggcagaggcgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagaggggctcctcacatcccagacgatgggtggccaagcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaggagactctgtctgcaatcccggcacttcgggaggtcgaggctggcggatcactcgcggttaggagctggagactggcccggccaacacagtgaaaccccgtctccaccaaaaaaatacgaaaaccagtcaggcgtggcggcgcgtgcctgcaatcgcaggcactcggcaggctgaggcaggagaatcaggcagggaggttgcagtgagccgagatggcagcagtacagtccagcttcggctaggcatcagagggagaccgtggaaagagagggagagggagaccgtggggagagggagagggagaccgtggggagagggagagggggagagggggagagggggagagggagagggagagggagagggagagtcagtgatgttcttttcatgacaatagcagaacatgatacaaccatgcaagcacatttcaaacatctgtttgcggcccatttgctagcatcccactggccaatgcatgtgataagcaaaatccaaagtcaaggtgtgagaaggcacactctgcagtaggaggaactgtaaagtcacatggcagagagtgtgacaagcagggaggaaaaaaattggtgacgatgttgcagtctaccatagattatcccccaacccagaaaacaagagttgttatctgggtcctggcctgtgactgaagtcagtgacagtgtcagtgggagtcaaaattcaagcatgaggtggccttactcaatatggacagggcttctgcttaatatggatgggttttctaggctaggatagtcagccttgggatcagctctgaaggagctggaggtgggaaaacagacactgtaggctttgcaggcctgtttgccttcctggatccagacattattttctgcctgtacccttgctctccatccccctaacttgttacctgtatgtatcttgttttctctttgctctgatttgcccttcccctgtgttctggtacattttcatctgtcacaggggctctcgaaggatacaggtcagattatactatctttctaacttggacatttccccagtggagaagtatttgaaatactgcatttcctgttgcttttgccactgctgctgccatgacgtgtttagtatattttaaatgaacacaacctgtattttgagttaatgctgttgtggttgctcttgccccctgtggtggcttatgtgaagggagtaattttggaattttcatcaaaataactagattcacataagaacctagtctcttctttggcgagcttagcacactataacctattacttctgaagcttatacacttacatgcttttttcttttccatttctaactttggtcaaaagtttgaaaattttaaatactatttttattatattactagtattagtaccattattactaaaaataactattaacatgactaattactattataactcaacctgccctagtaaaaatccttcttggcctttccatataactctagatcagctaggaattccctctttcttttaaacattttcacttaacaaataattattatttttttaatttagagacaagttctcactctgttgcccaggctagagtgcagtggcatgatcatagcccattgctgccttgaactcctgagctcaggcaatcttcccacctcagacttcaagtggctaggactataggagcatgccattgtgcctggctaatttttttattttaatttttttgtacagacggggtctcactgtgttgcccaacccatggcctcaagtgatccacttgccttggcctcccaaagtgctggaattacaggtgtgagccaccacactcagctaattttaaattattttctagagatgggatctcattgtgttgctcaggctggtctctaactcctgggctcaggtgatcccctcgtctcagcctcccaaagtgctgggactataggcaagggcctcctcacttgaccaacaaataattattgagagttcactatatgccagccaggtcatgttataggccctgaggataaaatggtgagcatttatattcactacataaataaaaaaactaatgtgtaattactgattgtggtgagtgctataaaggattcatggtgctgtgaaatcttttggaggcaggtaaatctagtctgagaaaatagaggatgcctttcagaagaagtgactttagctgggattggaaggatgaggagatggaggctgagggtgggaagactcttctggacaaagggaacagcagatggaatggccccctggtaggaggtagcatggttctttcagaaggatggaaaaagaccagtgtgcctagagcacaggaatgaggagtggacaaggctggagaggtaggctggggccagatactgcagggcctcatggaccagggtgaggattttcatttttatcctcagaatagtaggaagccatgaaaaggtttgaagcaggagaatgacataggtttggtattttggaaaagaaaaatcattcgctttaaagaacagtttgattgggaggtgaatcggggaggccagttagaaagctgtgatagggcgcagatcagagatggtgatggttcagacaaaagcagtgggggaagatggagagaagagtatgcattcaagacatacatagcaggaaaaatcaaccagtttgggaggtagattgggtatcaatgtggtagagtaaagggggctggcattttagcattcatccaggaagagactattgtcttgtttagcattcatccaggaagggactattgtcttgtttagcattcatccaggaagggactattgtcttgtcagtttgggatctctccaggtgaggcagcctctccccttcacacattcagagattagattagtactaaagaaattacctcttgccctgtgatcatagtaataggatagaagttgccagttctttgttattcttgccagtattcagcctcctctcctcccagaaccatcttccgccgctgtttgatgaatattttcccatcctaggaatatgaacccaggcttcctggtggtaccaagccagcagcccccacagcccttccagttagttctgtggcctagtctctcctcagcttctgtggcctattgggttccgtgtcagtgcatttgcacatggggcttccttactctggtattccctttattcctagtctgggactcgcttttttcttcatttgaccccaactttatcaggagggccaccccagagaaggatttttccactgcgctctgaacttttttttttgagacggagtcttgcactgttgcccaggctggagtgcagtggcgtgatcttggcttactgcaacctccaccattcaggttcaagcagttctcctgcctcagcctcccaagtagctgagattacaggttcctgccaccacacttggctaatttttgtatttttagtagagatggggtttcaccatttgccaaggctggtctcgaactcctgacctcaggtgatccacctgccttggcctcccaaagtgtgagcaaccatgcctggcctgaatgtattttttatccttgaaaataatggttggggttagagggagatcattatgcacatacttctatatactgtatgtaggttcccattttttaaagtaaaacatacagaaactccctactgaagtgggacggcaggaacagcaacagcatggtgtgcgatatccctggcatcttgattggggatagagtgactggtggaactcagagttctctatgggcctcccagaattgcgagaactggtgaatacttgcctatatcattatccttctatacttgagtttacctgattatttgagagaacttgtgctgtgtgcttccttcggaggaattttttctgaaagtcattgatttgggttcttaaatcaaacttaacaccagcaaggcaatgctgtcctctggcaggagaaagcagagtcaaagtccaggttgtcagaagcaccatctttgcttcaaatctcccatctcctgaaaaaccttttccctgaaattctccatccctacagcagtttcatgaatgaatgaatgtgtgtagcattccatttgtagtatgtgctactgcacagttgctttttaactatacttgagtagttttgtgcagtgcataggaatagcccatcgattcacaacacttgtttttcccagctgtggatcagctccatagataggtgggtgtaggttttcagtttctcttggctccactccctgcctccttggcttgctctgtcctcttgccttccagtctcttccttcttccttttcataacgttaagtgccacacttttatgtgccaagccctggcctaagggctgggaaatcaaaaaggaggaaatacagtccctgtgcttaggaaggagagagcctcatagaaggagcctaattaaacagatgcaggtggtgaggtgtaagcttgctgggatggcaggctgtctggggccctgtgggactgactgtcgaggaggggcaggaagggtgtcatggaagagacggtaaagtagcatgtcctgaggaatgagtagttatctaccacttacctgctgcacgtaacacaaagcttttattagctcaagaagacatagaagagcttaaatatgcaggttctaactgggggacattggtctctagattcaagtgtgaatcctcttgcccatcttacgtcattcccttacagatttccttatagattagcaaagtgagtttatgcgagtggtgtgtgtgttcaagggagagggatgggtggattgaggaggtaactgaacacagctgagtcgtgtcttcatgaactagtaagtcctgttggcttgctggccatcccgacagccttccaaagaccttgtacctcatgagccttttctcttcttggcttttagggcaggctgtccctgcaggatcccacgtacggctgaatcttcagactggggaaagagaggcaaaactccaatatgaggacaagttccgaaataatttgaaaggcaaaaggtacagtgtcaaccctagggactgggaggctaagtgataacgttgattttgtattgtaatacttaaaatgttacccaaattcatgtggctttttttaatttgaaatttaatagcatagaatttgtgataaatctgtcagggttttatgaaagtttacttctacagtctttggaaagagatagtttgcaaagcaaattgatactttaaaaaaggctgtagggggaatgcttaacctgctttaaaaatgaaactatttttcccagtactttaagagcacccatttgaatcccaacaattaatgcactgattacagatgagtcatctattcattaaaacaggcctgttaggccttctgctttgcagtaatacttccttggtgaacaataaaattgcattttaaagtctttaattcaggctaacttttcctctcattagtcagtattaaaacaggccttcttatagtataaaagtagaagctactgccattctccactggctagaggttgccttatttctcaataaccaggttatattattcaattttagagaattcagtgtcactatttttcttttgttgccttgaattagcatgctttctttgcttgatatttcctgaatgagggggaaggaggttgaggcatggagttgcaggggttgctgaaattgtgcattttgaaagctcagtagaaataccagccatgaaatttctaacacagggaccagcaaattatggcctgtgggccttattgggactgctccctgctttggttcagcctgcaagtgaaattggtttttacatttcttaaaggttggaaaaaaatcaaaaggtagtatttcatgactcatgaaaatgtatgaaattcagatttaaatgtccataaataaagttttaatgggacacagccatgctcatttgtttacatattgtctatggctgctttcttgctacaatgacagagttgattaattgggacagacaccatatggatcacagagcctaaaatagtatccagtcattacagacagtttgctgaccctgtgctaacacgtgtaagcactgggaattattagttatggattgagtgtggttagtgttactcagtccttggatgatgatgatgatgatttttttttttttttttttagagatagggtcttgctctgttgcctaggctggagtaaagtggtgtgatcatagttcactgtaacctcaaactcctgggctcaagcaatctcattgtctcaacctcctgagtaggctggggctacaggtgtgtgccactatgcctggctaatttttttaaatttttttgtagagacagggtctcactttattgctcaggctggtcttaaactcctggactcaagtgatcttcctgccctggcctcccaaagtgctgggataacagatgtggaccactgtgcccagcctggattttataatttaaacagtattttgcaggtcgggcgtggtggctcacacctgtaatcccagcactttgggaggccgaggccggcggatcacctaaggtcagcagttcgagaccagcctggccaacatgatgaaaccctgtctctactaaaaatacaaacaaaaattagctgggtgtggtggcaggtgcctgtaatcccagatactcagaaggctgaggcagaagaatcgcttgaacctgggaggcagaaattgcaatgagccaagatcttgccacagcactccagcctgggtggcagagcgagactctgtctcagaaaaactaaaacaaaaacccagtattttgcagttagatgtaatcagaaggaggtcctagagactcacttcttaccctagtcttttccttgacatgcctgtcagaaggtcactcagctggtccatgtgcacttttttcaggtggcactcaccccacaaaacagcctgttcagatttagacagttttcactgttagaaaattctacttcatattgagatagaggcatttgttctccttacagtcactccaaattgggaaggatctttcatcttccctcattcctccaggtaggcctatacttggagtggcccaggtcagacaattactcctttctaacaaccatgtaagaaataatcagctgtcattgtcacggcccctgccaaacttctttcgtccacaatacacacatatttcagtgcctcaaagtacttttaggaagtcttttctcacatgtaatccaagtcttattttctgaagaaaacaatctattcttttcttagcttatgaatattgagttaggggccgggtacagtggttcacacctgtaataccaacattttgggaggctgaggcgggtggatcgtttgagcctaggatttgaagacacacaccagcgacagggtgtgtgtctgcaaaacatataaaaattagctggaggtggtggcacacgcctgtagtcccagctactcgtggggctgagttgggaggatcacttgagcctgggaggcagaggttgcagtgagtcaagatcgtaccactgcattccagcctgggtggcagagccagaccctgtctcaaaaaaaaaaaaaaaaaaaaaaaaccaacaacaaaaaaaagcaaaacagaaaaaaacaccaaaaccaaaaattagctgggtgtgtggtgtgtattatgcctgtagtcccagctactcaggaggctgagatgggaggattacctgagcctggggaggttgaggctgcaataagccgtgattatgccactgtactgcagcctgggtgacacagtgagaccctatctgaaaaaataaataagcaaaatatataaataaaaaataaaatccctttacaaaaataatactgaggaattttattaatttggagtttatttgttggtttttatactatgagaactcacttctctaccacctgactatagattatcagtgtgaacacgtactgctttgtctgttactcatatcttttacgaatagacagcagagccgtccatgtgaactgtagagacacaccataagggagaaatatttgtccctactcctgcctttttactttcctcctttggagagtctctgcctgaaatggcccctagcatatgctggacctttcttcttccttctcagcatttatagctaatggcaaacctatctgaatagaagtccaaaggcactgacaaggtggtgtgaacattcagtgctgtgagctcagtgagcctttgatggtgacttcctacttctgggatggagctcctccaattccatttcatggtgtcttcctggccccttagcactggaataggaacagaggcctaagggcagggtcagttccctgaaattgttagagtattttgcttatatccttattctgttttagaggacaaaatccatagctttccatgaaattgtccaagaagttagtgatcccacagagttaagaaccattggcctagagggagatggggacagcccattaatccaaaattcatggcagtctttctactatttttactggttgtgtggctggccacattgctacctagagctgcaatgcttgtgggctctaaagcctgggacagaagaccctgactctggcttgtctcagagagttcctttagcactgccttatttcattgcatgtagttggcccttagcaacaggtttccacttgctatttatgctttaggctttgccatctctagtggttttagtccatatccctgtcaacgtagtacatctctctttttgccctggaataaccagcttcttggactcttcctcctaggtttggaggactgagggtaaaaccacgttcaagttgtgccatcttgggttgaacatttaccaaggtccaatatggtatagtggttaaaaggttgggctaaggacagggccatttacttcctccatttatttatttcacaaaaacctattgagtgcccacgtgccaggcattgggatacagtaataaacaaaacagcctccacaaggctggcagacagaaaaccaggtacataagcacagaagtaagatattatctggtcattactgatagtttgctgaccctgttctaaaacatgaaagtattgggaattaatcatagattaattaactggccccaaagggaggaaggaaaggaaccaatgtggctgatcccaggaacctgtcaaagactggattggtatcctcactgagatccctggagctgatccaaaccacagccatgtagcttgactagagagaagacatccattggggagcaaggttttaccactagtccttatttcaattcagggaacagaggtaagaacaaggatgatatggacaaaaagaataattaactctttatgtaaagggttaggtttataggtttaggagttagggcatttcagacagatggaacaacaggaagtcccaggctttatcaaggaaaaggctttgtcaagtatgagaagcaagaaaatgatcaaggtgactataggagaagagagaaggaaggaaatcgataggagatgagattggagaggtatgtgggggccagatcatgtggcttttgaggaagattttgtatgttcttcattcacctttaattgtaatggaaagccattggaagattttttttttccccataagacggtgtcttgctctgctacccaggctggagtgcagtggcaccatctcagctcactgcaacctccgcctcctggcttcaagcaattctcctgcctcagcctcccgagtagctgggattacaggtgcctgccaccacacccagccaatttttgtatttttagtagagacggagtttcaccatgttggccaggctggtcttgaaattctgacctcgtgatctgcccgcctcggcctcccaaagtgccggaattgcaggcatgagccaccgcgcccagctgccattggaagattttaggcaggagagtgatttagttactatgtgtctggagatgagattgaaggtggacaaaagaagacagaattaggatgtcatttcagtagatcaggtaggacataatggtggcttagtctagggtatcataacagagactgaatgaatttggagatttaatttggaggtagactcaagaggacttgcttatgatttcagtgtagaggttgaaggaaggtgcagggaggggcacagattcaggataaagcctcattttggaacttgagcaactgggtggttgttggtactatttattgaaatagaaaagttgggagggggacagacttataaggagaagaatcaagagccatgttttagattcaataagtttgaaatacttgttaaacatttgagatacagatctatcaggtagttgtacaagagtctgattggtgctcaggggagaggttgggctggagatgtaaatgtggagattactggcagataggtttttaaagtaactaggggaggatgtcgaggtggagaagattgacagggctgaactccaaggcattctgggctatgtggctcaggtaggagatgaggaaccagcaagagttggagaaggagtaaggaagaggaagagccatgagagtgaggtaacaagccaggaaaggaggttttttttgtttgtttgtttgttttgagacagggttttgctttgtcgcccagactggagtgcagtggcctaatcatggctcactacagcctgggctcaagcaatcctcccacctcaggcttctgagtagctggggccacaggtgcacaccaccttgcctggctaattttcaatttttttgtagagacagaatcttactatgttgcccttactggtcttgaactcctgggctcaagcaatcctccctcctcagcctcccaaagtgccggaattacaggcatgacccaccacacccgactgagagtttttcaagaagggagggtcaactgtgcaaatgctgcttagtggttgaggaacatgaagtgagtgaagaagggtccatcggatttggtcatcaattattggtaattttgattagtagtgtgagtacagttgtgaggacagaatccagattacagtaaatggcaatataaataggaataaaaaagctggggatagtgagtgaaaacaatgtgttcataaagtgttactctgagtgagagcagggaaatggcaggataaccagaagagactgtggagtgacaggagaattggtgtgctgatgggaataatccagctgaagggagaaattgatgatgcaggcaggagggagcggtgtaattatgggagttaaagcttttgtaaaggcaactgcgatctggaactaagtttaataggatcagggacactcatccattataataggaaggaaagtagaaaacatagacttaggtgcaggttggcttgtagagctgatcatgggaaaatgaagttttggtctatttttcttagtgaagaatgaagtaagaacaccagatgactgtttcgtgtgtgtgcgtgaacttgagtgcacatgtgcatgcttgtgtgtatgtagttgggactgagagtgggtgatgagagatggcttgggagagttgagacttaaggcgtaaacagagatgcacggaataatgggattagtcctgaccaagtcttacaagagggaggagataatgtgttcaagctatggttcctgaatacttagctccctcttgggtatgtggggtggggcagtggtatcctcacacattggcagtggatgatgctctgtagggagagggattcaggattctctccctactttgtagcattgtgataactatttgaatgaaatattactttgaagggattaacacactgcctaacacatggctaaatgctcaataaatgagttactagctattattaattagtttaggaggactgaggtttagagaagacgagtgttcttctcagagccctaaaaggtctctaggaagaatgaaagcccttggtacatgagagctgaggcctgctggaatctcagactatgagactgatgtgctcttcctgcctggagtagagcaggccagtagccccttcctcctcacctctgaaatcttgtgggcattccaggatatatggaatcctgaacccaacaccaacctgacagtcttgttaagcacattccatactccactcttcccttcgtgcacatcattcttgtgcttacctctgttcattgaactaaaatgaatgctagtggtaaaaccttgctcccacatgatggatgtcctctctctggtcaagatgtgtagctgtggcttggatcagctccagggaattttgtgaggagaccattctggtctttggcaggttcctgagattatagccacattggttcctttccctcctccctttggaggctggctgtggaaggggctgaccttgattctactccttagtatctcaaatccattccttggtcaggttgagacatacctcctgcctctcctttgtgctcataggttggtcttatggtgtgaatctatccaacttgtttttgtaaagacaggctgccttgtctaatcagttcaggcacacactgtggggctcagggccctgttgtcccctttcatggaaaaatatattaatagataagggtgcatgctactccttgtggctgggcccacttccctctgagaggtcctgccctggcagcgtgctgagggagagcattgcacagttatgccaggcttatttcttcctgagaagctggctgagagccctctgttcgtggatggcttctgtctgccccatgccattgcttcctctttcatgaaatgatcccattttcagctgcgtctttcctcttctagcttcaaggtaaggtcactctgttagacccttggctgactgaagacaaaggtatgatagtacactcagctggcctggcctcacttaccttagggtgccattcacccagggacattttctttcttggggaatatgatgctcccctcttatttatttttagagacagggtctgactctgttgcccagctgtgggagtatggtggcacaatcatagtttaccacagcctcgaacccctgggctcaagtgatcctcctgcttcccacgtagctgggaccacaggcacataccatcacatcctaactaatatttttaaattttttgtagagatgggatcttggtatccttccatcttggccacccagagtactgggattacaactgtgagccaccaagcctagccatgcctccctctttactctcagttttctttggacaggctggatatcaacaccaacacctacacatctcaggatctcaagagtgcactggcaaaattcaaggagggggcagagatggagagttcaaaggaagacaaggtgtgtgattatttttcctgtgagtataagcctgcagcatggccttgttgtctttgcagagaatggaatcatttttatgggaactcttgcaataaacatgggataacaatattgtaaaataatttaaagaacattaatgacaaataagaaacccttttagactattaaaaaaaaagtgctgggagcatttctgtcatggtttaggttagaattctatttgccatcccatgtcttcaaacagctccccatgtttggagaaattgaggcactgagcaggggtagccattctctccattatcacaggcctgagtggagtgagtagactttatggcccagatctctgcctcacttacacttggattagacacaagcttgttccaaaagaacagaggagctggcccaggaagcaagaagccggaatccttgtccttgtcctttgaacatgtagcaaatgtgtttcttctaggcttcagattccttaaatttaaaacatggggctggaacaagaggatgactgaggtttcctccagctctaaatttctctacaagctaagggaatgagaggaggaaaaggtgaagaattacagccccttggccatgcccctaatgtctgggagggctcacaggtgcaggtctataccaggaagatcatgagctcttggagtcatttctctgtatttctgtttgagtcctgtcagtttttgaaagaaccttctctgatggctgccttagagacctaagttctccctccctcttctccttacagtccccatttgcttttttttgtttttttttttttttgtttttgagttggagtcttgctctgtcgcccagatggccttgttgtttgtgcggtggtacgatcttggctcactgcaaggtccacctcctgggttcaagcgattctcctgcctcagcctcctgagtagctgggattacaggtgcttgccactacactcagctaatttttatgttttcagtagagatggggtttcaccatgttggccaggttgctctcgaactcctgacctcaaatgatctgcccaccttggcctcccaaagtgctaggattacaggcatgaaccaccgtgctgggcactcatttgcctttatttacctcttcactccttcccctgaatccaggtaatgtcctagagagacagcattagcctcttgacagcttgtgtattactggaagaagccataggttgttctgatcctttagaactaaatatttctgggaaaatgaacctttttgggggataggaaactggtgtttacctgtttaagaagtgtgaaatgcaggctcagtctccacgtctttactcatcttaccaaagtcacttctcctacacggagagtgtatgtggtgtgggagggcacgtggcttggtggcagcagcagtgggtgaaggaaggcaatgctcgcaattgtgtcctaccacagatgtattagccaaggggctgaggagaagcacatcttctgcctggtacaggtgaggccagcagaggagtgcctgggtgcctaggacagggactggccagggctttggctccttcccacccactgtcggttccatgtgggactgatgggaacattaaacagctcctattcagcgtcttctctgtggatggaggacccacttaaccttgttctcttctctttgctttccctgggagtgtgtttggcttttcttttctcaggtgatggcatttccccccaccccagtaattcaattagtgtagaaaagtatgaatatttataaaagtatttcaaaatgtataaccaagagattacttaaaagttttagttgctggtttttgtaattaaaaatactcctctcggctgggtgcagcactttgggaggacaaggcgggtggatcatctgaggtcaggagtttgagactagcctggccaacatggtgaaaccccgtctctactgaaaatgcaaaaattagccgggcatgatggtatgtgtctgtagtcccagatagtccagaggctgaggtgggagaatcacttgaaaccgggaggtggaggttgcagtgagcctagattgcaccattgcactccagcctgggtgacaagagagaaactctgtctcaaaaaaaaaaaaaaaaagaaaaaagaaaaaagaaaaaatactcctctccccttgcaaggggatcccaatatcagcacccaaatgcaagacccaagctccagctcatttgcaccagctgcacacctctgaggtctggctatcatactctttccttacttatgtggaacttaggttgttagcaccatcactgaggtgctaagtcctggcatccttctcctgcttttcatttggagcctatctggactgactcagctcactgccaatgtgctcatcgagctggcactgggattggcaaataaatggatttgaaattggttggggagtttcttacatatatcaagcttttggctacagatatcatcctatttttgtttattaatctttaaacctagcctatgtggtgtcttgttagtacaggatggtgcttttgtgatttatatagacaatactgtcagatattcggccatatcctcttaattaaatgagtgggtttttgggaactggatgtttttggggacgagaacatcaattatattgtatccatcggtagcttggtaggtttaagtgaatcagtctttcccggagttccttggttcttggaaaagctgtctctcccagcagatttggttgttatggttgaatctcgtctacttatccctctatttccatacaaattgcttgatgcttttatgttttattatgtctgctattgttcacctgtattctacaaattattgttttttaagatatggcctttttaagcttttgattcttggcaagatgtaatagacttatttctccctattcccccagctaagggtaactaaaaaccctggacataatactaaaggcaaatgtaggaagactctaaaacacagtcagaaggcagcagactggctagggaccttggagcttggggaatgacatcagtgagttccttggattttctttttgtcctctatatattttagactgagtgttggcaaatcccacatcctgaaaatgtcaactggtgcagattttaaaaagttataagaaaagcctgctatttctagacaaagaattgagcaaagggcatcctaacaggatagaaaccttatttacaatacctgtccaactcctgccaaagataatgaaaatctccccaccccacttagtgccagtgcagtggacattgaggtggggagtctggatttctgcctgctatttggtggtagtagcaagctgtactctgattcctccaccagggtcgccaggagccaagtggacggcctgaactcacgtctgctcctggcagcaaaaagtggtagaaggcagtaaaaagtggtagaaggcagtgttctgcttcctccaccaagatggtgtcagtgggagctgagcagagagcttgacttttcatcctctgcccaatggatactctctgcttcccctgctggtgtattaccaacagaccaagtgtgcaccctgattttccatctcccatctgacagtagcaggctgtttatcctgctggagtggtgtcagcagaggctaagcagggaacttgaatatctgtcctctgcctggtagcaccaacatggttttttacttttccctgataacatggtgtctgttggggtgaatgaagagtctgtacttccacccccaacttggaggcagtgagacagtgtgaggcagcattctgcttccctctctggggcggggccagtggaataagtgagaagtatgaacttccaccctcaggccagcagcagtgaaacagtgctcgattctcccgccaaagtggtgtcagtagaggcccagggaggaacctagacttccactcccagtggccagcatccagtggtggcaggtgaagttgtttcccttctcaactagagagtaggggtacgatttgggagagaggagagctagagaaagggattttgcatatgaagtcctagacatacccgttcagtgacccatacaagaaactgaccagaattaatacaacaaaaagtttaggaactgaactatagtgtggaatgctgcccaggtttttagattggcctctgggtagcacacaaaggaagcagaccagaatagcactacaatgctctgaaaactaaattgttgttggagccacaacccacacaagtaagccagaaccagtatactaagcctaaataggatgtctacctactgaaaaagatgaagtaggatctggaatttcataacttaatacccaaaatgtctaggatataattaaaaattacttttcataccaagaaccaggacaatcacaacttgaattagacaatcaacagatgctgttatggattgaatgtttgtgtctcccccaaatttataagttgaagccctaaccctgcaatgtgatgtttggaggtgggacctttggaaggtaattagatttaggtgaggtcatgagggttaggctcaagagggattaatgtccttagaagaataagagagaccagtactctctctctctaccgtgtgaagacacagctagaaggtgattatctgtaagccagaaaggggaccctcaccaggaaccacgtcgactcattccttgatcttggacttccccagcatccagaattgtgagaaataaatgtatgttgtttaagctgcccagtatatgatattttgttatagcagcctgagaagactgagacagatgctaatactgaaatgactcagaagttgaaatcatctaacaagaattttaaaacaactattataaaattgcttcagcaagcaattatgagcacccttgaagcaaagtctcagcaaggaaacagaagataagaaaaaagaaccaaatggaattatagaactgaacaatataataactaaaactttaaaagtcaccagataggctcagtagcagaacagagatgacagagaaaagaatcagtaaacttaaagacagataaataaaaattacacagtctgaacaacaaagagaagatagattggagaaaaaaaataacagagctttagggacctgtggaactgtaacaaaagatctaacatttgtgtcattggaattccagatggagagtagaaagaatatggggctagaaaataatcaagaaacaagggctaacaaattcccaaatgtggtgaaaggcataaactcacagattcataaagtgaatccagtgaatccaggtgaactccagacaggataaactcaaagaaatcaacaccaagatacatcacagttaaacttctgaaaactaaagacagaaaaatcttcaaagcaactagaaaaaataacacaactataggggaacaatgattgagcgatattgaattttttatctgaaaccatagaggccagaagtatgtggaatatttttcaattgctgggggaaaaaatgaactgtccacacagaattttatagccgtgaatatatttcaggagtgaaagggaagtcaagacacttttagagagaggaaaattaagaaaatttctcaccagcagacctactctgaaagaatgactaaaggatattctccaaatagaatgaaaaaagaataatagaaagaaacttgaaatatcaggaataaagaaagaacaatgtaatgaataaaaaatagggaaaatgcagcctatccttttcttcttgagtttttattatttattttctaatttttaacttttaagttcaggggtacatgttcaggtttgttatatagataaacttgtgtcataggggtttgttgtatagattatttcatcacccaggtattaagcccaagtacccaacagttatttttcctgatcccctccctattcccatcctccacccaataggccccagtgtgtgttgttcccctctaagtatccgtgtgttatcatcatttaactcccacttataagagagaacatgtggtatttggttttctgttcctgcattagtttgttaagaataatggcctccagctccatccatgtttcttgaagggatagatctcattcttttttatggctgcgtagtattccatggtctttgcccagtctatctttgatgggcatttaggttgattccatgtgtttgctattttgacaaatctgacaaaaacaagcaatggggaaaggattccctattcaataaatgttgctgggataactggctagccatacacggaatattgaaactggaccctttccttataccatatacaaaaatgaactcaagatggattaaagacttaacctaaaactatgaaaaccctggaagacaacttaggcaataccattcaggacataggcatgggcaaagatttcatgacgaagatgccaaaaccaattgcaacaaaagcaaaaattaacaaatgggatctaattaaactaaagagcttttgcacagcaaaagaaactatcaataaacaacctacagaatgggagaaaatttttgcaaactatgcatccaacaaaggtctgatatccagcatctgtaagaaacttgaacaaatttacaagaaaaaaacaaccccattacaaactgggcaaactgctgaagtttgaccccagcgacatcaaagttgtatgcctggccgggcgtggtggctctcgcctgtaatcccagcactttgggaggccaaggcgggtggatcacgggtcagaagatagagaccattctggctaacatggtgaaaccccgtctctactaaaaatacaaaaaaaattagccgggcgtggcggttggcgcctgtagtcccagctactcaggaggctgaggcaggagaatggcgtgaacctgggaggcggagcttgcagtgagccaagatcacgccgctgcactccagcctggcgactgagcaggagtccatctcaaaaaaaaaaaaaaaaaaaaaaaaagttgtatacctgagatgcacggagggtgaaatgggcgccatgtctgtgctggcacaggtatcattgctggtatctggcactggcccccaagattggccccctgggtctgtctccgaaaaaggttggtgatgacattgccaaggcagccggtgactggaggggtctgaggattacagtgaaactggccattcagaacagacaggccctgattgaggcagtgccttctgcctctgccctgatcgtcaaagccctcaaggaactgccaagggacagaaagaaatggaaaaacatcaaacacagtggaaatatcacttgtgatgagattgtcaacattacttgacagatgcggcaccaatctttagccagagaactctctagaaccattaaagagatcctggggactgctcagtttgtgggctgcagtgttgatggccgtcacctcatgacatcatagatgacatcaacagtggtgcagtggaatgcccagctagttaagcacaaaggaaaatatttcaataaaggttcatttgacaactaaaagaaaagtgggcaaaggacatagacacttttcaaaagaagacatacatgtgggcaacaatcatatgaaaaaaagctcaacatcactgatcattagagaaaagcaaatcaaaaccacagtgagataccatctcacaccaactataatggctattgttaaaaagtcaaaaaataatagatgctggcaagggttgtagagaaaaaggaatgcttatacactgttggtgggagtgtaaattaattccacattgtggaaaacagtgtggcaattcctcaaagacctaaagacagaaatagcatttgacccagcaatcccattactgggtatatacctaaaggaatagaaattgttctgttataaagacacacatgcatatgtttttgagtttttaaaattgtttgatagttgaagcaaaaattatgacaagatctgtttctgaatgtatagtgaggaattttgaagacaattaggaggaagaaaggattaaacataattggaggtaaggtttctacatttcactcaaagtgataaaacattgataccagtagattatgatgttacttatgtatattataatacttagaacaatcattattaaaaactatacaaacagttacactcaaaagcataggtaatccaaaaaggaattatataaaatgtaccttggtttgtcacaggaaggtgagaaatgggaaacaggaacaaaaactggaggaaacaaaaaaaataaataaaatggtgtatttaagctctaacatataaaaatattaccttaaaacataaatgtataataattgtaaaatgttttataattggtctaaatataccaattaaacagattttcataatgaattttaaatgaatttcaaaaatatgctttctacaagaaattcaaatataatgataaagacagtaggttgaaagtaaaagaatggaaagcatatcatacagatattaattaaaaagcaggagttactatattaatatcaaagttgactttagattaaaggaaattattaggaacaagagcaatttacataatgataaaagggccagtccattaaaatatacagtaattctaaatgtgtatgtaccacttttatttgtatataaaaatacctgaagcaaaaactaacagaactaaaagaaagaaacagacaaatccgcaattacagttggggatttcaacatccctttctcagaattgctagaactactagacagcggatcagtaagggtattaaagagctgaataacaccttcaaccagaaaaatttaattgacatttatggaacattccattctacaacagcagaatatacattctttttaagtgtccatgaaacactcctcaaaatagagtatatcctgagtaatcaaacagatctcaacagttttaaaagaactgaaattaggcagagtatgttctctcattataatggaatcaaactagaaaccagtcatagataggaagaaaatctccagtcaagtcaaagaggaaatctcaggggaggttaaaaaaaaaagatacattgaactgattaaaaatgaaaatgcactttatcaaaatttgcaggatccaactaaagctggaagggaaatttgcttatattagagaagaagtaaggtctcatacctataatggaaggtcctacttcaagaaactaggaaaagatgatcgaaacaagctcaaagcaagcagaaggaaggaaataaagagcagaaatcaatgaaattgaaaacatgaaaacagtagagaaaaatcagtgaaaccaaaaggtgataaacttctatcaagactgacaaacatggctgggcacggtggctcacgcctataatcccagcactttgggaggctgaggtgggcagatcacctgaggtcaggagttcgagaccagtctggctaatatggtgaaaccccttctctactaaaagtaaaaaaaatgagccaggcatggtggcgcacgcttgtagtccgagctactcgggagactgaggcaggagaatcacttgagcccaggaaacagaggctgcagtgagccaagattgcaccactgcactccagtctgagcaacagaacgagactctgtttcaaaaacaaaaaacaaaacaaaaacaaaaacaaaaaatccacaagactgacaaacacataaagcactaagataaaaattacctgtatcaagaatgaaaccaggaatatcattacagatcctgcagaaattaaaaggaaaatacagtaagagaatactatgaacaactctatgcatataaatttgataactttcatgaaatagtccagctgttttataagcacatattatccaaatttacccaatatgaaataatacgagtagtcctataaccattaaaaaaacttgaatttgtagtgaaaaaccttctataaaggaagtctccaggttcagatagtttcactggagatattaaccaaacatttaaaaaccactggcgtcaattctacacagtttgttccagaaaatgtaagagggaggaacacttcccaacttactttatgaggccagtgtcacactaatacctgaaccagacagagtacaaaataaactacatagcaacattcctcacgaacatggaaacaaaaatcctcaccaaaatttagccaatcaaatccagcaatatgtaaaaagaattatgcattatatataatcacatggagtttattaccagaatgcaaggctggttcagtgtacaaaaaataatcagtataacccaacatatcagtaggctaaagaagaaaaatcacatcatcttatgtcagttaatacacaaagagcatttgaccatattcagtacccattcatgataactcagaaatctaggaatagaaaccttacttgataacaagcatttacaaaaagtctgcatggaatattatacttaacagtgaaagactgaatactttgccactgaggtcagaaacaagccaaggatgttcactcttaccactcattcaacacagtcatagccaatgcagtaaggcaaggcaaggaaaaaataaaactatctcattttccagatgacacagttgtccatgtataactcccaaagagcctccaaaaaaaagtcttctagaattaataagtgagttcagcaatgtcacaagatatacagacaatgcaaatcaattgtatttctatatactaacaaagaatatttggaaattgaaattaaaaacatatgtaccatttacagttgctcccctaaaaatgaaatatttaggaataaatctaacaagacagatataagatctatatgctcaaaagtataaaagttgggtgaaagatgatgatggagttaaatcaaagaagacttaattaaatggagtgacacactgtgtccatggattgaaacattcaacatagtaaaaatgttaactctctctgaatgtataagtttagtgcaattcctatcaaaatttcagcaggatttttttgtagatgagcttattctaaagtttgtatggaaagttgaaggaactagaatagctagaattttaaaaagaagaataagtggaagaaaacacaccacctgattttaaggcttactctgtagctatagtaatcaagacaatgtggtattggtggagagaaagaatcatagatcaatggaacagagtagagaacctagaaatagacccacactaatacaactgactgatttttgacaggtgcaaaagtagttcaatggaagacaaatagtcttttcagcaaatagtgggcatccataagcaaaaaatgagctgtcacttaaacctcataccttaaaaaaaattaattcaaaatagatcatagatttaaatgtaaaatgtgaaactaaaaagaaaaaaaaaatcttctagaatgaaacatagaacatctttgggaactaggaccaggtaaagagttcttatgacatggcaccaaatgtaagatttataaaagaaaaaaattgataaattggacttcaccaaaattaaaaagttttgttttgtcaaataccctgttaagatgatcagaagataaactactggaaggaaatatttgcatatcatataccagcagtcctcattttatgttatgtggaattgtgaaaatgtgcacactgaaactatgcaaaacaatcttaacataatcaagggaaaaattatgattgttccatgatccttgaaatgttttgccagacattaaagcaactacattgctattggttataagtatatatagaaatgaaaaagcaatagtaatatttatttagcacactgtaatttaaaacattagaaacatttagaattatgccgggcacaatggctcacacctgcaatcctagcactttgggaggatcgcttgattctaggagtttgagactagcctgggcaacatagcccggaaatggtctatgttttctacaaaaaatagtttttttctaccccccaaaaaaaagaattcttttttttttctttcttgcttttttttttttgacagggtctctgtcacccaggctggagtgcagtggcaggattacagctcaagtgatcctcccacctcagcctcccgggtagctgggactacaggtgtgtgccaccatgccacaccaaaaaatacatttttttttttgagacagagtcttgctctgtcgcccacacgggagtacagtggtatgatcttggctcactgcagcctccacctcccaggttcaagtgattctcctgccccagcctcccaagttacaggcatgtgtcaccatgcctggtcatttttgtatttttagcagagaaggggtttcatcttctctctaatttcaccttctctagttggccaggctggttttgaactcctggcctcaggtgatccacctgccttgaccttccaaagtgctgagattacaggcgtgagccactgcgcctggccaaaaaattcaaataatttttgtgttttttgtagacacagggttttgccatgttgcctaggctgttctcgaactcctggctcaagcgatccacccacctcagcttcccaaagtgctgagattataatctaattataacctaatctcgttagaaagaagtatgataattagccaagagagaaaagatgcttgctctgtgtcacaatttttttggagtcagagtctcactctattgctcaggttgaagtggtacgatcacagctcactgcagtctcaccctcctggactcaagtgatcctcccacctcagcctgagtagttaggactatgggcacacatcaccatgcctggctaaaatttttagtttttacagaaaactaaaaacttggctgggtatggtggcccacatctgtaatctcagcactttgggaggctgaggtgggtggatcgcttgagccaggagttcaagaccagcctgggcaacatggcgaaaccccatgtctacaaaaaactaaaaattttagccaggcgtggtgacttgtgcctgtagtcctaactactcacgctggggtggaaggatcacttgagtccaggagggtgagactgcagcgagctgtgattgtaccactgcacttcaacgtgagcaatagagcgagaccctgactccaaaaaaattatgacatagagcaagcatcttttctctcttggctaattatcatacatctttctaagtatggatgagcctccaacatttcacccttcgtactttcaatgttgtgaaatttctcagagagttcctgtaatgtgaagttttttgccagtgtcatttcatcctttttatcactttcctaatttgtgtctgtaagtttgcctttgctgagtccctctgtctgcacatctagagctcatcaacagtggcagtgttaacattcccacagtcagccatttcttctataactccatgtacattcaattcaaatttcattgccaaagttaccacctttcatttatttgctgcgctttcatctttgctggccagttctctgtttaaaaaaatagaatttaaaaaatataaatacagagagtctcactatattgcccagactggtctggaactcctgagctcaagttgtccacctgccttggcctcccaaacttctaggattacaggcatgaaccactgtgtatataacattttttaaatgccagaattataaacatggagaataaattagtgacaaccagggcacagggatgtaagagagtagcatgggaggataaagtataactgtaaaggagtagtacatagtagattatgtgatcatggtgggacagttctctagcatgattgttctggtagttacacaagtctacatctcaggtaaaattacatagaatgatacacatacacacatacatgtaagtgagtatatgtaaaaactggtgaaatccaaacaaggtgtttagtctagttaacagtatggtacctgtgtccttttcttgattttgacattgtatccttatgtaatatccttatgtaaaatgttaacattgagggaagctggatgaagggtacatgacactctctgtactattttttgttatttcttgggaatttataattatttcaaagtaaaagttttgttttgttttgttttgttttgttttgttttgttttgttttgttttgtgatggagtctcgctctgtcgcttaggctggagtgcagtggcacgatctccgctcactgcaacctctgccttctgggttcaagcgattctcctgcctcagcctcccgagtagctgggactacaggtgtgagccaccatgcccggctaatttttgtatttttagtagagatggggtttcaccatattggtcaggctggtcttgaactcctgacctcgtgatctgcctgcctcggcctaccaaagtgctgggattacaggtgtgagccactgtgcccggccaaaacctttttttttttttgaggccttcttgagagccaggcacacatcgtttttgtgagacagatgtcactagtttcttattgtgctcacttgcctatcatctcacagttctagaaagtgactcagccttcccagacctctttgcttggctttggcagccatccagagacctctagctgggtgcagggagagtatctcatattattttagcccagagaatcaggatgtggcgccccatggatgtgattgctccgctaggagcttggtcttttttaagagaggctgattcatttctttggttggtgtttctatggagtgcttgtaactggggagaaaaacccataggtaatagatgagcaatttggagctgacagctgttcatcatccggctttttataaatatctgtgccttttagtttttcttggaagacagatacataagccactgtgacttttcagactctctttataggcactatcttctcaaattgggaagaaaacagtgtcacatgtataaaatatttaattaaagtcttttattcacctctaatgtaacttcatttttaaagtttttatatgtgagtggagtggggaaggattcagagaaaattgttcgagatttgagtatagtacatatagtaatttagccatttcaaacagttgaacaaattgtacacctgtggttagattgacagtaatgacagtgatttaattttcatcagcaaattgctcctgctgtgacagctcttacccatagttttctatgtccaagtttccctaaaatgttgttggattgggtagggcaaggccaagatagtctatgattgtgagaagtggagaagtagggtgtgggttattctaccttaggtctcagctgtttcatatgtggtttgaggttgaagatgaacttgcattacttccccttaactcagtggttgtgacaaaaagcctttctattcttcctgaatattggaaatcggacttgaataagcgaatcttggaacatcttgagtgtgtttttagagctgaggcctatataggcagactttgagggctgtcttctctgggcatcttagaaagtattagtatttttgatagcatagatgagagaagactgtgagtcttggagcagcagttttttgaggatgggcatccatggtagaccacagacatcttgggcagatgtctccaaccaatttaatcacctctttgctgctctccttaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcaggtactgtatttcttcgtccataagtcagacttttaacagctccaaaaataaatcccccttccctaagccctaagaaaatagcatcaacatctttacttctctcccagagcacagactatttttaatctagtcttgttatcttttgtagtaagatacagtcttagaggccagagccaacttctttttctttttttgtctgagtcagagtctcactcggtcacccagcctggagtgcagtggcgcgatctcggctcactgcaacctccacctcctgggttcaagctattctcctgcctcagccttccgagcaacagggattacaggtgtgcaccaccacgcccagctaattttttgtatttttgatagagatagggtttcactatgttggccaggctggtcttgaactcctaacctcaagtgatccacccaccttgtcctcccaaagtgctgggattacaggcttgagccaccatgcctggccagccaacctctttttcatgtggagtggtaccttctttagtacctctgagggtaccacagagataaaatagacatagtcctagttatgcagcttatagcctggaagaggaagtaattgaataatgaacaattgaacaaattaattaaataatgagataatttaagattgtaatgagggctccagagggtgatgtaagaatatgtaactggagaacttagagcctagtcatggacaataagggaggcttctcagaggatgtgacatttaggccaagcgttataggatgattggggttggctgggtgaagaggggggactagagcaggggatggcaaactactgcccataggtcaaatctggcccaacacctcctttcctaaataaaattttattggggcacagcaacccctatttgttcatgcattgtttattgctgtttttatgccacaatggcagaattgagtagttgtgacagagaccatatggctcacaaagtcaaaaatatttactaccaggccctttagaaaaagtttgccaatccttagattagagcattccagctagaggaaacaacatgtgcagagattctagggcagggacaagcttggggagattgagggcctggaaaagattggagtgactggagcacagcggcctggaggggagcatagatgaagtgggaaggttcgggggctggagaggtgaggttggagatatcatgctctttatgattttagccttgatcctaagaaccactagagagtttgaagcagggaagtaactgatcagacttataataactaatatttgttgagtgttgtcatataccaggcactgcttcaagtgctctgtatgcattaattcattgacttccgtggctgccctatgagtaggtaccactattaatcccattttataaccgaggaaaatgaggcacagagagattatgtaattgctcaagatcatccagcctagtgagtggtagagctggaatttgcagcaaggtctgtctgaccctaaactctgtgctctaaaacttttggccactctgtttctcaaaggcaactggtaccttttgaattaagctcaaaaggtggagctaacaaggagccaataaaagccattgatttattcaataaataaatcaagtgtctactaactcccaggcactgttccaggcacttgagatacgtctatgaacaaaattagggcttaaccttctagcagaagcagatagacaagcataagaaagaagtaattatatgtaatatgtttgtaggtaataaatactgtagaaaaatagaaactatggcgagataggaactggcagcattgagaaggggcatctctggctggaggaagagcaagtgtggaagcccggtggtgggaacatgcctagtgtgtttgaatcagctggagctgagagcaggcagagaagaagtacatacagctcagagagataatgggaggaagaatatagagggcctgtaggccatggaaaagagtgaacttgcatattattgaaggatattgagcagaagaatgatgtgatctgacttacttttaaaaggattcctccagctactgtgttgagaattagactgcaggtggggggcttggtagaagcagagaccagataggaggctattgcagtaatccagactaggggcaacagtggcccaggaggctgtgtaatcataatcaaaggcttgtttgagatccttgtcaagacacagatcctcaatgtcctcccatgcaccatgcacgacagtgcccttgttctctgtaaactgggctaaaagacatgctttcttcctttaggattttgccagcatctgtggtgaaagaggatgagtatgcactgtatccataggaattatggggcagcctcttcatcttctttctctgctcataactctttctcaggcctcaaatagcaggactctgatcctcttagagaaaaaaaatgaacctcggttctctttcccctttccagtcttactctccagggtaaaaaccaagaactccaacagcttttccattagagatatttaaaggattaaggatataaggggttatttgccaactcagtcctcctttgatgttgacagcttctattttttctcatcttaacatatttggatgaatctttaggtatcaggtcaccatgggctcttgcacatgaaacaccaaaatgactggagagcttatcatacctggaagggtgtgagtccacaggaggcttgggctagcattgccccaacaaagttctttgttttcccttgtaggctctttgtcacttggcagtgtcttccctaaggtgacatccccattctgctttcacaggccacctcaccagacccatcctgaggtcatcccaaaatcagtccctggcagaagccaaatttgtctgttggcagagaaatgttctggatcattggtgttttgactggaagggctggtgcatcaggctgccatgcagcaatgttaagctgtgatttcactgggggattaagtaagacacaactcggcccgagtcccagttgtgatgggggcttggggtgatgtagtactagttttaaggaagatggcactttcctagccaggaacttccccagtcctttctcattccagactcactgaatggtggtttgaggagctgtaggctccaaggacccaaaccaggtctgccaggcttcctcacagccatatttgaattattaaacaggatatgtgaaaagcaaaaccttgtgtgtggaaacagatggtgagttatttatgaggagcggcctccgtccgccccatctacctcgggcagtacatttgccttctcccacgtgtctcctcagctgtgtgccaccatttttccccttcgctgtttcccattctctcattgtcttatcagtgccctgcttctttcctttcctccagggtgttggcatagttccctcctgcactccctcctcctcttcctctctgcctgtcccaccccaccccgaaggcagcctgagaacagttttggccccagaccgagatggggagctgtggacctgggctatggtcatggtttctcctgtatgtcaccaggggggggcccagcttttgatgtgcactgggcagaatgaatcgtttcttcctcactgttagtgaagtaaaccatgagaaaacatcccaaaaaggctgaagtgcttatataaatgtctgcatttctatcatgctgaattatcattgtagtaatagtagataaactgactctagaacagaaggtccatgattctgggctgtgttgctttggagctgaccgagtggcagctgctctgctaggaactcataccagctttataagtggccattccaggcgtggtatgacaggattctgagccatagttttgtatccagaaaacccagaggaaggacaaccaaagaataggtagtgaattcttacattgtaaaattagagcatgtagggaaggaaggaaggtgcttatgtcagcaaagcacccaaccctgagtctccctagttagctgggctgtggctcaaccagttattcctcttcataagaacagtttggggcagaaaaatgtccatggcctggggccacatggcagagcagacttcatgcttacttcacaacctggtttagccattacttcatgtctgcggtaccagaggcccattcattttgttggcacagataccccagattgcctttttattcacactggagctttatttcaggaacattcttttctgatcaaattcatactcattaatgcaacagttattcattgaacacctaaccatatgctcagcaccatcctagtccctggagctacaagcgtggacagacagacaaaacccctgctgtcatggagattccatccaaatgtgtatgaatatgatttttcaagtggcaacaacaggctaggccaccacaaaacactagcacagtcaaataccaatcctcacacttgatttctctgtcagagtcctctcctagttcagagaggcaaggatgcagttgggaaggggccctgtggaatctggaggagaaagatgggtagcagccacagttgttgggcttcagcttcctgagttttcctcatgattgatagcgtgggattagcatatgggcaagatgcagcctttgtggcaacaaagatatattcgagggagactgtagcgggtacatgtagaaaacaggatccagtgacctttctgaggaaagcgagttgtcttgttccagggtactaataaactgtgggtaatgagatccgctatagagtaaaagagagaatccggacttggggatttggagcttaaatgatagcctagaccaatgctgttgaatagaactttatgtaatgatagaaatgttctgcactgtctgatacatagccactagccagtagcacaggcttagacagaaacctttgggagagcgattttcttgcatattttatcatgaatgtcttcagatgcagtcaacctgagatgcaagagaaaggtactattgttattcccccctccccagcactcttacggcaacccccctcccaataacagggctccttttatagtccctagcttctaatttaaaatcagctttaaaaatctgcctccactgtccccattgggattggacatcagcaggaagcatggcaccatttagtggtgctgatgacgccagattctttgtgttaacagcttgtacattaggagcaagctttgtgactcattatgatattagaattttccaggacatgtttggcataagcaatagctaggtgtcatttctgctgattcccacgcaggtgctcatcaatcgtgttagatgaattaggagttctcaaatttaagagtattaaaaaattggtttttacaaaccttttcttagtcaaaaaggccattattgatttttccatggctttttaatttgtttttgggtagtcaccaaaagaaaggctctaagaacagctttcctgtccctgatggctatgctgtactaagcagtggctctgttgcagatggacaatgcgcaggacctgctttcctttggtggtcttcaagtggtgatcaatgggctgaacagcacagagcccctcgtgaaggagtatgctgcgtttgtgctgggcgctgccttttccaggtgagcagtataatggacgtcccaatggccagaattgcttggcctgatctgcttggaagaagggtacacttgaatgtgcctgttgctactgacatttcagtgtcatctcaatgaaactagagtaaaatttgattctgcccttattccaagtagataggaatttttacccatgttgtcaccatctgtgactctctgttcccccatcttatgtgtatggacatttaataacacatcttaggtcacattctctgttttattcaaagcttgtaaaaagttagaccaactataaatagtagagagggaggggaataaacaagagtaggtcttttggcagtaaagctacatctagtgacgaataaatgatgagcctgaccaagggggtgctttcagggaggaatgtgtcttgccctagttgtctggaaccaatgtacatgccgtcagattatcgccctctctaggttggaaattgttgagaatttcagttagtctggcttgtgatggaagactgataaggcaagaggagtggggaggtagcatctcgaaagagtagatgccaaaagatatgtaggcaccacatcattctacaccacctgcaaaggtcaagatatctgcatgctgcaattggtccattggagctattgttcctcccatttttgaaaatctgctcttaggaccatttgtgcctttaaaacaggaacaaatattctgattcttgctgcaagggcatgggtggaggctattagatgcttagatgcaggtcacgatgttacaggagaaaagctattctgaacatatttaccattataggctttgtttcgagaagatttcctttgtgctttatctgtgcttgttttttaaatcagaatctcagtctgatgctctctcactctgaaaggcattcagcatattttcttagtaagttgaagggcagagctgggaaagctggaggagttgttccatgaggagaggcactgccggcctttgtttccgttatcaccactctgcctggatcttcaagccctggctccctgtgttggtggtgttgacagtcaaggctctggcctcaagggcaactccacctcccttggtctcacctcccagaaccaaagtctcccaggaagcccagggaaatctcctcctgtgcagccactggaaagatggaaaatctgcatgtttgacgttagtatctgcggtttcagtcatgaggaagtccaggaaatccagggtcttagccttataaggctttagaggcttgagaacttactaaagctcactttttacttctcaggccagaaaagaactaaatccaacattattaacctctctccagaccctttttggaaatctttgccttactcccgagtacttttattctacctttaatatgaacaaattatcctatacgtcccttgccgttgcttctggaaatacattacttgggggaaactgtgtagcattttcatgtcacatcctagttaaaggggactaattaagtgacttgagaaacatgcgttgggcctgctttgcagacccgtaactcacccaggggctgtgccaatgtgtggtgttattaagacttttctgtgattgtattagcttaagaccatgttaacatttatgcagcatcaactaaaatttaaatagagataaatataaaatattgcaatttagtgttttggtggcaagcaaactgctgtattcaaaatgttctagctaggtttttgatggctcactggagggctgttaccgtgacagcatggtatggcgccagagcttttggaagccaacagcaggctcccaaacaccatggaaatgtcaatgttttctgcaaagaggaacttgatgcaaggtaaggatatttctacatggagaggtaggtttcagtactctagtctgatattcatcatttactcttcatgtcttaagtattggctctgcacctctgtaaccgcttctagtatacaggtgtgtatacacctgccacacatgtgcacaaatacacaacacagtgatgggatgagcttgctctttatcaagagggtgttcagatgatagtgagcactctggaatcatggagtcctagcactggggatagtatctagaagatattctttctagttttctgctgatgggcatgaatactgctcagtcagtccagatgtttgggtatttaggaggattaggcagaccactggacctacagtcaatctagtttcaagtttagtttctactatttcctatctgtgtgcccatggacaacctttctaagcctcacctttttcttacgttaacagggaacaataataggtgttctctgcatttcataaaattgagtgagtatcaaataatatacaatgacctgtgaaaacggttgtaaagcacctgtcagtgacaagatggtatcaatatcatccccctcatcaggatgtgtcctttatactatgagtttctgctatagtaattcttatttcttttctttctgcaataaaaacctttatcttcctcattttctcttctgttaagtcgcttatattctaccatgtatctcttggtgctacccttttttttttttttttttttgagtcagggtctcattcttttcactcaggctggagtacagtggcccgatcttggctcactgcaacctctgcctcctgggctcaggtgatccttccacctcagccatctctgtagctgggactacaggtacgcggcaccacatctggctaatttttataatttttgtagaggcaaggtttcaccatgttgtccaggccagtctcccggactcaagcaatctgtccatgttggcttcccaaagtgctgggcttataggcatgagccaccatgtccggtctcttgttgctaatcctgctgcttcattgagggcatttatttgcctgcttgggttaattgcttaataaggttttgatatacatttgtgtggatgaagagatctatttcctggtgttaaacatgaagcaattattccaagatcgagaagagagagtacatgtaaatgtaattgacatgactactaaatgttacatgaccactgaaataaagtttatttaaatactattcacacttatatatgggtcacacacgttcattttcctgtttttgcccacatataaggcaggtcaagctcttacataaaaagatatgcaggggtaggggtgctgatgcttttagcagcttcgtcttttaatggtttttcttttatctcaaacctgctttctccttcttcaagtaaatactttcattggcctttctgtgacctgatttaatctcataatggcacttgtgtgtgtctgtctgcagtctgacctaccaggagtctctggagttccagacaagtcatttgtgtttctgtataaggggagtctcgaaaaggctttgtgaatttcagaggccaggcagccttctgtaatctggttttggttcttagcaaactagccgcctgcttttgttttcctcttagctccctatatatctcctttacctcgtaaccgtcaggagttaaactatcaagtaactagtatgcctgccccatgtaacactgactttgctgttctcatgcccctgcctcagtcacctttggagtcctgtatccttctttaataacccatgttctcatctgcacatgtatgaattactatgcaattacatgggcttataagcattcatgtttgcagtacttttgaactttccacagtttgcaggatgtcatggaactgaacctagtacaaaaaaggatgtacatgtgccattagtcatggtgagattatgtacttttacaatggatccccagaacaggtttctgttcttccccctttatccttggcatcatccttggaacctccttggcagattttgggttatatatatccctttataaaatgaacgtatccccctcccccaaccttgtcccctctcacctcatgctttgttggctctcttaatttccttagttgtgctcttcctgctgagggtttaccaattaattttaactctttgaacctgggtgcaatggcttacgcccataattccagcactttgggaggccacggcaggtggattgcttgagccagggttcaagaccaacctgggcaacatggtgaaaccctgtctctacaaaaaatacaaaaattagctgggcatggtagcatgtgcctgtggtcccagctatgctactcgagaggctgaagtgggaggattgcttgaacttggaaagtcaaggctgcagtgagccatgatcacaccattgcactccagcctaggtgacagagtgaggccctgtcaggggggaaaaaaaaaagagtagacagaaaggaatacaaatgagtgcacatgggcattaaattaatgtacttgaaactactattcctacaatctggtttctgtccctgaaatttttcaagagtactatccctgaaatttttcaagagtactttgtcatcattggcatctttgtggcagtcaaactgttggctgccactttccttagggaactttacctcttggctgccatgtcattatagtcccttggtttggggatgattgtaattaatcactcactccccttttccttttttggcaacatcatcatcttactatcttctgttaataattgtagctattcacaaagattcctccagccttgtcctccttctctcttttcattttctcccataatggtactatctattcctgtggtttcgaatccaacctcactgtggatgactctagtgtctacatttaagtccagcctttctcctgtggtcttctacgtttctaccacactgtctcatcgcacctcaaactcaagaaagtggaactcattattgtttcacaaactagatttttcctcccacattctctttttatctgttcttggcattgtgactattgtagttctccaagcttgaaacttttgagtgatatttgagtctacttccttcttcactttctcattaacttagtgaacaagtcctgtggattttaatttctactattgttgtctactagacaatcattccccatttttctggtttttaaggtttttttttagagacagggtctcactgtgttgcccaggctggagtgcaggggctcttcacaggtgtgatcatagcatactacagcttgaactcctgggctcaagcagtcttcttgccccagctttctgagtggctgggattacaggtatgcatcactgtgcctggcctccccctttttcatctactaaggaacctcgataatgtgagggcagcaacatgtttaggcagaagattcccttccccagttctaggaaatgcgctatgaatggtctaaagcaaacatggaaatcccattctctatggatgtgtattagtttagagatggccatgtggcccagttctgaccaatgagacataaagagatgtttgcttggaagcctctgggaaggattttgttcttataataacatagtaaggagaccctacccacttcttcctgccttgactgcagctgtcttggagctgcagcagctatcttggaccagtgaggtgagaagcacaagaacaaaaagccaacatgctgaggaggataatagaggcgaaagacaggaggaggaaactgggttatttatgatgtagtttagccactttcgtgattttggaaccatctacttccagatttttcttatgagaggtaatgaaatgtctttgttttttaagatcaatgttaatcatgattccattacttgcaactgagcatatattcatattgatatgaattcatctggatatttccaaaatccctctcagatcttttaaatgaaaaaaaaatcctgttgatcttcatagcattcatctcaatttgcagttatatatttggttggttacctgtttactgttaatctcccttattagatagtacttaggggataagatctcttttctatctttattctgctgtctctctaatatatagcataggacctagtattgggtgggtgctcaggaaataattattgaatgaatacatgaaaaacaaaggaataaattgataccttggacatgaattgtttttcagagaacgttggaggctgagtggacggtgctgtttttattattaatgatgtaatcatggatgattcagataccgcaccttgaccctttaaaatctaaggccatggaaatgagtgtatagccccactggctgaaggcccagaaaatagaaggttggagattgggatgaggtcacacactggagatgccagtgtttgaataaaagttcaaatgtgacccctaggacttgtctgacctcttgtctctagtagctcatttttccacactcttatagtgacaggagaggtgctcaagccttttgcatctgataaactgattagcatattaaccgagattggcctaggaaattggatagtcatagctctcttaagctacattcaaagtctgattacttttttcaaatggcaaataatgacgaatggaaaatgacctctgactctgaccagctatcctgagtactgcagaaactaagccttcattctggggagggaggcaccactttgcttaataaacttgtcccttcagcatttcgcttgaatttgtctttgtgatgtacctctgccttctccacatcctctatgtggctgtcttcagattttttcactactatccccttcttaatttcttccttacataactctcagcacacaaagttctttgttttatcatcatctttattagcatttgttgttggactcctaaactgactcttttttttttttttttgagacgaagtttcactcttgttgcccaggctggggtgcaaagacgcgatcttggctcactgtaacttctgcttcctgggttcaagtaattttcctgcctcagcctcccgagtagctgggattacaggtgtgtgccaccatgcccggctaattttgtatttttagtagagatggggtttctccatgttggtcaggctggtctcgaactccagacctcaggtgatccacctgcctcagcctcccagagtgctgggaaaactgactctttaatacatctacttctctgttgtaagccagttctttcatctatctcctcaacaagattgaaggcttcttgagcatgggaactggtattcaagtctgtggtgctcacagcaccttatagagggtaagtttcatgtggatgctttgaacataaatggtctaacacaaaaattgaagtcaccaaaaattggtgggagaaagaaagccaccaagagcaaggaggctttaaaatttttctgtgctttgagtttgtttgatttttcttccagtgagtatgtattatttttgtaattaacatttaaatagtgagtgatgaaacaaagcaaaacagcactgggagacttctcaatctatcaaatagcacatttcccaagaaactctcttagttcaaatacctgaagatgttgtattaaatacttaaacatttctttaaatgcttaattcagccaacaagaaactgtagagccactgctctgtgtaactgcaggggaatttaataatgtcatattctttatgtggtagccctgtaagaaagtgagagaaattctaaagcaaatataatggaaagctcaaatcctaagagatacaaaacactgaacctgacagctgacctgggaacatttgctattccctagtgactgtgagctcttggtttcaacaggaatcataatttaggggacaagagacaaagcttaggggccatgaaataattagaaaaatgaaaatcttccactaaaaaggaattattaaggcaaattggctttgagtggaagggagaaaaatgcctgcagatcttcagtctgtttcctaaggaaactgagtctgacatgccttctgaaaacagtgtaacaccacataggaagcactcttgatagaaaatctaatctgaatttgaacatacttctagatctgatgtccaatttaagggaaatattggggacaggtgataggttcaatgatataatagacttgcaatcagcaaagaccagactgtggaaaaccgtagagcaggcaaattactggctttttcacaaaataagatacaagagaaaaaaataaagagatgggatgaagcccataaattaaaagatatttaagatgaatatcagccaattatagttacaatgtatgtactttttgttttattttttgagacagatcttgctgtatcacccaagcctagagtgcagtggtgcaaacacggcttactgcagactcagtctcctgcctcagcctcctgtctagctgagaccacaggcatatgctccatgcctggctagtttttactttttattgttttgtagagacagggtcttactttgttgcccaggttgatcttaaactcctgggcttgagtgattctcccaccttggccttccaaagtgtttgtattacaggcgtgagcccccatgctggagctctacgatatgtttacatcttgaccaaatcagcaatctgcaaaaaaagaaaaaagaaaaaatcatgacataattgggaacatttaaacaattacttgatatttgataatatgaaggataatattaaatttttggtgtgaaaatggtattgttttgtttttgtaaaaaagagcctttttagagaagaagtatgctgaaaaatttatgggtaaaagataggatgtcgggccaggcacagtggctcgtgcctgtaatgccagcactttggtctcccatccaagtactaaccgggcccaaccttgcttagcttccaagatcagatgagatcaggcacattcagggtagcatggtcatagataatcaaagcactttgggaggccaaagtgaaaggattgcttgagcccaggagttcaagaccagcctgggcaacataaggagaccccgtctctacaaagaaatattttaatttagctgggtctggtggtatgtttctgtggtcccagctactcagaaggctgaggtgggaggattgcctgagaatggaagttgaggctgcagtgagccatgatcatgccactgcactgtagcctgggcaacagagcgagactccatctcagaaaacaacaacaaaaaccaaagataggatgtctccattatgctttattttgagatctgaggaggtgggtaggtggctgagtcggggtatagataaaatagtgctagctatgacttcataattttgaaagctgagtgaagagtccatggggattattataccattctctgtattttagtatatacatgaaaatttccatgggaaaaggttttttttaaaacgtagtttgaaattggcagaatttctgggttactggtagatgcagaaacaaatcctctttggaggaactcacatccaggcctcagagcatccccacaaacaaaaatcttcctatgatcatgagctcacaaccaaaacatcacaaagcacataaaaaataaggcactatgagtgaaagacagcagaaacagataatcaaacttttaaaactatagctagatggggtgcagtggctcacacttgtaatcacagcactttgggaggctgaggcaggaggatcacttgaagccaggagcttgagaccagcctgggcaacaaagcgagaacctgtctctattaataattttttaaaataaataaaaattggaggagccaagatggccgaataggaacagctccggtctacagctcccagcgtgaccgacgcagaagatgggtgatttctgcatttccatctgaggtaccgggttcatctcactagggagtgccagacagtgggcgcaggccagtgggtgcgcgcacggtgcgggagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctcagagggtcctacacccacggaatctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagggagcagtggttctcccagcacgcagctggagatctgagaaccggcagactgcctcttcaagtgggtccctgacccctgacccccgagcagcctaactgggaggcaccccccagcaggggcacactgacacatcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaagctctaaaaatcagagcgcctctcctcctccaaaggaatgcagctcctcaccagcaacggaacaaagctggatggagaatgactttgacgagctgagagaagaaggcttcagacgatcaaattactctgagctatgggaggacattcaaaccaaaggcaaagaagttgaaaactttgaaaaaaaattagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagtaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaatattcagattcaggaaatacagagaacgccacaaagatgctcctcaagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaagctaagcttcataagtgaaggagaaataaaatactttacagacaagcaaatgctgagagattttgtcaccaccagacctcccctaaaagagctcctgaaggaagcgctaaacatggaaaggaacaaccagtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtgttcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataacgcaagtcctgagtgacctacaaagagacttagactcccacacaataataatgggagactttaacaccccactgtcaacattagacagatcaacgagacagaaagtcaacaaggatacccaggaattgaactcagctctgcaccaaacggacctaatagacatctacagaactctccaccccaaatcaacagaatatacatttttttcagcaccacaccacacctattccaaaattgaccacatacttggaagtaaagcactcctcagcaaatgtaaaagaacagaagttataacaaactatctctcagaccacagtgcaatcaaactagaactcaggattaagaatctcactcaaagccgctcaactacatggaagctgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacaccacaattaaaagaactagaaaagcaagagcaaacacattcaaaagctagcagaaggcaagaaataactaaattcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctacgcaaataaattagaaaatctagaagaaatggataaattcctcgacacatacactctcccaagactaaaccaggaagaagttgaatctcttaatagaccaataacaggagctgaaattgtggcaataatcaatagcttaccaaccaaaaagagtccaggaccagatggattcacagctgaattctaccagaggtacagggaggaactggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaaccaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggaaaaggaaataaaggatattcaattaggaaaagaggaagtcaaattgtccctgtttgcagacgacatgattgtatatctagaaaaccccattgtctcagcccaaaatctccttaagctgatcagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaacactgctcaatgaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactgtctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaaaaaaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcatacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgatgagttagtgggcgcagcgcaccagcatggcacatgtatacatatgtaactaacctgcacaatgtgcacatgtaccctaaaacttaaagtataataaaaaaaaaaggaagaaaaaataaataaataaataaataaaaatttaaaaaattataggtagtaaaattcacagaaaacagaatataaaataatacgcttaaataagattttatcaaaagtatgggcaaaaaaacaataggctatcaaaagtgacaatggacagattagaaaatgacacaactagaacttcttttaaattaaaaaaaatttttttttacttggcagataaaattatatgtatttattttgtaaaacatgatatttcaaaatatatatacattctggaatgactaatcttgctcacataagttatcatttttgtggtgagagcacttaacatccctgcctcagcatttttcaggaatgcaatgtattgttattaactacagtcaccatgctatatgatagatatcttggacttaatcctcctgtccatctgaaatttcgtatcctttgaccaacatctcaatactcccctgccccagcaacctggcccgacatcctatcttttaccccagcccttggtaagtaccattctactctacttttatgagataaatttttttagattccacgtatgcacaagatgatgcaatacttgtctttctgtgcctggcttatgtcacttaacataatgtcctctagtttcatttgtattgtcacaaatggcagtttttctttatttttttctggctgaataatactccattgtgtgtgtacatcacattttctttatccattcattcattaatggacagttaggttgattcacaaatagaacttcttgaagttgaaaatctaattgcagttaggaattcagtagacaaggtaaatagctggttagacacagctgaagagtaattaagtaaactagagtatagaatggaagaaattacctaaagtgcagcatagacagaaaaatgaaaaaagaggttaagagatgtgaagatttgaatataaaggtctcacatgagtttcagaagaataaagagaataaacctctatttaaagaggtttggctgatacttttccaaacctctttaaattgataaaatacatgaattctgattcaggaaatccactgaatcccatgcacagtgattcaggagaaatccatttctggtaacagtgaaaccacagaaagactgggttataaaaacagaggccaggtacagtggctcacacctgtaatctcagcactttgggaggctgaggtggaaggatcacttgaggccaggaattcaagaccagcctgggaaacataacaagaccctatctcaaaaactaataattaaaaattaaagcaggcgaataataatgaagacagattagctgcaaagtaccaggagtggggaaagagggaagacagtgcttttggtattcttagcctagttgcttggcctgacactaggctctgtttgatataattttcatcagttctccacagctgtttccactgtggttccattgcctacaacattcctctcttggtgttccactcacctcccgttagacatctggattcaaggaaaaatccactgtgcttcccaaagttggagttatttcaggtgtgcctgttttctcattaaggtcctgttcacgggctgaggttattagaaagagtataattcatttattgaagcaaagagaagaatggaactacagagactggcaaggaggccaccagccagcatgggcttctcttactgttctggaagttcttactttcttacctcctaccagctttcagtttctctctctttctctgtttttatttttaatgtcctccttggttttgcagataatatatatgctcatcataaaatatttaaatgatacaggagacatcatcttctgtcttgacagtgtgaggagctttgttgacccactcctagtaaaacttgtgtacgttatttaaaaattagtctttgggaatagtcccaagggcaaagagtaaataaagaaacatctgctcaaggaaatctgtgaaatttggtgtgaaaggtgggagtctgtgttatctcacataagacgtctccctcactgcctgcttccagcttggtgaagtggagacgccattccaaactgctgcagccaagcacccagagctccctttcccccaagtccaagggcttgcttcccagaaggagcagactgttaacacttctctcctgccccttgctacctgttgctaaggccaagtcccaggcaactgcatttgagagtttgggagttggggggtgggagagtcccttcttcagctcatctcctgcttgtagaatggaagctctatcttggatcttggctgtggcacacagagaatactagagtcctaattgcctttccccagctcctgagatggtggttccatgtgacgaagggccttgggctgctgtcccccaactcactgagcactcagaaccttgttattgtttccacctctagctccagggtcctaactcagaggtttggcctgagttaggccataaaacagatagctcttaatctcttcccgaaggaactgactgcatttgcaacagagcatgcagaagttcaaacctaaggacactttgaagaactgtggaggttgtggtgaaatgaaactgggagagattcatggatatagcatcagaatcaaactatacgtgggctagttctcaggagggaaccggggagtaagccagttggaaggagccctcctaggatcagaagaaatatcaaacagtaacctcagcaactattccttcaaagggggcaaagttgatttgattcatttgtggagcaatttgtgccctaggacattgttgaaaacaatacagctctttatgtttcagggattaatcttctgttttgcaaatatttccccaaatttgtatttctctttcatccttatttatgatacatttctatatggaagtttaaaatgtttatttagagaaaatggatgcttatttcatggtttctatttttttatgagatacttagtaaagccttttctgcaatgagtatttatttatttttgtattatttcaaaaatatgaaatatttcaaagaggagttcagaaaatcttacgctcactacccagatttaataaactaaaatttgctatatttgcttcagattttttaaagaaataagatattagatatagttgatgaccctttcataatcctttgtatttccctttgttcacccccggaggtaaccactgttctgaatttggtgtgtatcatatctattttttttttttttgagacaggttctcacttttgttacccaggctggaatgcagtggcatgatcttggttcactgcagcccgacctcctgggttcaagcaatcctcttgccccagtcccccaggtagctgggactacaggtgagtgccaccacacctgggtaatttttatattttttgtagagacagggtttcaccatgttgcccaggctggtctcgaactcctgagctcaagtgataggcctgccttagcctattaaagtcctaggattacagccgtgagccatcactcctggcctattgtatctattcttttttttttttagacggagtctcactttgtcacccaggctggagtgcagtggcgcgacttggctcacggcaacctctgcctcccgggttcacaccattctcctgcctcagcctcctgagtagctgggactataggcgcccgccaccacgcccagctaatttttgtatttttagtagagacggggtttcactatgttggtcaggctggtctcaaactcctgacctcttgctccacccgccttggcctcccacagtgctgggattacaggcatgagccactgtgcccgcctggcagtatctgttctttatagtttgtcatatatatctgtcttcattgtatcccccctaccacatacacacacagatagtgttttagtagttttctatgttgttacatgtagctccgtgtacagcttagtttagcatcccactatttgaaaacctttgttaaggaacatttagattgatgccagttattttgctgttatacacaatgttgcaatgagtatccttgtgcatgactccttgggtacatatgcaagtatgtccctaggatatatgccttaaagtagaattgctaggttatatgcacattttcagtaccactagataatgccaaattgttttccaaagtggttgctagtggaaataaaccactatgtttcaaaaaactcatactgtgtttgatggttcctatttctccatatccttgtcaatgttttgtattagagtttctattttttgccaatttgatgggtatggtatagtatctcattcttcttttgaatttactctttcctgactactatataaattgagtagtttccccccccacacacacagacaattggaattatactatacagattgctctgagattttttggtttggattatgtaggtttttgtgtgttttcaatacagccatcttttttaattgcctcttaatatcttttccctattttttcccatagagtcttttgtttatgttttagttggcatttatatattatatatataatctgggtaattatatatttcatatgtattttcatgaattatatatagtctggatactgtcttttgtcaattatatgcatagcaaatatattcttgtgtgtagcgggtcatttcacattgcttatgttgcttttgttacagacattttaaagtatttttagaaagtcagaattatccatctttttcttgaagtttattctctgtgtgttttaagaaatctttccttgaggtatagagatatttgcctatattatcttctgagagtataaagttttgacgggtttttattttaatatttatttttatgtatgctgtgagatatagatttaattttagtttttatcatgtggccaactagttgttctggcattatgtactaaagagtctatcttttccccagtgaagtataattgttcctctactatatactgaattctcttatttgtattggtttgtattctgatccattggtctctttttctatccttgcaccaatctcatattattttaattactgtagctttatataagttttgacatcaagtagaacaaaaccttcatccttattcatgtttaaaattgccttgggtcagggatacaaggatggttcaacatatgcaaatcaataaatgtgatatgtcacattaccagaatcaagaacaaaaaccatgtaatcatttcaatggatgctgaaaaaacagtcaatgaaatttaacatccctttatgataaacaccctcaacaaactggatatagaaggaacatacctcataataataaaggccatatatgacagacccatagctaacattgtactgaacagggaaaaatggaaaacttttcctgcaagatcaggaagaagacaaagatgcctatttacatcacttttattcaacagaatactggaagttctggccagagcaattaggcaagagagaaacataaaggccatccaaattggaaaggaagaaacagtttagacaaagtgaacttttttctttttctgagacttactctgtcacccaggctggagtgctgtggtgcaatcatggtgcactgcagccttgacctgctgggctcaagcaatcttcccaccttagccttccaaacaacagatcttctacttagaaaaacctaaagactccacaaaaaaaactgttagaactgataaacgatttcagtaaaatggcagtatataaaatcaacatacaaaaaccagtagcatttattctttattattatttttagagacagggtctctgttgcccatactggagtataatggcgcagtcatagctccctatataacctcagggctgaaacaatcctcctgcctccacctcagtagctaggactgcaggtgtactctaccatgcctggctaatattttcattttttttacacagatagggtctcactatgttgcccaggatggtcttgaactccttgaggattgcttgaggccaagagtttaccttggcctcccaaagctttgagattacaggcttggccatcgtttccagccaatagcatttctatatgccaacagtgaacaatctggaaaagaagaaagcacttccatttacagcagctatgaagaatacctaggaatcaatttaacaaaagaaatgaaagatctataaaaggaaaactataaaacactgatggaaaaaattgaattggacatgatatagtgtggatatttgtcccctccaaatctcatgttgaaagataatcctcggccgggcatggtggctcacacctgtattcccagcactttgggaggccaaggtgggcatttcacctgaggccaggagtttgagaccagcctggccaacatagtgaaaccccatttccactaaaaatacaaaaattagctgggcgtggtggcgggcacctgtaatcccagctactccgaaggctgaggcaggagaatcacttgaacctgggaggcagaggttgcagtgagctgagattgtgccattgcactccagcctggatgacaagaacaaaactgtctcaaaaaaaaaaaaaaaaaaaaaaaggaaagataatcctctgcatcctactttattcatgagggaaaaacaaaaagaaagataattcccagtgttagaggtagggcctggtgggagagtaattggatcacagggggcaaatcccttgtgaatggtttagcaccacttccttggtgataagtgagttcttcctcagttagttcacatgagatctggttggttaaaagtctgggactgctcccttctcccactgtcaccatgtgagacacttgttcctgctttgccttatatcatgattataaacttcctgaggcccttaccagaatcagatgccgacaccatgctttctgtatatcttggagtaccatgagccaaaataaaacctcttttctttatgaattacccagcctcagctgagcacagtggctcacgcttattatcccagcactttgggaggctgatgcaggcagatgacttgaacctgagagttcgagaccagtgtgggcaacatggcaaaaccccatctctacaaaaaatataaaaatttgccaagtgtggtggtgcgcgcctgtggtcgcagctactcaggaggatcactggagcctggggaggttgaagcctcagtgagctgtgatcacaccaccacactccagcctgagtaacagagtgagaccctgcctcaaaataaatagatagataaataagtaaaaattacccagtctcagatgtttctttatagcagcataaagagtttaatacaggacacacaaaaatggaaagtttccgtgctcatggataggactaattaatattgttaaaatgataatactacccaaagcaatttacagattcaatgcaatccctatcaaaataccagtgcaattcttcagagaaataaaagagacgattctaaaatttacatggaactacaaaagaccccagatagccaaagcaatcctcagcagaaagaacaaagctggaagcatcacactacctcacctcaaaatatagtacaaagttggctgggcacagtggcttatgcctgtaatcccagcagtttgggaggccaaggcaggtggatcacttgaggtcaggagttcaagaccagtctgaccaacgtggtgaaaccccatctctgctaaaaatacaaaaattagccaggcatagtggcacacgcctgtagtcccagctattcgggaggctgaggtggaagaattgcttgaacctggaggtggaggttgcagtttgccaagattgcgccactgcactccagcctaggctacagagcactctgtctcaaaacaaacacctgcaaagctgtagtgaccaaatcagcatggcattggtaaaaaacaaaacaaacaaaccaacaaaacaacccagacacaaagaccaatggaacagaacccagaacccaggtgtaaatccacacatttacggccaacccatttttaacaaaggcaccaagaacatccaatgggcaaaggacagtctcttcaataaatggtgctgggaaaaccggataaccatacgcagaagaatgaaactggacctctatctctcactatatacaaaaaaatcaaatcaaaatggattacagacttaagtctaagacctgaaattatgaaactactagaataaacattggaaaccaggtgtggtggctcatacctgtaattccagcatttggggagcccaagacaggaggatcgcttgaggccaggggtttgagaccagcctgggcaacacagtgagaccccttctctataaaaaataaaactagctgggcacagtgttgcattcctgtagtctcagccactcaggaaggtgaggcaggaggattgcttgagccctggaattcaaggttatagtgagctgtgatcgtgctgctgcactccagctgtggtgacagagcaagatactgtctcaaaagaaaagattggagaaaggctccaggacattgttctgggcaaagatttttttgtgtgtaagacctcaaaagcacaggcaaccaaagcaaaaatagacaaaagagattacatcaagctaaaaatctgcacaggctgggcatggtggctcacacctgtaatcccagcactttgggaggtcgaggcaggcggatcacaaggtcaagagaccgagaccatcctggccaacatggtgaaaccccatctctactaaaaacataaaaattagctgggcgtggtggctcgcacctgtagtcccagctactcaggaggctgagacagaagaattgcttgaacccaggaggtggagattgcagtaagccgagattgcaccactgcactccagcctggcgacagagtgagactctgtctcaaaaaaaaaaaaaaaaaaaaaaaaatctgcacagcaaagaaaacaaccaacaaagtggagagacaacccacagaatggaataaaataatttgcaaactatccatctgacaaaggattaataaacagaaaatataaggggctcaaacaactcaatagcaaaaaaaaatctgattaaaaatgggcgaaagatctgaacagacatttttcaaaagaagacatacacatggccaacaggtatatgaaaagatgctcagcttcactagtcatcagataaatgcaaattaaaatcacaatgggatatcatctcactccagtttaaatggcttttatcaaagagacagggaataatggatgctggtgaggatgtggtgaaaggggtacattgttggtaggaatgcaaattagtacagccactttggaaaactgtatgaagtttcctcaaaaaactaaaattagcactaccatataatccagcaattctgctgggtgtatgtccaaaagaaaggaaatcaatatatcaaagaaatcaccacatattcatgtttattgcagcactattcacaatatctgaaatatggaatcaaccaaaatgcccatcagtggattaatggataaagaaaatgtggcacatatacacaataaaagaaatcctttaatatgcagcaacatggagggaattggaggtcattatgttaagtgaaataagccaagtacagaaagacaaatatcacatgttctcacttatatatagtagataaaaatgtggatctcataaagataaagagtagattggtggtaaccagagactaggaaaagtaggggaaagaggagatgaagagaggttggttaatagttacaaatatacagtttgatagaagcagtagcaccattgtttgctagatcagtagggtgactatagtttacaataatctgttgtataatatatttcaaaataactggaatgtaatttgaatatttctagcataaagaaaagacaaggtggggcgtggtggctcatgcctgtaatcccagcactttgggaggccaaggtgggcggatcacctgaggtcgggagtttgagaccagcctgaccaacatggagaaaccctgtctctactaaaacaaaattagccaggcgtggtggtgcatgcctgtaatcccagctacttgggaggctgaggcagaatttgttgaacctgggaggcagaggttgtggtgagccgagatcacgccattacactccagcctgggcaacaagagtgaaactctgtctcaaaaaaaaaaaaaagatgaatatttaaggtgatagatatcccaattatactgatttgatatttacaaattatatgaatgtaataaatagcacatgtatcccatgcatgcctatgttcattacagcactattcacaatagcaaagacatggaatcaacccaaatgcccatcagtgatagactggataaagaaaatgtggtacatatgcagctgtaaaaaggaacaagatcatgtcctttgcaggacatgaatggagctcgaagccattatcctcagcaaactaatgcaaaaacagaaaaccaaacaccacatattatcacttataagtgggagctgaacaatgagaacacatggacacaggaagaggaacaacatacactggaacctgttggggtggttggctggggggcaagaggtgggagagcatcaggataaatagttaatgcatgcagggcttaatacctaggtgatgggctgataggtgcagcaaaccaccatggcacatgtttacatgtaacaaacttgcatgtcctgtacgtgtgtcccggaaattaaatttattaaaaatttattacacgtatccccaaaatatgtacatctattatttattaatttaaaaattgccttggatatttttggcgctttactcttccatatggattttaggcatactctgtgaggctcaacaaaacactggatatttaagctagaatgcagtaaatgtatagattaatttatgagaattaacatatttataaaatgtgtttctgttcatgaacatgatatgtctttccagttagatggtctcacatcttttaataaaacatcataattttttccatataggtagtgaatcaatctcttttgttatgcctaattacctcatagtatttgttattgtaaagaggttaattttcaagtttttattttataattgtttgttgctggtatatgactttatagccaacaaacttgctgatgtcttattagttctaatagtttacattttttcttggatgttatttgtagataatcgtatcatttaatataaaaataattttgtttcttttcaatctttatcctccatttctctttcttattgcaatgtctagcacctttaatacagtgtttattgaaatactagtagacatccttatccttttcctgtctttaaagggaatgattctaatattttaccactaaatatgatatcttccataggttgatgaatttatttatatattatctagtagtgaatcatccttacatttctgaaataaatgtttttggtcattgtattagttatctattgctatgtaacaaattctcacaaacttagtggcttaaaacaatgcacacttattatattacactttctgtaggtcaggagtccaagtgtgactttgtcgggtcctctgcattgccgtagtccaaggtgtcagctggagctagggtctaatatggcacttgactgggaagcatttccttttaaactgatgtggttgttggcagagttcagttctttgcaggctgtcagattaaagaccttagtttgttgctggtgggaggctgccctcagttccttgccacatggctatctccataagcagctcacaacatggcagcctgcttcttcagagccagcaagggagagtgtttctcagcaaaacagatgttaccgtcttacgtagtgtaatcacatacacatagtcgtatatatcttgtcacctttgccgtattccattggttggaagcatgtcatattcccacacccaatgggaggtaattacacaaggatgcgtctggctgtggcctagacatcatatttctggaagtgacagaaaatgacataatgggatagatatttattttttccatgtaaacagcatcttcaggtcagcagctttgggttggtgtggcaactgtattgtgggtagactcttgggtcttgagttccttcgagtcacactaggatgccatccctaaggaatagcccttcctcatcatcccagatggcaagatctgcattccagggagcagggtggaaggagcgacatagaagaggaggtaaagggcacttaaaaatctcttaaggggatcccagaagctgtcaaatgatgcttctgcttataatctgttggccaaaacgtagtgccttggccatacctccctgcaaaggaggccgagaaatatagtctttatactttatttgcccagcaaaaattctgctactgtggaagaatgggagaacagattgtgggggaccactagcagcttccatctcagctagctttcagttacaaaagaaaaagtttctcttttctcttggctctggaatagtttagcataagattatttatttatatttttttaattattattttctaaattttacttttttcaatagttttttgggaacaggtggtgtttagttgcctggataagttctttagtggtgatttctgagattttggtgcacctgtcaccagaacagtgtacactatacccaatgtgtgtagtcttttatccctcaccccctcccacccttccccgagtccccaaagtccattatataattcttaggcctttgtgtccttgtagtttagcgcccaaggattatttatttttttgatgtttgaaaagataacctgaaaaattaccaattactctatttcttatgtgtagaagagcatagcataccaagagagtactggactcacctggaccaggtatgctgtggatatgagaaaggctggctgtggaaaaggagcctgctaggggcaggggctttacatatactgtctcatttaatcctcacaacaactgccagagtgaggggtaggattttggcttcacagaggagggtcctcacccaagagcatgcagttaacttatgggatggttacacttcaaacctaaagcattgatgtcaaagcccatgttctttctatagtttgaagagctagcagactctctcagaaagggccatctctctgaaggtcttgagtggggttcctagtctctttcttcatcactcacacaagcttttgacttggatatctggaggatataggtaatgatagggagggagcaggtgggatttgtggcaaggtctcctcattcagcctagcacccatagtcgtgtagtgattgccatgggactcagtacatccgttctgcaccttgctttccttccatggtctgcgtatgcattagaaggtgtacagtgggcactgactggagtgagcctcatcaggagtccagtacctacaggcttctgccctttggcagcaaacctgaaagagagctctgaccagcctttttagaaatagccctgatttaactagagtaagcatgcttctaaactctgctgctatggtccattttttggatcaagccccttctggatgggttctctgtgatatttaagtcacaaggacatagatggggaaccttctccgttgtatttcttctcttctctccttctgccaaatacttttgagtgtttgtttgttaaattctgatcagttagatgtattctctcccagcagctcttcttctgtaaccatagttcaatacttaaaagtggagaatctgtcaaggatagagggagggcaactattgaaggatggcaggaaatatcgaccctgtaccctgatgatgaccagccctgctttgcagcctgtgctgcctggatagaaggcctgctgggggagtcttggggcttttttagggagttagtgtatcccattatctcagaatgtgtgcaaaatgtggaatgaacagccctgagtaaaagaggctgtcatgtggctgtggaacagaaggatttccttgtattggacaatccataatccctttgtttcagggaaatctctaagactgacttcccatgctgcctcccagcccctactgcatttcacttgcatacacagccttgaggtctaaagctaatttatttctatcccattttctctcagcttttattctgcatttaatcagttgccttggtcccacagctacttcagccaggctgctgggaaaagattatagctggccctggtgccccagcctccatccagagcatctggccaacacgccagaaaacagaatgtctcaggccttcctactctttctgactggcaattgcaggatggtgtaggctatagagactcctgtcatgaagccttcatttttcagatcacccggaaaaaggaaaggataaagactgttttaaaaagccggctgggggtggggcatggtggctaacgcctgtaatcccaacactttaggaagctgaggcaggcggatcacctgaggctgggagtttgagacgagcctggccaacatggcaaaaccccgtctctactaaaaatacaaaaattagacagatgtgatgatgggtgcctgtaatcccagctacttgggaggctaaggcaggagaatcgcttgaacccaggaggtagaggttgcggtgagccgagatcgcgccactggacttcagcaagactctgtcacgaagaaaagaaaagccagctggggcctgtttggggctcatgcctctaatcctagcactttgtgagactgaggtgagaggatcacttgagccctggaatttgggaccagcctggacaaaatagtgagatcccatctctaacaaaaacaacaaaattatccaggcatggttggagactgaagtgggaggatcccttgaacctgggaggtcgaggctgcagtgagccatgataacgccactggactccagcctgggcagcagaatgaaaccctgtctcaaaataaataaaaagccagctggaaagcatctagaaaatagaatgaaagtcatctgcccaattcccagcagtcctccccaggttaccttctacggttatctggtcatttagattctcatggcaaggagttgagactaaaggctgccctggttagagttgctgtttggcattagactgggatctctgtgggcatcctaggacaaccttccctcatagtggtcacactggtgcctttgctctgagcaagtgtctttccacagtcctcattgtctagatggaaaactcttgggtaagtgtacgctcacattgggttggatacaaagattcaaagagaagcaaaggccaaagcaaaaaaatgggaccaggagtaaacttgctgggcggtccaggaagagagggcaggaagacgcaagccctggtgcctacctgtgacccttaacgtgaaattcctgtcgcacgcatgcctttcccaaagagccatggacagtgatcagtggctgaatggaggagcctctgttcccactcagtacctctgctgcagtgatttgttcaagaccacagagccagctggcagtcagaatgagaagatgagtcagaaactctgagttttcaggataagacatggccttcagatggcatttcccgtgcagttagagaagtcctaggatcagaagtgatgtgttcctgcaaagttcatgtaaagccaccctctccacccctgtaactcactatgaactgtgacttaaatgagctgcagtttccccttttgcaaaggagagaaactgttgggggcttatcaagctagatgatgccttagagggcaaaaggtgtcctacataaaggagtgcggcccttgtttccagccttcttcccctccctccttccgtatctctctcctttccttcctgtcttccttcctctctttcttccctccctcctgtgctgctgccatctgccctcagatatgtgtagtgaccactgggggccccatttttctcttgccatggctaatcttgatggtgttcgtgaagtctgtacacagaggttcattcaaaccatatgactaagataatttctgtaatttttggtagagatggggtttcactgtgttggccaggctggtctagaactcctggcctcaagtgatctgcccgccttggcctcccaaagtgctgggattacaggtgtgagccaccatgcctggctgggatatataagattcttgttttccctgtggaacatggtctgacttctctgtagtattttggtaagtgtccagattactgtctatgagatgacttacttaaacttcatgttttcaactctgatttggtaatacagtcacatggctcaaaattcaaacggcaccagaggatatgaaaagtatcctccactgtgtccttccaccgtgtccctttgctaccctgcttccctgcctcaaggcaaccagtgttgtcagtttcttctagagatatttttccatgttaaagtaaatatttccatatattgtttttacatgaaaggcagtttactgtagattcatcattctgtaatttactttttctgtttaactatataagtattttgtttgcttatttggtagagatacggtctcgctctcacccaagctagagtgcaggggtgcaatcatagcttagtgcagcttcaacctcctgggctcaagcgatcctcctgcctcagcctcccaagtagctgggaccacaggtacgtaccaccatgcctggccaatttaaaaattttttgtagagatggggtttcactgggttggtcaggctggtagcactgtatcttgaatatcattctttatcagtccataaagagcttcttaggagatagtttctttgctttcaatagttgtagaatgactcaggtggaaacttttgggaaaatgcttacattgacctacgtttaaaaatgacagtgcttcaattaattagacttattagtaggcaaaatttattgtttaaacgaaggaggtatttgattgttgtgtctaagaagtgattactgatggttttttagagccaatatgactcacaaaacatctttgatgttaagtttggaatgcctatgtcattagttctgattgggaatctgtgtaattcaaaattttagtttaaaatctgttaaggcaataaagaagccacatgctgtgtctccttggctgcagcatgttccctccattgtgctgggactgttctgtaagaaccaggtgtacgggtctgtgctaggcgtacaatggccaccaggagctttggactctggagaggcccaaatgctttgtctttacaattgtaaaaagtaaaaagtaaaaaacttggccaggcgcagtgtctcacatctataatcccaacactttgggaggctgaggtgggcagatcacctgaggtcaggagtttgagaccaggctggccaacatggtgaaaccctgtctctactaaaaatacaaaattagctgggcatggtggcgcatgcctgtaatcccagctacttgggaggcagaggcagaattgcttgaacccgggagatggatgttgcattgagccgagatcacgccattgcactctagcctgggtgacaagagcaaaactcttgtctcaaaaaataaaaagctcaactattttcattttctctgttgaaacctgctgacaagttaggcttgcttctagatccaggtggccagctggttgggccgtggccctttccatggtcatgctcctggtaaagagattatcctcagggtaggggatgagatgggtgtagtaagagggctccatttagagtgtttgccagggcagtcactttaatgcttctatgagagccaggctatgcaggaatacaaaagccatatatcatgccctttagaggagtgtgagggtttagactcctcagggccagctgaaaacttctagaggtcctacacattgaaaagaatatggtgccctatcttccctgacctccctgccttcatgaataggtaatgcaaaataaaaataattctaaattttaggttaagtcctctggtcccagaatggatgactagttagattttttttttaataatgcaatcccagcactgtgggaggccgagtgggtagatcaattgaggccaggagtttgagaccagcctggccaacatggtgaaaccccatctgtaccaaaaaagatacaaaaagcaaccaagagtggtggtgtgtgcctgtagtcccagctacttgggaggctgaggtgggaggatcacttaaggagattacagtgagctgtgatcatgccactgcactccagcctgggtgacagagccaggccctgtctcaaaataaataaaataaaataaaataaaataaaataaaataaaataaaataaaataatctatcataaataaaacaaaatagtgcatcaaatatcaaattgacccaattttttttcccctcccatgttttaggtacctatgttgtgcccaaggacaaattgagtctttctgttgtctgatccaatctcaggagtttctgattctcctgagaagctgcccttttccaaggatttgggggcaggaattattttacaatgtcaagaagtttgaagttaaaattgtttttgtttatatttacaaatatctttatctgaacagaactttaaagtagctctgaaatttttcttcaagaaatgtattttctttttgagtgttccatgatgaaatcagtcttaatttcagttcaactagtgtgtaaaaacacacagtgagtgattattagtccccgaaggaggcaagacagatggagcctagaatggaattggctttatgattaattgaatccttgaagagttgaatagagttagagctgattctgcccaatcagtgccttgagagggctggtgttgtcctgcgcctgggagaggaaagggtcacaataacccagatttatcctctattaaaatggattggatgtatgcaccagacggttcccatttttaaaccattgatgcaggataattggaatggaaacaaacaagattagaactagattacaggtatttgtgcaagttgcgtcctaaatcaatcagagtccgtgatttgttcagagggtgcattatcattagagtgaatcattgaaactcagagacacatctggagctgtccagccaggaggggaagcaggggaagggcagcagagagctgcttggagttgggaactaggtacaactccagagtgcttttctgtctttctgggcagaaatcttccagagagaattttaatttaattttgctcttttttctttccagcagggatgcataatgtataggtttgaaataactgcctctttgctatagtgaatggacgcttttttaatgtttggatcaaacagacacctggggtagctgctgcctgtggggaccctgcaatccagagggagggaagggagagggcctggcgctgtaggtggactagccatgttaatcacaaagtccattaggatgatgggtgccctgctgccttgccagggagcctgttagtacagaacatcatctgtggagctggagattgcagggtttgccttcatcagcgggctctacttcactggccagtcgctgagggaggaagtccacgttcccgcccacagctctgccaccacttatctctagccatggccatggggtgggaggtgatgcaaatatgtacaggggcccctgactcagtgtgactctgacctagtcctgaactcaggagtctggacacatgggatacagtcttgggtcgacagtcagagaactgacttttaagccatcattttacttctgtgagactttaagtctctgtgaaaacaagagcactagatatgaggttctttctggcttgagaagtgtgccctgagttccttccttcctgaattgtatacccatgccaagtccctggcagcgtgctgggttaggcccatagaagcttcacgtgataggcaagtctcacccttacctttgaactacactggtttgtttctcttcatttttccattttgagctgccgtgagtcaggctgcaggcagctcatttacacaggagtcagcctgaaggaaggtggcttgaagtctactttcattttgtcatgggaggtgttttcctgtggaatcgctaatcaggcaggtcaaagggaaccataagggatctcactcatccctagatggaaacaagtacagcaaagccatctcagaaggagaccaaaaacacacaaaaacaactcccctgacagcatttcttaactctggcactctcaaaattgaacatacttaaaatatccccaagggatggaggtgaggtttcttggtcccacatcagagctggtgaaccagggcccatgccacacccttaggatgctatagagataagagctgagccctgcttctcttctccccatgtgcccactgccatgtcctgccattacctcggcccctctagctgctctggctgtagcttccactgctgccgttgtgccaggcacaaatgagtttaatttgcctattttgctggtgtcccctttgtgaagaatagcgcctgagaagcatctcatcccctgtgtctgatacagcctttgttcttatcagaggcatcgccctgctttccagcttagactcagctggaccctttgcccacaccctagcttgggccctcaagagcaagaagtggtcagattttccttcctgcttttgtctgggtataaggggatggtaggggttggtaatcccacttgggaggctatgcctgattctctagagctcacaggcctcaagaatgcataagaggctgggtgcagtggctcatgcctgtaatcctagcactttgggaggctaaggtgggtggatcacctgaggtcaggagtttgagaccagcctggccaacagggcaaaacccaatctctactaaaaatacaaaaattagccaggcatggtggcacatgcctgtagtcccagctgtttgggaggctgaggcaggagaatcgcttgaacctaggaggcacaggttgcagtgagccaagatcaccccactgcactccagcctgggtgacagagtctccagagtgagactctgtctcaaaaaaaaaaaaacaaaagcaaacaaaaaaaaaaacaccgtaagagagggagggttggtgggatagtatcagtcctgcctgagactaagtaatccttggcatccaggttctaaggagttcattcctcttttgtacttgagcctggatattatctctcatctgccttgagtgctgtttctcctgaagtcctgcaagcacagctgctctattcagtgacaagaggacagaccagacacttgagcctgctggttatataaggtgcaggagatcttattcagtgccttcctcagcctttgatttttcagatcttgattggaacctatcctctgcaccaggattagctacctttgctaatcccccgacatagcccagtgtgacaggaagctttgattttagccttcaggatgacacacactacttgtggcctcctgtcccacctatctgcctgatgcccagagctgtgggcagggtatgtatcatggagatggctggatgagctgtttccagcagaggaagctcttgtctagtggtggttagggtccatctctgggaggagggatgctcacttggcatgtgtctcacagagactgtgtctgtctgcttgggcatcactgtcattcatgttcatagtttctgccagacgtcactcttgggagtagagttctgtgttggggaggggtggagcgtgggagtccgggcagggtagagtgggtggttggacgggaatctccttggacacacatctgtgtgtcgcatgggtaagattggacctgtcctttctctgcctccctttgtgtggcactccagcctctggactactaggtgggtgtgattgatttcttttttcttttttttttttcgagacaaaatctcgctctgtcgcccaggctggagtgcagtggcgcgatctcggctcactgcaagctcctccgcccgggttcacgccattctcctgcctcagcctcccgagtacctgggactacaggcatctgccaccacgcctggctaattttttgtacttatagtagagaaaggctttcaccatgttagccaggatggtctcaatctcctgacctcgtgatccgccctcctcggcctcccaaagtgctgggatgacaggtgtgagccaccgcgcccggccttttttttttttttttttttttttttttgagacagtgtctcactctgtcacccagaatggagtgcagtggcatgatcttggctcactgcaccctctgccttctgggttcaagtgattctcgtgcctcagcccccctgagttgctgggactaataggtgcaagccgccatgcctggctaatttttgtatttttagcagagatggtgtttcaccatgttgcccaggctggcctcgaactcctaaccttaggtgatctgcctgcctcagcctcccaaagtgctgggattacaggcatgagccaccacgcccaactggtaggtgtgattcttgatggcacacaggaagaggaagactaagccaaggagtggtcatgtctaagggcttcccgccaagaggatgctttttggaatagtgcttgatgccaccctccacccatgggtgttttgttaaaaggttaactttgctaaacatctgaaaagaactatgctagggaagttctgtcctagggagatgccatccagggatgcagagggccgcagagaccaggagcaccggcatcccactgacttgtacagtgaccttggccaaaccccttggcctctcctgccctttacttgaagtggggaatattctcctgctcctgctggagccatggagagatagatgaaattgtctctataaaatgctctgattgttttggaagaaaaatgttgtatcactgccagttgttgttgttattaacagtgacacttaaaaatcgatagggcatcgctctgaggagctgcaaatactgcctgtggctgtttgttttccaatttattctcaccttttcctaatggagggaggggcagatgctgcccaccctgcacaccttgctggtggttgggaggatttatcttgaggtgatgagaacaaatggggccggtgaactggacaaatgcatttgccagctgggtttgttgcccatggcaaacatgctcagggaagccagctcatttgacaaaagtttactgaatttcaactctgttacactcttagaggataggaagatgcatttggcatggttactgtcctcaaaatgtttagagtctagaccaagacatgaagaatatttagaaaaaagtacctacaacatgtcaggcaccgagctgagagtcactgcatgctctcattgaatctggccaagtaagtactgttatggagtaaagacaattactatttccattttatgcatggagaaactgaggcttggggaggttaagtacttgcctagtgtcgcccagctagactgtgtcagagccaagacatgaacccaggcagcgtgacttcaaagccagacttctaaccacagtgtggtgccaagtggtgataaatgctgagagagagaaaaaaaaaagagagagagattgagagcacgcgagagcaggcgtgagcgtgggagagcaagtgcttttcctacaggactgacttgggtgagatttgcgcatctgggacagaacagaaactccagtccctgcccatcactggcccacatacaatttgggttcctgttgttttctctgtccatgaatcatactgagcttcactccttgcctttattttcatgtgccatcagtcagatctaatcccaggggggaatatcctggtgcatgtgtatcaggagtgggcagtggataagaaacttgatttcagtgccccactagtcccatgaaatgactctcatgaaatactcccatatgatctggactctggggaggataatttggggactctcccctccttttttgttacattggttctgatgcctccatagttggattctccagtggagtcctgcattcacttgctccctcttgccaagggatcttttggagactgttgagaacctgagtcacctctgaggcatgagtgccattatcagcttgtggtccgagacccagaatgcttctcacaagaaatctccttcttactggagacaggcacccagggtaaacttttttttttttttttttttggagacagagtctcactctgttgcccaggctagagggcagtgacgtgatcttggcttgctgcaacctccgccacctgggttcaagcgattctcctgcctcagcctctcagcctctcaagtagctgggattacaagtatgcgccaccagagccagcaaatttttgtatcttttatagaaatggggtttctccatgttggccaggctagtctcaaacccctgacctcaagtgatccgcctgcctcggcctccctaagtgctgggattacaggcgagagccaccatacctggcccagggtgaacctctcataagaacatgaggctgccatggcagcattagacctgccacactgggaggagagtttgcctgttgttaccaagcacaggagagggactctgccactggggagggggtcaagcacagtatttttagcaagcaatcctttactgtttattcagccactttaaaaatagataccaccctttctttctaattggcaccatttttcatcctctgtccttgcttttcatacactgagctgttcatgaatatttatttacattcccagaggcaactccatatatgtgtgtgtgcatgcatgtgcctctaaaactcactgtgccctccttcctttccctcatgaaaagtgacacagtggaagtctgggatggaagggcaagggcccttgcctttgaatacctttcttgatgctgcaactgatgagtttccagacctctcttttggacccctgcttgtctcttaggttacctccttccctgccatgggactcatagactggttgtccaaactgtccaccttttttagcacttagccaactttaagcacccataccacacctccaacctctttgcctgactaaaatgcctcctctcggcagtcaagtctaggatccctgaggtgctttgatgaagcaccctggcatggacattcagctcttcagacttcttatttcattgttcttggcaaaggctagaagaggcaagttcataggcaaaatgtggaaacaaccctaatatctgtcaactttatcttttgacttcatctctttttcctcagtataaccgcttcctgtcagccatgctgacacacaggcccctagcggtttttgtaaagcaagagcctagagccccctttgggggtgttgctgtgtgctgaggattctggaaagaacctcacccctgtgactaggcccttttgcctgagttgtccccattcctgagccattgttctgtcttttgctcacccgggtggctgaaaagacaggatgactacctgagcatttcagtcagggagtttgttattgatgatgccgttcacttctcaggagtgttgcatctaacactgcccccatgctcttgtggaagaccgcattctctcactctttacagctcctctagacagaaatgattccagatatcactgtgttcacccctgcctcctggcaaggagccctctctcatagcccatcccaacactcatctcctctggccctaaaaattcatacattcattaaaaaatatgaattagccgggtatggtgacttgtgctggtagtcccagctacttaggaggctgaggtgggaggatcacttgagcctgggaggcagaggctgcagtaagtcgagatcacgccactgcactccagcctgtgtgacagagtgagaccctgtctcgaaaaaaaattatttaaaaaagtcatgactacctattatgtgccaggcattttgctagactgaggatgtggtggtgaacaagacagataggtgtttctttttacatgtcagaagttgattttttagtcagtcagtatgtcatcaaaattaaatactcttggctgggtgctgtggctcacgcctgtaatcccagcactttgggaggccaaggcgggcagatcatgaggtcaggagatcgagaccagcctggccaacatggtgaaaccccgtctctactaaaaatacagaaattagctgggcgtggtggtgcactcctgttatcccagctacttgagaggctgaggcaggagaatcgcttgaacccgggaggcagaggtttcagtgagccgagatcatgcactgcactccagcctggcgacagagcgagactccttctcaaaaaaaaaataaaataaaattaaattaaattaaatactcttgtgcttcaaaggataccatcaagaaagtgaaaaggaaaaccaccgaatgggagaaaatttttacaagtcatatatctggtaagggactttttatctagaatacctaaagaatgtttgcaactcagcaacagaaaacaacgtaattaaaaactcctacaattcaacaataaaaagacaacccaattaaaaaataggcaaaggatctgaatggacagctgtccagacaagataatgcaaatgtgcagtaagtacaggaaatgatgctcaacatcattaactcccaggaaaatgcaaacccaaccacaatgagagaacactgtatactcaaaaagatagataataacaagtgttgacaaggatgtggagaaattgggaccctcatatactgctagtggaaatgtaaattgatccaaccattttgaaaaacactactagttcttcaaatagttaaacatagagttatcatgtgatccagcaattccaatgctaggtgtgtacccaagagaagtgaaaccatattccacacaaaaacttgtacatgaatgtgcatagcctcaatattcataacagccaaaaagtggaaacaacccaagtatctgttgactgagaaatgggtaaatataatgtagtatatccatacaatggaatatttagcaataaaaagaaatgaagtactgatacatgttatgaatggatgaaacttttaaaaagtcagagtgaaaaaagctagtcacaaagcaccacatactggatgattccatctctgtggaatgtctggaatattcaaatctgtagggcctagtgctgagggagtgggggttggggagagttgcggggggcactagtaataggtatgggggggcaatgaaaatgccttaaaattgtgatatgttgcacaactctgtgaatacacaaaaagctattgagttgtacactttaaatgggtgaattgtgtggtatgtgaattttacctcaataaagcatttttaagtcagtaacgtgttatgaagaaaataaaataggatgatataaggttctttagatgagttagttacagagacttttccaaagagatgtcattctggcctcaactcaaatatagattgagtcagccatatgtacattaggccaagggttttccaggcagcaggaatagccgttgcaagggtcctgaggtagggacaagcttggccagttgaggaagcagccagaaggtgagtgtggctggaatggagtgagctaaagaaagactaagaagaggtgaggttggcgaagttggcagtgcacctagagacctaggtgaactaaatttggattttattctaagggtagcaggaagccactggtgccatttaattaagggagtaacaagatctgatttacattttaaaaatgatcccctggcttggctcagtggctcacacctgtaatcccagcactttgggaggccgagggaggtagattgcttgagtccaagagtttgaggctgcagtgagctatgattgcaccactgtgctccagcctgggtgacagagcaagacctagtgtcaaaaagaaaaaaaggaggaaaaaaaaaagattcctctgattgctttgcgggagagaaggaactcttcatggtttcagactacagcactgcctaccttgttatcttaaatctctgatagtaggaagctcttcctggtatctagttcaagtcacctcctctcatcaggattttgggtggtagatctgatggccatgatagtgcttcataactgggaagattattgttccccagattaggatatagagtcagaaagcttcatgtctctccatgtttgtggctactctcatcataagattgtggctgtccagactcaggaccgtgatgtctgcctgattttcaattgctggggctgtctttggccatggcacctggtcctgagacgagtagagcaatcctgccacttccaccagctagcagcatacctacttccttcctctgagttggaggacaatctggagggtcaagcaacacagggtgctgtgtgaatgggctttctagtggatccaggtagctcttgagaagctgtgtgagaagctcaggatgtgtgagaagctctcagagagtcagctcaggatggaggtgcacttctctgggaaacgtgatggatggcacataatgattagagctttgcttgccctacaaattttttttttaatttcatatatattgtttcctctatttaagtaatacattctcagtgtaagcttttcaaacgttaaagtaatacgtaatatagaaagttgaaattataccaaaaggacatagatcagttatagagacgaactcctaatggtggtttatttactcatttagcaaatatttattgagtccctactatgtgcttcctctgaggattgcaatgaagaataagggaggtaatggcctgcgtggtggctcaagtctgttaatcctagcactttgggaggctgaggcgggtggatctcctgagctcaggggtttgagaccagcctggccaacatggcaaaaccccgtctctactaaaaatacaaaaaattagccaggtatggtggcgcgtgcctgtaatcccagctacttgggaggctgaagcaggagaatcacttgaacccaggaggcagaggttgcagtaagctgagatcgtgccactgcattccagtctgggtgacagagtgagactccgcctcaaaaaaaaaaaaaaaaaaaagagaggtaatataagaatactgagcatgcaccgggcacatagtaagcattcagtaatggtagcttctaatattgttgttattgtcatcctgactggaggcagaggtatgggcatcgtgaatattttctgcaagcttttccttgactggagggctggaatatctgggccgtgaaggtcattgttttttctcatatagtgttctaagaccttaggggcttagtcagggcctttggtggcctctggccctgacaccaggtttggttcttctatggatacgtcacacttctggaaacaatgctgtgaagcagctcttttccctcttgtccagtttattagctatgtgttgttgtataacaaattattctcagatgtagtgggttaaaacaacagtaatagtttattatttttctgtttctttgggtcaggaatttggaaatgtaggcagggtgttgactgggtatgagaatctgcttccagtttacacgcctggctggttggtgccagttgttggtgagaggcctcggtttctctctctgtgagtttctccacagggctgtgcaggtctccccatggcttcccccagagtgaacaacataggacagcaagatggaaacttcagttctttttgtggcctagccttagaattcgacatcatcacttcctctttattcttttggtcacatagatcatctatagttaatgtgggaggcaccaacacaaaggctgggatcgctggtggggatcgccggtgaccgtgctggagactggcaccacacctagtatctggggactctgtcctaggcactgtggaaggagaccccacacatgcagggacagtcagtcacctcatggacccttgtctgaggcaggtgttccttgcagctcactgagcctatgcccttcccccatgctctggcctcacggtgctgagctgcccagctcagtagctgcctcttggctgaagtggtggcgtgtcagggggaggacagtggtttcatttttgagtctttgatcatgagagaaggctgagctcttctggaagtctgccagtggcttgtgcttccagacactggatttctcgaaatggattgaccagctgaccagccccttcctataggcttcttgccaaccttcagaggagggagccatttttcttaccttgaaatccagtaatttcaagatgagagtagacagtattatactaaaaatggggtgtttttatcctttacagttttatgtcttgtgtaaggaagactcttaaaagtgggagaggtaagaggtgtgtggcaaaagaacttcttgagtaagatcctggtctatggatggacatacagcttgttgctgtatatctctgggcaagttacttaacctaagcctcagcttcctcagctcagagatgaagaagacagtggtgcttcacagactcatgtgaggattaaatgagataatgtaggatgatacacatgaagctcatagcacagaacacagcacattgtaaggaaatacagcaagagctgtcactaaaatattgttaatgttaatatcatcatcatcattgtgctcaccgactctgagtgagaccgagagaggagcattgacttcccaagcaacataaaggaaacccaggcccggaaacaggggctccttccctctccagctttcatactttccataccgaatgttcttccacgtgatgcctgaactacaaatagaagtttgggcaactcccaattatccctagtgtgaataattcactctgagataatctgtgtgcctggctggcttcccaaatcagctgagtggattattctcctctttcaattattcaacagtacaagtaattgggagctggcattagaatgtaaaggccgtgaggtcatctcctgttgttctcagttgcacagtcctgccagtggtgatgtttcagagcagtgcggaggctgtagagcaggcccaaagggggaggacagaggtggtgacaggcatgacagtgaagaatgaaggccctcagatggcaagttgggggaggtgaagctaacagccacaggcaggagagcccaagaggaacggtttataaaggctgccttccctctccctggcctgtagagagagaccccgttgcagccgagttcacgctttcctgaggagctctttggatttagcttttggttctggaatgttagtgtatcctggagtcttttaaaatatgaccagccacccctgttctcttctgtttgctgctcaatttgatatcaaggggtgcacggagagacctgaggagcctcttctttctggagagtagggtctctacattgaaaatagcatgtgtagaagcgtgatccattcatataaaaagtaaatgggtaaagatttatatataaatttatattgcacatatatttttaaatatgtgatataaaaatctgggccgggcgtgatggctcatgcctgtagtcctagaactttgggaggctgaggcaggaggatcacttgagcctggagtttgagaccagcctgggcaacatagtgggacttagtctctacaatcacaacaacaaattagtcaaggctggacacggtggctcacacttgtagtcccagcattctgggaggcgggaagatcacttgagcccagaagtttgagggtaacatagtgagacctcagctctatattaaaaaaaaatttagtcaggtgcagtggcatatgtctagtcccagctacataggaagctgcaacaggaggatcagttgagcctgggagctcagggatgtagtgagctgtgatcacaccactgtactccagcttgggtgacagggcgagaccctgtctcaaaagaaaaaagaaaaaactctgctcttacctctgatggtctgagaaacagggacttttcctttctattttgcactcttctatactgcttgattttttttttctttaccatgaacttacatgatttataattatttaaattacttattataaaataagacacagaagttgctgttgggttttctggcatgagccctttggattctgtgttttagcattcatgatcattctctgggccactttattcttacacaaccttttttttttttttttttttttaaatacttcaagttctagggtacctgtgcacaacgcgcaggtttgttacatatgttacacaacctttaattgtataaggataacctttaattggcttgggcttgggggtggactcatcagtttgcccagatcccttcagccaggtggcaggcaggtgtcgctcctgctgtactgtaggaatactgtggccagcctcagctccatgctgggactgaacaagggcttctctacccccatcactggggcctcagccctgggttgtcctcccttctgctcttattgcccctctgtcccccttgcctgaggacccaggacccgtttgtcctggacttggtggacccagggttttaccctcatgttacccacatagtcctctctttgcctctggggagaaggattaaactcttggttcatgtactattttgaggtatttgtccaagtttaatagttgtgaaggaagaaaaaggttagttgctgtttgaactgtttctctgggattaacaaaaattagtttgtggctcaagaaaaattgtgtgagctcagtttgtggggtggggtcatagtttctgaggttctctccaggtttggctggtgcttggttccagcctgtgctgaagaagggcagggaacaagtgggaaggaggagctttcttgtctctggggctcttaacagctgtagtaaattgtggcatgtgtggagcagcagcagagccagcctgaggagctctgagccagagggttcacccatgggaaagctgctttttagcccagcttgaggttcttacatctggacccagcatggctgcgttgaaccagaccttcaaatgtggctgtgagtaccaggcatggctagagcatttaagtactccacatgggagctgagctttgtctttctgcatttctagggacaggctcagtggacaagtaatggtggcagaaagaacttggtgaccagatgttggctagcaccactgctttcggcgggccccaggttgttggtgaagtcaacggaatcacttaagaatgtgcagagctcaggaactgaagcctcatgattctcctgctggatctggcttccaaaggtccccataacccttatccccagctggccttggaacaacgaggcctcctatgtctcagctctccccagggaccctacagagctcattctgggcttttggagggtgtcatctgtgtggcctgaaggagacctgagttttggacacgcttgagaagggaagctgctttgatatttagccagagagatgactgagcctgttggttggagcccagtgaggatgttagaagagtgtgccgtgggccctggaggtgaggaaaggccaaggacctctcttccttcaagccaggttgtggggagagccccactgtgagccctttgtgctaggcattgagcaaagtggcagcttttgtggtgctggggatgtgggaagttttctacttttgcagctattatgctgagtttccctccctctccaggatgtaggggtatattggaatagagagctatcctgtgaaaccattggtgtgaatggggagcaactctgggctgagcctcatccccgctcttgacccccgtcaaaggtgctgaggtttccaggttcaggggagttaatctttatggtctgtgctctgagaagaagattcaagttagttggtgagaaaaccctgcaaagagttggctgctgggggaactcctcactatgcttttagtgctgtgtagatttcctaagtggagctgtttgaagtagaaaaagtcctgtgcatggtctcaggggcaggtctacaaggatgggctgcttttagaagtacaagcagcagggcctttggagcatttcaagccggtaggtcacatgggatctctgcaaacaaatctccaaccagactgttaatagacttggccacctcccattccagccccagatagtcaattatcatctagtatcttggcctggggtggtataaaacaatgtggtgggctatgaaggctcttgatttatgttgtttttggtctctcaacacattctgttctcctctttggaaaataatacttcctttcctttgggaatctcttcaccagtgccacatggtgtggtgaggctgttaatctttatgccccacctgttcccttcccagttagggctggtcatgtgatctagacttgccactcacagtatcacttccatctggacagtaattggtccaggggtgtgtgtgtcacacaagcaggaccaatcaaagttcttctctggaattctttttttttttttgagttttgctctttgttgcccaggctggagtgcagtggcgcaatcttggctcaccacaattttggcccactgcaacctccccctcccaggttcaagctattctcctgcctcagcctccctagtagctgggactacaggtgcgcatcgccacacccagctaatttttgtatttttatagagacggtttccccatgttggccaggatcttccctggaattctataccacttgggaggatgtagttacctttatgctgggattggctgtttacagggagaaaactggagagaagcaaagcctagaggtgcaggctgagagagggccttggcacattacttaagcctctggacccagctgtgctttttacctttgtcatgcctcttcataatgggacccagtacactctcttttccatagatgaggaaggaattcaaaggaattcaaattcctctgaatttcattttggtcccttaaaaacagagtcctaactaatacaaaacaacttccaactgatctgtttgcttccaaatagctaatgtcatgtccagggaagctgcttccctggtgaaatcctgtacctaacactttgctttgcacacattgggtgcttgccttgtgtttcttatgtggtaactgtaccctcaccatctgccaccatcctttgggaggagagtggagacctgaacctgggtctcccagcctgcctttgttggtggcagtgaatcctgtcatctgtgcatacattttcatctcccttcctctctgcctctgcttctgcaaagataaatacaatctgccagtcttgctttgcaggggcctttccaaacatgccagtggtggggcatttatcggaatacctcaggctgctgtcttccagatgcagacaagaggccatactcccagggcacagtactgttgcagccatgggtgtgattatccccctctgagatcaagctgtccccttgtgcccagtgtgagctggtgctaaatttattgtgcctaaaacatcagggcagtgttagaggttccttgcccactgcttccttcccaggctgctcgtgccagctgcaaggcccttgtgaggctgttagatgtctctctgtggcagattcattgttccatatttttatttaattacttacttttacagctcttagaataaatctaattatccatctgttatgctacattatgccactgcggttcatgcaattctttctgatcgtatatggtatttgtcaacttgaccttgccctcttccaatgttgttgctcccctgtgtggctctgtgccatctcctcaatggatccttggcaccagccaatctatcagggacctcgggcagagctgactgtgagtggctctcagatggaacaggggttggtggagcgtggagtattattgcaggaggagagtggccaaacagccatctctgataccatgctgacctgacagaggcatggaaagttgggctggtactgtgttagagtcccagaaaggaaagcaggagctctagcctacagtttccagtcttcagccagagaggactgttgtcaaggaggacagccagctgaggtcaggctgaaaggaggtgacagtggccacctggggacatatctgtggactgtcctgccatggctggcaggcggtgcctaatcctaagattgagtcagggctgatcttagacacagcagaggtgggcattacctactagaggtgatttcaggaatcaagtgaaactccctgcttcccaaatctttttttctttctgctactgcctaaaattcaattaataccattagaaatttgtttcttggttttatatatataaacttctctttgtgagcaaatacagacattcctaggaggaggacctcagggggttattgaccatctgggctgcatcccttttctcaagcaggcaggggatatgcagtgaggaggacccatggtcaagagaatcaaagtgcagggagatggggagagaagtcagaactcagggcagtcgcggagtctgattccgtgagctcttggaatgggcaaggtgctcagaaagggagggaggtcatgtgcccaacccatccacgtgcctagtgctggggctcagtgtctcagctgggaggggacacagagccagccttgtgtctgcaggcagctcctgttaattgcatgctgggcattgggctctaccatctagagtgaggtcacagttgaacagacaacaaggcacagtccaggtccttgagagagttcatggtttaggaggggaagctgatcttgtcaggtctgttaagaggatggaaagaaggagggccccaggaatgcatagcaggggccctgtgagggtcaggaggtcagcgagtgtttctctgaggagatcgtgtctgaagggttcttgcagtaggaactggccagatgaagatggggacgggcaggggcagggcgctcaggcagaggcggtggggaacacagcacactgagattcctctgtcgatggagatgagttgagaaattcatcggggcaagagaggtcctccctcctcatcactttggtcctgaaacagggtcattttcagcagacctcttgaatggaaacgctgagcctgctgctgtcactgcttctgaagcatattccccaggggccaggggaggacctgtgtggcacaggctttctgtggtggaggcactgtggtcagaagctgtgctctaccgcctcatccccccaaggtacctgcaacccagggcagggcctgctatgctgactcttcctcctcattcacctgccccacctccagcccaagcacacattaaaggacttccgacttggatgtgggcccagtttggagctcgttatagcccagtggccaggcccttcattttcccttccaggttaagacttggaaggcatcaaaggttgcaggaacaccccacaggccttctcccttagtcgtcttgctcttgccctgtctgcgtggcctccttagctgagcttttcccaccagagcctctggtgactttccacaagtttctcctcattccagcaagcagattcatgactaattgctggtaattttttcctcaagactctatttatataggctgtcgtgttgggggcgggggaaagcaggctctagtcctgggggggctgctgttccctgcaactgccatcattagactgaggcccatgtggcattgatatccacactttgtctttattcttgtattttttgtcgttgtgacatttggttctttgaacatctaacgtcccttttatgcttctcatctcccacagaagattgttgtattttgacccccactgaagctgcgttttctttttgtcagatttctcactttcttctttattgtattttgatcagtgcagccatgtaggtctgggttttattgggagcttttcatctttggggcagtggccctcacggcctgggtcttctggccaatgctgggtcctgcctcaggcccaccagggtgagagaggcccaggttgttatctgtccagggatactctagcctagcggttctgaaaattaagcatgcctcagaagcacctggaagccttgttaaaatgcagatggccaggcccctcccctaatggttctgatttcgtgagtctggggtgacgcttgagaatttgcatttctaactagctcccagatactgctggtgctgctggcccagagatcagacttggaaaaccactgctttagagtaattcctcctttaccttgagccagagtgtgcagggcccaagggaggaaagaacagcagggtaccaggattctcctcctccatactgggtccagctctcagaaacacaacgatggaggatgttgccagggcatcataatagtaaacacctgtacagtgatttcacctgccctatctcactcgatactcacagcaggtccattggtgaagtagcacagcttcttgacaaataatagaagtcaaattgagataagttaaggcctccttcctggccattaggctagtaatttgcggcgtgtccccagtggaatccagttttcttagctcctattctagagctttcatgactctgctacttattagctatgtgaccttgggaaaattacttagctttctatgactcagtttgttgatgagcaaaatgggagtaatggtgtctgcctcattgagttgtcatgaggatggcatgatttaatgcttgaaaagcacttgagagctattaaatggtggcctccagaatcccctcctctcatggcgatgaggggctgcgggttttttgttttgtttgtttttggcatttctgtcacaagaggcacaggaagatgtactagtgcccaccagacagcattacccggccatcaggacagggctcagtcactttggaaagtcaccacccccctacacccgcccgccgagggaaatggcctgaggaagcctggtgggtggtgtctgcctccaggagttgaggatggagcagtagctgaggggctgggtcagtgtgtgaagcctaagaccaggaggaaggggcaccaggagagcaaggcggccgggtggtccactcctcaggagctactgtgatcctggtcctttcactgcccagccctgggtggtggcccttggaggattagtttggagggaagctaaactaagtctgccattttagtggttttctcttcctgccttgcccccaccttctgacttgggacatttccagcagtaacgggggtttgagtggaaggctggtcttgattatgctagcaatattgaacttgttgaaaattacatgccaggtactgttacatttggtatctcatttaatcctcggtagcctcatgaagtaaccctcatttgacagatgaggaagctgggtcctcatctgtataagtagggtgaccacataatttattgtccaaaatgggatacttttaagagtgaaaggggcacagttaattactgcactgggacaagaggcataaacagaacatatggtcactctctgtataaggctttgtgttaagttctatggaagatataaaggtcaataaagcactctcatggtcccggaacctggaccttgagctgagaggcaggttaattgacctgtcttaaggttgtacagaaagaagtccaggattcaaagtcaaatctgtgtggctccagagcccttggtctttgctaagctgccatgacacttccctctggagtgctgttatccccctccgtgggtgcctagagttagcctattcccaggatctcctgcccctcagctcaaggtccaggttccaggaccatgaaagtgctttattcacctttgtgtcttccatagaacttaacacaaagctttatacagagagtgaccatatgttctgtttatgcctcttgtcccagtgcagtaattaattgtgcccctttcactctcaaaagtgtcccggtttggacaataaattatgtggtcaccctacttatacagggtcctcccaacccagggacaatggcattttaatagaggaccctgaaagacagaattgtctttaagactcaaagaagtaaatcccagatggtgaaattttaagcgtttatatcccagtaggcaagagaatgtagacaaagattctgctcagcaccccacaaacctaccacaaaggactatttctaacacccgatttgagggttgtgggggtcaccaggcctgtgatgagatttgaaagggcaggagtcccactgtggctcatggaagtgtctgacaagcaaggccagaaaaggggagggacagcaaaaagctgttgcttccccacctccccaggcaagagggaagcccctgcctagcatttgattgttctcaagcccccagcctccctgcaggaaagagctaatggggattggccctcttcccagcgtcaccctcagcccctggtgggcccctgggctcagcttccccacgctttcttgtcgggttccctcaggccctgcccttgtaccctggacattggtccatactcagccatggcgtgtgcaagtcacattccaggctgtgtccttgccccatttgcaggcagctgaaaactgctgtgcatatgtcagttcacacttgaactggtttaatgtttttttcttttaagttgcaatctaaaattcagccagacaggctttaacgagcactaaatcgtcaagccttttgtttcccttgctattcaagccatagagattttgtgtttgattcagcaacaattgctgaatcttaaacaaaccatttacgttttgacattaactattttacgagtgtaactttttctttggtatttgagtgattccagcagaaggccttttaatgatttatcagaaatagagttaaaagagtctgtggaaggtgattcttaacattttcttttggggaaaaaaggaggttttcatctgccttcagttgggcagtacatacagaagtttagctttcctcctcctattttaataacttttgatcttgtcaaggtcattcctccagcatgccctcctgctcagctcctccatttttcagacaacccttgcacccagtggcttctctcagagtggctctctgcgcgtctctgtcggctgttaattttgtctgatagagacaggaactatgttcgttctttgctctagccctggtattcttaactgaggtccctgtgcacactgggcgtgatcagtatttgtcaaccagctgactggacaaagagcctcagacaaatagcatgtttgcaaacaaagccatccatcattctgtcccttgaagctgtaagtaattggaacttttctccagttcttaaagatttccacagaatgggaagtctccactttcctttaggttcccattccggtctggtgagtcaggtcaaagggccttgagcaaggtcaggcctcccagtgttgttcctgcttccgggaagctctgtatttttctcagcctccagtgagacctggtgaaccccgcgcctagctgaggagtcagcggatctgcccagttttcttctctgttacaatgtgagccaagtggccaggcctaggaaacccatgctaggggggcctgagactccctgtgaaatgcagctagctgaggaggccatgttgatccgcccccacggaaaaccgggagcctgggtgctgcacttgcctctctgaactagaactaattgttcttaaagatctttccaaataccaatgatgcaaaatatttggatggttcaccatattgttcaccatatttaaactgtcagaaccttaaatatctgagcaaaacctcagcaaacaaaggatattttggggacttgttatgtgtgttgcacagcagagagatttgtagtctatacgacttccaaatcctgtaaacgaagtatttcagtgttgtcattttcagctatagaccgtcctacgatcattgccttttcttttgctattaagagatggctcattcataaacattcctacagttgtgtggcaaacgcaaaataggccctgcgtgattccactggctctgattgaggagatgatttttcacacagtgagatttatcatgtttatcaagtttatgacagaacacaaggagggtgaggggatgtggaggttggagggagtgcagatctgagtgaggaaggaagctctttcctgagcctcaaagggcgggttgacaaggtgtgttgcctataagcttggagcaaggattgtgtgggccatttccttggatcccctcttgccctgcagggtctggcctcctccgctctcccccagccaccagacatggggatagttataccaccaactgagtatagaagacctaaaataacatcctctgtgttctctaataaagttgataaatctcagtgtgtgaaaaatctcccgtatgttttagcttaaattttcttctgcttaaccttgttactcctgccttgcctccctcagactgcctgagacaattactcagggacattctttgaataattagaggctgcagataattctctttagcccgctttcttccatgttccctaccctgtggtctccctttagccagttctaattagctgctttgatccttcctcccaatctctccctctagcttgttaattacatttctcccccatgaattccttctgtactggctttgtctatccagtcagaggagctgagaatgggaatctaaggccactcagtgggaggtcttctttgtcccccaacacagatagctcctctcccttctgagaagcctgaaaaccctggcattctgtcttagcagaaaagtaaaaataataatttttgttaaatggtatattatgataaaacagctgttatcctaatgcttggcatttgccaggaactctgggtatgtttatgtatataaaatcacatttcatccccgcaacaatcccatgagataaatattattgttattaatccctgttttacaaatgcagaaactgaggtacagagaggcttagtaacttacctcagtcacacagctgaaaacactagaatctcggactttcacctaggtctctctgactccagagcagcactcagtgttttgcttcctgggtttgggctttttggtgaagaggaaaaaaaaaaaaatggaaaaagtccaggtcattggcttttagcccaccaaaaaactaaccaaccaatcaactctgaggtaattgtcaactctttaccctccgtgtagaagaggctttctcaattgaaattataaaactggcacagaagcaaactggcgtggtgcacggggtatctgggcagttggaaatcttctagaaaaaaaaaagaaaccaataaattcttcacttgctttaattcttaattctcttttctgacagttttctctctcaggaggttaaggaagcaataaggagaagggcctcactgaaattatattctgagcaacaagaaggatctgtctggtaaaaaaaaaaaaaaaaaaaaagtctagagaacatcagcagaaagtgactgtgtttggagaagctaaaaggggaaggtaaaactctctgcctctgagttttagggaaagtaaatttcagagggtccaggaaaaagtagatatgatgtctgaacaggagcttcaaaaggaaagatgacttagagtttgaaaaatgaagtgtacttaatagagtcacgagtgattactgcagggaacagggagccacctaaagagacccacatggcttcagggggcacagttcgagctgagattttgtctagagatgaaaaagggacctgtaaccaagagcaaatagagaagtggatgcaacctccgagaacagtgtcaggagcaccagatgggtgagacctgggaaacactaagaacaacaaaggcgcctgtgcagctactgttgagagtgagagggatggcaaggaaggctttaggccacctggttcaatcaggtgatttagcagatgccatagagggcatctctgtccttactgcttattctgtttgcctctgccttctctctcaaggagaatggccttcctgcagaaagtaaaacaaacatagagttaagtggaacttgagaccaggagtgtacaaaaagtgtaaatgaaccactggcttctccaaattagacagggtctgaaaaattaaatgccagacagaaacttagggacatcatcatcaaactgtgtgcagaaatctttatggcattatggggattgggagaggggcaaggagacacaatgggcaactgttctggttttcaaaataacagagcaagtttttgagatgtgacttaagagtatttttaaagaaaagaggtcatttcttagagttagtgtgggttccataaaaccaggtcttgctggactagtttaatgcttaagtcctccctcccccatccctccatatagaaaagtttaacacattctacttgatgaattattgaaagtggagacacccatgtaaccaccacccagatccagaaatgtaacattatcagtaccccagaagactgtctcaagttcctcccaactctaattttctttttcataagatttgccaggctggcagattaggccggtataatagacacagaggaagtctgcgtttcaggaaatcatttgacagaatctcataataatctaatagatcagatagagaaatgataataaagacgtagatttgaggccgagtgccgtggctcacgcctgtaatcccagcacttgggaggtcaaggctggcagatcacttgaggccaggagttcgagaccagcctggccaacatggcaaaaccttctctccactaaaaatacaaaaacaaaaacaaaaacaaaacaaaactgggcatggtggttagtgttgtggtgtgtgtctgtagtcccagctacgtggtaggctgaggcatgagaattaagcttgagttctgggaggtggaggttgcagtgagcttagattgcgccactgcactccagcctgggtgacagagtgaggtgagactctgaatcaaaaaaaaaaaaaaaaaaaaaagacgtagatttgtagcagcttgaacaatcagacttaatcaatgtttatttagaaatggttcaagtggttcaatgtcaacagagccttcactgtagtgatgtgccaaagagcttgtggcagactctgtctgtctaacctgcattctggttctcatgtgaagatgtgggaacagatggcacggatcaggaagagataaccatgtaagatacatgacagtgagaatccaaaagaatagtgacaggctaggaggaagggtctaggtagccaagtggcatgttaaattttattgttattaaacttctaatttataagtaattcagattccttgtttaaaacaaaaattcaccacccagaaataaatatatggtgtcatatcacccataccatttgtaatttgctttttgcctcctgacaatatttattctttagtaagaataaaatcgaagccctgtgcttggcttcagagccatgttggggaccccctggctcatcagaagatcatgtgagcagcctttagggatttgacctaggcaggccactgtaagctctgtgaggctactaacaaaaatctagagattgaggcattaggggcagagtggccctggggcagaggcagccaggcccattggactgtgggtggggggttgtccagcctggatccctgagggtaggtttgggcaccaccactgtagggattcatcagtaagtggaacagggtcccatagagcattgtcaggaaagtggagagtttcaagagtcaccctgagaatgactgcagaatcccgtgaggccacgttgtgagaggggagctttctctggatggttggctgctcccaactttcagaagggctgacctgtcaggacaagatcaggcaaccctttctttcttcaagggtagacttaggaccagagggtataggaccagagggtataagcttcatgagagcagatttcagctcagtatcagaatatgtttttctggcaattggaggagttttaaactagcgtaaagctgccttgtttgatgatgtagtcttcaagtactgggctgccaattaccagagatgctatactggataaaaggttgagcattgactctagttatcccaaatgcttgtcctcagaacgtaggaatcacatgtggcatttatgaaaaatcaggtcttcggagccacgttctctgagattatgatttagtatatgcagggtagggcttggagtctgtattttcaaaaagggctccaattgttccttggagaaatggctgattccatggctggcacgggaaaagagcaatatcttgtacaagaacatcctgtgccagaaggtaagaaaatattaaagggtgatggaaacatgttaaaaagacacagaagccagcatgaaaatgcctggtgattaaggataatttgagcattgaagtaaatgatagaaatggatgccattccatagattaaataagaatctattaatccatactgataccagtaaatgaatgaatgaagaaataggaaagaaggaaaacctcttcttttaggtagaatgccagcaaataaagatagaaacaagaaaaataaagacaggagtttgaatatcatcatttgacaaacatcatggtacaggttgaacatcccttatctgagatgcttgagactagaaatgttttggattttcttttttttttttggcttttggaatatttgcattatatacttaccacttgagcatccctgatccaaaaatccaaaatccaaagtgctccaatgaacatttcctttgagcatcatgttgatgcccaaaaagtttcagattttagagcattttggattttagatttttggacttaagatgcttaacctgggataattaagcaagaattgtcaatgattgccaaaacgactacatgaaagtttgatgaggaataggctgtcttcatatctcaaagtgtctccccacaaaatattaatttcagaggaacaaatagtatttttatagtggagaaatctggcagataccaccataaccaagtatgcaaagaaaacatccaattgtgagacttatggacatcacttgccctcctatgtgatacactgagaaagatacggcattgtgtttgtgtattcctgccaaagccacagcctcagtctaatcattagaacacattggacaaatccaaactgagaaacattctaccactggcctgcacttttcataaatgtcagtgtcatgaaagacaagactaagggacagttccagatgaaaggagaccaaggagacaggctgctgtgtacatcgtatgggcataaatcggacgtggggtcaaaattatttttctaaaaacaatattattgagagggctctgtgcagtggctcatgccggtaatcccaacgttttaggaggccagggcgggaggattgcttgaagctaggaggagttcaagaccagcctgggcaatatcgtgagaacccccatctacaaaaaaaaaaaaaaaagtgtttcttaaaaagaggaaagagtggggggtaaggactattattgggacagctggcaaaagctgaataaatatctgtagattactgtgtcagtgttagtttcctgattttgatcactgtactttggttatgttcttgggacatacacactgatatgtttaggggtaaagggtcttcatatcttcaattactctcaaatattttaaaaaagaaaatctgtgtaaatattaagagagacagaaaattgtggtaaatgtccacaattggtgaatctggatgggagtttatttactattcttgcagctttccagtaagtcatttttttgtgtaattacttttctataatttttttttctttagagagacagaatctcactctgttgcccatagctcactgcagcctcagcctcctgggctcaagtgatcctcctacctcagcctcccgagtagctgggaccataggtgcataccaccatgcccggcaatttttttttttttttttttttacttttgcagagacggggattttaccaccttgtccaggctagtttcaaactcctggactcaagcagtcctcccaccttagcctgtcaaagtgctgggattacaggcatgagccaccacacctggcctattttctgtaattttttaaagcactagtctgaaatggtttcaggaaataaactgcccaggtgattgtgacacagggctgtgttggagagctaccagatgaccctcaggaaggtgatttgctgcccctccctctgaggttccctttatctcctcagaggtgggcagatgattgtgtctgtgtgtgtgtattgtgtgtgtgtctgtcagtagggtctagagaccctcttgtgagttgctgttactgtggtgaggagtgggtgtctcatagttgcttacgtgggtggcttccagttgggggctgtacatgaaggggtcagatgatagccctgcctttccccagtgtccagatggaactcctgaggccatacaggtcccaacacaaagtgatgtgcagctcatgtgttttgttattcctggaagcttgactttgtagtggaagatttgtacagtgttttttttgttttgttttttgttttttgttgttgttgttgttaaacctattccatttttattcaattcggtaattgtatcttttttttttttttaagatagagtcttgctctgttgcccaggctggagtgcagtggcgtgatctcagctcactgaaacctctacctcctgggttcaagcgattctcctgccttagcctcccgagtagctgagattacaggtgcctgacaccacaccagctaactcttgtatttttaatagagacggggtttcaccatgttggccagactagtcttggactcctgatttcaagtgatctgcccgcctcagcctcccaaagtgctgggattacaggcgtgagccactgcgcccagccaattgtttgtatcttaactgattgattacctagccccactcatccctggatggcaggcaaatatagatgtctcttgaacccatctatttcaggattacacatcctgcaaattcttgctttcccagatgatggaggccacacattaaggcataagcaaggtggggccaccagaggaaatctttctttctgggcaagaaggtgagctgcacttcatcaggtgaatgattgagcctggccccatatacccctgagatgtgccctctgccctcagtgcatggcatcatctcagaggcatttcagaagaaaaataatagttttttcctgttctaagggaatgaaaagagtatttgttgcacttagaaatgtcacgaggacgcgtgagtgagcacatccctctgctgtgcctctggtgtcctggtctggcctggcagtctcaatcacagaagctctcttcagttacaccttagcatttccttggcccccatctaactagtcaccctcatccttattcccatcctagagctctgccttttccagttgttttccttttcagaaattcaagcttacttttcagcccttgttgttccggttggttgaccctggagcaggatttccgtgcacataccttgttggccctgccacccgtgcagcggcacaggaccccacactcaaaagggcccgtgcttggcttcatgctctgttctcactgtcttgaaatttctgataattcttgaacaaaaggccctacgttttcatgttgcacttgggcctgaaaattatgtagccagccctgagcccaagggtgaagtcagccccggggtgtgtgctgggcagcaatctcctgggccccctggccgagctgggctgccttccctgtggtcagctccttcagtccccttccacccagacacttgcttagcttcagttagctaaaatatgacctctgactcttggctgattgcccaaattgctgtcaccctgacccaaactctttggtttttgcaaatgcaatcacttccatttttgcagcctgccccacccccagcccatctccctgcaagatttacagagtagcagctgctgtcgtccctctgcacacagacagctgacttgcctgctgattgtgaacatcccagtaatccaagtgctaatggtatttatttagtccagccggcttagccctgaacaaggtttattctcatttatcgcatcggagatgagctacgtccttaatatccttctgttgactttgagcacaccagcgccactgatgtcactttgaggcgtgccaggcccccgcccccttaactcagatccccaactgtcaggacacctaccttccagccagcaggactggtccctccaggggtgggccgcagctctggtccagagtccataggctggaggaggatggggctgccatacatgatatgtgctcgaggcatccaggccaaataaagctgtgctctcaaagatgtggtctggcctctttgtgtagtgagcctactgtaattatcttttggccacagtgcattggctagcagtgtggcattttggcattcattaactgttctgtcttttacatgggtagtcctagctctgcctcacaggtgaaaacttgcccaaggccatgagccattcattgcttatgagattcccagcaagggtcctgcaggccctggtccttgcacatccagaggcctcactctgagctgttttggtagttgcctcccccagccccaggctgtgagcatttaaagcccaaggcagagctgactggcgagagggtctgtttctaggagcagattctacccttggtgggtgattgctcaggaaaccttcagctctactggccctgcctggatggactgaggagcagctggaagcgcaagcctcatcttccccctcttcctctgctgtgtttcttcaaccccttgcctgggcagccctaaaaggccacttcacagggtggccttttaggaaactcctgaagctgtgggaaccctggggtaaggcctggagttcccagggttccatgggtacctcgtttaagctgatcatgtgaagaggccaggcagggcatgggcccagggctgccaaggctgtgcactgtcacagcccatgtttggcccatggtcctgccgtacccacagacttggctgtgggtgaaaacatgaatttattgccttatgaacctgatttcagcaatttacaaaaggtcagactttctcttttctctccgatttacttatctgatgttggagctctcttctctcctactctaaatggggtgggaagagcctgcctgagggggacagagtgggtgggactgggctgctgctggcttggctgtgggtggctcccgacccacatcagcccaccttctgaagagaagggacttctctttgccctggtcacagtgcagaaagtggaagggctttggttgcccagccctgggtgattaactgaggctgcgatgatggggtgctgtgatgagctttgtgctgtctttggagggccttgtctctgctgctctgagggcccatgagggatgggactccttggcagtgctcccaaaggctgatgcgatgtcagatctctcagcccccttggggaagcagcatttgatgtttgtgtgaatctctcagcgtggtcgtcttctcttcctggaccctcctgtcatgggtgagcgttccttaggcacatgatggcagagacagccctaattagctcatgctttgatgaaacagctgcctgtctcaagtcgtggggggcaggggagcagctcagctcccaggcccccctgcgccagcgcctgcctgcctatctggagaggagctgtcagcctcccttccccagggactctggcccatctccaggctgctctgcagacacaggggtggagttgctgtgggacgggctggcacccaccctgtacttcctttctggctgagaggctacagagtgacacgtggtacaaaggagcttttctctttagaaagctggctcagcgtgctcggtctgctctggaccttgaagcttgttcctggtcagaatagaagtggggagctatcttcattccattcagccagctttgggggcacgcctgctgtgtgtcgggccctctcctgtacggtggcacagtgtgtcttttctgggtttaggaccaggagccagctccttctgatttgtctttgtttccttataccctggctcactctcaaggacaccgtgagggccccctggccaggagggttgggagttaggaggaacaggtgctttttgggtctctgggagcttgtggtcatgccaagggcaggcagccagaggcatgcggtggctttggtagactgcggtgtcctttgtgggctagttggatgggtgtgacagccaccatctgactgctggcttggccccttcacttgttgttggcctcaggcttttgtgtgcctgtcccctcttttctctggggcctcacatgtgggctgctgagaggggagccctgacctgcccaagggcctgactatctggtccctgtgcttgacacttgctccttaattgatccctaatgcaatcttgaaaagcaaggagcctgcaaaagggcatcctgtgagggatcccggccttgtcccctgcatggcaccctgccctgatgggggtccccgccaggcccctcatcccttcatctgggaggtctgggcctgaaatgttttaatcacatcactatttctctagcccagaatggggagaggagttccagaggcagctcagggttttgagtactttagtgcagtatgtttatctattgatatgttcatggttgtgtacacgtgttgttcattcgttcgttcgttcagtcgttcattcattccctactgtccagggacctgtgacgtggcaggctctgtgctgagtgctgagaatacagggcagagaagctgacagtagctgctgttatagagtgggagcccagtgggaggcattgggttgtcctgttttaggatctgcctgggtattcagaggctcctgtctcttgcactttcttcctgccttctcccgcaagcattttctatgtgcagtctgagtgccgacccaggagaggagagggatggggccctggccttggggcaccagacccagaggggaacagacccattagtaattgccccagtgtgtgatgtgcttgggtcatggaggaaggaacatccggcactggcttgggaagcgccaagaaaggcttcctacgggagggacgctgaaggagcaccttcggcatcgaaatgtctttacagtagtagaggttgttcaccttcccagcccactccagccccttggctgctggggagtgggggctggcatgggagcactcagccctgtcacctgtgctgtgggccgctgttcccacgtgggtctgtgccagatggtctttgtttccccagctgagtttgacttgccccgtgtgggaacctctgttgttcttgtttctccccagggatggctgacatgggctcagttccctgaccatccgatccctgggctgggcagggtagtcatgctgtcctgtgcttcttccccagcaaccccaaggtccaggtggaggccatcgaagggggagccctgcagaagctgctggtcatcctggccacggagcagccgctcactgcaaagaagaaggtgtgtttccatgcccttcctcctgcccagcctccaggacacgtgtggggcctgaaaggaaagggttcctgtccaggctgtgcatgttaccatgggggcctgagcatcatctgctgggtggcacagggggagaagttacactcaactaaagcagatggcagtgtgccgaggtgactagaggcctgggggcagctcctgtgctgtggccttgggccctactcctggcctcccacccttggcctctgtttacctcccatttactcacttggtaatgttgaaggtgtctgagtccctcctggcctcacagtcctgggttctggggtatagctgtaactgaggtggggccgggaggaatggggactaatttggggcacctctgcctgccttccctgggcctcagggcaggtccagctcgcttggcccctcacctacccctgggtctgtgcccccaggtcctgtttgcactgtgctccctgctgcgccacttcccctatgcccagcggcagttcctgaagctcggggggctgcaggtcctgaggaccctggtgcaggagaagggcacggaggtgctcgccgtgcgcgtggtcacactgctctacgacctggtcacggagaaggtgagtgcccaggcccacccagtctcctcttgtttgctttgtgtgtgcttctgggtggatggacagacagatggaagagactgcggacgtcacttgtttgctttgtgtgtgcttctggatggatggacagacagacagttggaagagattggggacgtcagggagtatgtcatgtgagatgtggtggctaagctgaaacctgagggctgatgaggagtgggaggtggccctgccagccatggtcacggccaagtgtgcaggcagagggctcagtatgaggcaagccttggagcagccgagaccaggccccgaggggacaaaaggctgagggggtagaacagcccagagctccttcgaatggcactcactcttcggattctagaaacgtggaggtgcctcctctgtgagctttggctctgggcagggcctcagagtggctgcccttgagagtctcagggacccaattgcttgccacttgggaggagacttggtgcccagccctgtttgcaagcttgaagaagcatcttaattaaggaggagagaggaaaaccagccaggcctggattcttaattcagctactgcagagagcattggcagggcttcctcagttgcctctctcgggccacacgctccccagaagagccgcatgccgactagtggagcagggctgggcagccgctggaactgctgccgaatggtggaggctgggcccctcactccctctgcacacgcctcccccaggccttctctcccaggcagtgtcgggatggctgtggccacctctgtccatcactgtctctccccaactctctgtctttgcctgtttctctctcttctcttgttaaagctgcagaaatccagtttcttagaacagcaggcagccatgtggtgctcagatccaattgataaggcctgggcacagttcaggttctgggactgggccagtgagcctggagaaggacatgtcagctggctgggcatttcccagggaaactgggctctgttctctggtgtcttgggtgtgtgtccctgctgcccccagccctggcatcctgggcactatggcactgacacattgctagcacactaccaccaggcaggctcaccaaggctgccccgaggctgccggccccgggagcctgcctctggaagctttggggtgctgacatgattggggaggggaggactggcatctctctacaaacagtacagaaatggccctcttctttcagggaggacagcagataaatttcagccagagagatttaggacacactgtacttgggctgaggcagtcagggcttctctgttcttgtgatttcttttttcttttttcttttcttttcttttttcttttttttttttttttttgagacagggtctctctctgtcacccagtggcacgatcttggctcactgtaaactctgcctcccagactcaagtgatcctcccacctcagccccctgagtagctgggactacaggtccatgccaccatgcctggttaattttgttcgttttttgtagacagggtctcactatgttgctcaggctggtcttgaactcctgggctcaagcagtcctgcctcagcttcccaaagtattggaattataggcgtgagtcactaagtccagcctcttgcagcgcttaagaatgaagacctagccaagctaggggtgggtccagagctgcctgaaggtggagggacatgagctgtccaccacgatggaggggtgccatgcagctcggggatcactgcagcatgttgtcatgacagccaaggactgtggaattcccatgggcaatgtgacacccccatcagggtgctggggtctgccaggccccaggcagtcctcatatgtaccttggcctgtgagaggacctctactgagagaccatgccctgacatctgggcttctgcagtggtgagatgcctgcctggggtttggattccatggcctctggtgcatctgaggagctgaagggccgcagggggaccctgcctgcctgtgctgcctgctgtgccgggtgctgggaaaataatccgcagtccctgtcgtccctgagctttcaggcagatgtttatcagagaattcccctgagcttgtgttgtagtctgtctgctgctgctttaacagaatacccgggactggataatataaagaaaaggcagtttttggctcatgattcgggaggctgggaaatccacgattgggtgggtgcatctggcgggagcctttgtgttgcatgacaacattgtggaaggtgagagggcaagagcacttgcggaaaaaagcatgctgggccgggcttgctctctagaataacaaccgctctcccgtaaggaacccgctgccctcctgacctaggcagctcctctcaatactgctgccttgggaattaagcttccaacacttgaacttttagggaacacactcaaaccacagcagcatataagcagagaaggccagtcaggggaggccggtcagtggcggtgaggtgtgcagggagccgtggagtgaatggggccaatgcgggggtgcacctggaagtcggagctgcgcctccagaggccccaggggagagttagagtgacaggagtgggtgtgagtgggtccaggccgcgcacagtgggggcagagcctgcagagcctcgcagtcccagggaagggattgattttgtctttatcacccgcaatgccaggctgtgagggtttgggggctggaggagagggtgagagcaggaggcactggatcgcaggacacaagggacaaaggtggagctgacagaattggggtgtgttttggaagcgaagctggcaggactgaggggtgaagtaggaaaggactaggggatacctctcagcctctcctgtcccaggatgcaggattgcacccctcctcagtttcctctgccagccccaatcagccccacgacttcctgctgccgcaggaagcacaggtggtccactgtggcctcctcttctcctgggcttccctcttgccttgtgcatcttccctgtgcttcattctcccctggagttagggcaggcattccttctttctccatacaggcacacttcctacagctgcacgggagatctctgccccctcccaaccctctacctctgaccttcaggtaacctgcctgcttgtcatggttcaggtgttggctttcccgctgctggtagcccggcaggattggctcccaccatgttctgctgatagagctgggcttctgcgctttacagacaggctgagtttctccacttaggaggtgatgacgatgagtctcagggaggctaagtgccagccatggtcattcagcaagtcagtggtggagcaggaatttgaagccagcctgtctgcctccatgctgcactgttagattacatttatgctatttgggaattagttaatttttattctcctgctagaccttaagctccttgagggtaagactatgtctccatcgtggtttcttcagcacctggcaccacacaagtgtttctgttggtggatgaatgaatgaatagacagacagacttggggatagaggaagaggtgggccctcaggggtcagcctcgtgccttcctgtctgaagggcagagctagccaggtgtgagctaactgctccctgtgtgttctctccccacccccaccctacctggcctgcggctgtggcggatggcagatgttcgccgaggaggaggctgagctgacccaggagatgtccccagagaagctgcagcagtatcgccaggtacacctcctgccaggcctgtgggaacagggctggtgcgagatcacggcccacctcctggcgctgcccgagcatgatgcccgtgagaaggtgctgcagacactgggcgtcctcctgaccacctgccgggaccgctaccgtcaggacccccagctcggcaggacactggccagcctgcaggctgagtaccaggtgctggccagcctggagctgcaggatggtgaggacgagggctacttccaggagctgctgggctctgtcaacagcttgctgaaggagctgagatgaggccccacaccaggactggactgggatgccgctagtgaggctgaggggtgccagcgtgggtgggcttctcaggcaggaggacatcttggcagtgctggcttggccattaaatggaaacctgaaggccatcctctttctgctgtgtgtctgtgtagactgggcacagccctgtggccggggggtcaggtgagtggttgggtgatgggctctgctgacgtgcagggctcagcccagggcatccaggaacaggctccagggcaggaacctgggcccaggagttgcaagtctctgcttcttaccaagcagcagctctgtaccttgggaagtcgcttaattgctctgagcttgtttcctcatctgtcaggagtgccattaaaggagaaaaatcacgt
